United States Patent 10,407,724 (METHODS AND COMPOSITIONS FOR SCREENING AND TREATING DEVELOPMENTAL DISORDERS) - sequence listing, part 85

SEQ ID NO: 2461 - DNA, 19829 bp, Homo sapiens
atctcaaaaaaaaaaaaaaatagccaggcctggtggctcacacctgtaatcctagctactcgggaggctgaggcatgagaatcacttgaacctgggaggctgcagtgagctgagatcatgccactgcactccagcctgggcgacagagcaagaccttatctcaaaaaataaccatccaaggaaccaaaaaaaattaaaaacccacatatgggtctctcctttactttttaaaattaattttattgtcaggcttgacatccattaagcaaatcacctttttttttttttttttcagacagggtctcactctgtcacccagactggagtgcagtgaggtgacatcacagctcactgcaacctctgcctccagggctcaagcgatcctcccaccccagcctcccgagtgtctggaactacaggcacaagccacaacactcagctaattttctatatttttagtagagacagcttttcactatgttacccaggctggtctcaaactcctggactcaagcaatccgcctgccttggcctcccagagtgctgggattgcaggcatgagccaccgtgcccaccctcaattcacttcgtaaaaatttttttatttattttttgagacagggtcttgttctgtcacccaggctggagtgcagtaatgtgatcacagctcactgcaacctccatttccagggctcaggcgatcctccctgctcagcctcccgaatagctgggacaacaggtgcgagccacgagccagcatgcgtggtaaatttttgtattttttttttttttttttgcagagatggggttttgccatgttgcccaggctgttcttgaactcctggcttcaaatgacctacctccatcagcctcccaaagtgctgggatggatgacagatctgagccaccacctggccaagcaattcacttttattgcatgtattgttcttaggtttattttatagttttacagtttacacttttataatcttcaacatctaaagataacataagcctgtttgactagtcttaatttacataagcaaatgtggttttctaaagtcaatgaaatagagctcctttacaagttaatctttaggaattccatcaagagggagaaagtgttacatacctataacatatatatatataaacataaataggtgcagtcagaaatcttatagctttcattttaaaattatagctgtgagacaggtgtgataatacaaaactcactagtttttaaaaaaatggtggagccgggcacagtggctcacgcctgtaatcctagcactttgagaggccgaggcaggcagatcatttgaggccagggagttcaagaccagcctgggcaacatggagaagccccatctctactaaaaatacaaaaattagccaggcgcagtgactcacgcccataatcccagtactttgggaggccgaagtgggctgatcacctcaggttgggagttcaagaccagcctgaccaacatggagaaaccctgtcgctaccaaaaatacaaaattggccaggtgtggtggcacatgcctgtagtcccagctactcgggaggctgaggcaggagaatcacttgaacccaggagacagaggttgcagtgagctgagatcgtgcctctgcactccagtctgggtgacagagccagactcaatctcaaaaaatataaataaataaataagtgagatccaatttgcatctgcagaggcagatgaaatgagttaagattacctactcagatcatgaaagctttgtgctaacatttgtaaagactgttaaaatttttcacttgccagttggtttccaaattgccctctgagaacacagttctgatccattgcaggggagccccaaattttgggcttagcccaggagggctcttggcttcttctaggaaagtatccaagggtgacctggtggtgttatacagcacctttttttttttccctgaaagagtcttgctctgttgcccagcctggaatgcagtgatgtgatcacagctcactgcagtctccaaatcctgggctctagaatcccctttgcctcaaacttctgagtagctgggactacaggcatgcaccacctatccgagctaattttttaaatttttgtggagatggggtcttgctatgttccccaggctggtctcaaactcctgagctcaagtgatcctcctgcttcagcctcccaaagtgctgggatcacaggtgtgagccataatcccagcctgataagaattcgtccttttcttttttttttttgagacggagtctggctctgttgcccaggctggagtgcagtggtactttctcggctcactgcaacctccatttcccgggttcaagcggttcttctgcctcagcctcccgattagctgggattacaggtgcctgccactacgcctggataatttttttgtatttttagtagagacggggtttcaccatgttggccaggctggtcttgaactcctgacctcaggtgatccacccacctcggcctcccaaagtgctgggattactggtgtgagtcaccgtgccagcctttttttttttttttttttttttctgagacaaagtctcactctgttgcccaggctggaattcagtggtgctatctcagctcactgaaaccccagcttcccaggtttcagtgattctcctgcctcagactcccgagtaactgggactacaggcacacaccaccacactcagctaattttgctattttttggtagagatggggtttcaccgtgttggccagactggtcttgatctcctgacctcaagtaatccacccacctcagcctctcaaaaagctgggattacaggcatgagccaccgcgtccggctgaattcttactttgcattggcttgtcaggtcccagcatttctcccctgcagaccccagagggagcagatattcccagccaattgtagcccatcctcatcaccagaaactagcagggctagagctttcctcctctctctggtgtctggctcagactgacagacagattaacaaaacaatagcacacaaagcttattcattgtagatgggagccctcacgagaaaaatggagaccgaaaaaagtaactagacctaagtgtttgttttgagacagggtcttgctgtgtcatccagactggagtgcagtagcgggatcacagctcactgaagccttgacctctcaggcccaagcaatcctcctgtctcagcctcccaagtagttgggactagagttgcacaccaccacacctggctaattttttaaaaattttggccgggcacggtagctcatgcctgtaatcccagtactttgtgaggcagaggctgggggatcacctgaggtcaggagttcaagaccagcctggccaacatgataaaacccgtctctagtaaaaatacaaaaattagccaggcgtggtggcgggcgcccataatcctagctacttgggaggctgaggcaggagaatcacttgaacctgggtggcggaggttgcagtgagctgagatcgcgccactgcactccagcctgggcaacagagtgagactccttctcaaaaataaagaaaaaataaaaagatagatcacagagcccttctgggctggctgcggtggttcgtgcctgtaatcctagaattttgggaggctgagatgggcagataactgaggtcaggggatcaagaccagccagaccaacatggcaaaaccccgtctctactagacatacaaaaattagccggccatggtggtacatgcctgtaatcccagatacttggaaggctgagataagagaatcacttgaacccgggaggtggaggttgcagtgagccaagatcatgccactgcactccagactgggcaacagagtgagactccctctcaaaaaaataaaaagaagagcccttcttgcatccactgtttgcaagtgtgtttaactcaaaattctcaatatcaatatgccaaagttgtatgctggtatgttatgggtgacatgtcctgaacactatcaacagaaacatacaaaaattactgccaggtatcaaaagctgctcttcctgggaagcaataaagtatcttttgtttttctgtttttgagacagagcctggctctgtcgcccaggctggagtgcaatgacaagatctcggctcactgcaacctttgcctcccgggttcaagtgattctcccgcctcagcctcccatgtagctgggattacaggcacccgccatcatgcctggctgatttttgtatttttagtagagacggggtttcactatgttggccaggctggtcttgaactcccgacatcaggtgatccgcctgcctcggcctcccaaagtgatggaattacagccatgacccaccgcacccagccccataaattctcttaattttattttttattttactttttgaggcagggtctcgctgtgtcatccaggccagagtgtagtgtcaccatctcagccagctgaagactcagcctctgggactcaagcgatcctcccacgtcagcctctcaagtagctgggactacaggtgtgcactaccgtacccggataattttgttatccggtcttaccatgttacctggtcttaccatgttgcccaggcatctgggcaactccaactcctgacctcaagcgatcctcctgcatccaggtcccaaatggtaggattacaggcataagccaccgagcccggccaagcaacaatttttttttttttttttgagacaaaatctcgctctgtcgcccaggctggagtgcaatggcatgatctcagctcactgcaaactccgcctcccaggttcaagcgattctcctgcctcagcctccaagtagctcagattacagacatgcaccaccacacctagctaatttttgtatttttagtagagatggggttttgccatgttggcctgactggccttgaactcctgacctcaagtgatccacccgccccagcctcccaaagtgctcggattacaggcatgagccaccgtgcctggccaataaattcttaatttatccaccattgtctctcagcaaccagtaatccatttgtagattaccaaatggtcagctcaatgtcaaacaaaactatgggagaccactgttttggactgagctcctgcactaggcaccaacagaccagatgaaaccagaatggagtcactcgtgctaaatgccacataatcaaactgaaactttgaggaagcagacatatcccaaacagatcagtttcttattttttttttttttaaatttgttttgtagagatgaggttctggccaagttgcccaggctggtcttgaactcctggcctcaagcgatcctcctgcctcagcctcccaaggtgctggtattataggcatggtccactgtgcccagctgtctttcctaaaaatagattttagtctacctgggccgggcacggtggctcatgcctgtaatcccagcactttgggaggccgaggtgggcggatcacaaggtcaggagatcgagaccatcctggctaacatggtgaaaccccctctctactaaaaatacaaaaaattagccaggcgtggtggctggtgcctgtggtcccagctactggggaggctgaggcaggagaatggcgtgagcccgggaggcggagcttgcagcgagccgagatcgcgccactgcactccagcctgggcgacagagcgagactctgtctcaaaaaaaaaagattttagtctacctgaattagcccgataaggaagtcccctctgctttaacacttaccaaaaaaagtaacctgaagttaatcaggtttttctttttctttctttctttctttctttttttttttttttttttttgagatagagtctagctctgtcgccaggctggagtgcaagtggcacgatcttggctcactgcaacctccacctccccgggttcacgccattctcctgcctcagcctctctgagtaactgggactacgggcgcccgccaccacacccgtctaattttttgtatttttagtagagacggggtttcactgtggtctcgatctcctgacctcatgatccgcccacctcggcctcccaaagtgctgggattacaggcgtgagccaccgcaccggccttattattattattattttttaagatattctgtagttatggattggaaaaatccatattgtcaaaatgtccatactacacaaagcaacctacagattcaatgcaatttccatcaaaatacaataccaatgacattcttcacacaaaacagaaagaacagttctaaaaaacagtcctaaatttatatgaaatcacaaaagaccttgaatagccaaaactatcctgagcaaacagaacaaaactggaggaatcccattacccaacattcaattatactatagatctacagtaacaaaaacagcatagtaccagcacaaaaatagacacatacataaatggaacagaatggagaacccagaaccaaatccatacatctacattgaattcttttttactattattatactttaagttctgggatccatgtgcagaacgtgcagaaggtgcaggtttgttacataggtatgtatacacgtgccatggtggtttgctgcacccatcaaccggtcatctacattaggtatttctcctaatgctggccgggtgcggtggctcacgcttgtaatcccagcactttgggaggccgaggcgggctgatcacgaggtcaggagatcgagaccaaggtgaaaccccgtctctactaaaaatacaaaaaattagacgggcgtggtggcgggcgcctgtagtcccagttactcggagaggctgaggcaggagaatggcgtgaacccgggaggcggagcttgcagccagccgagatcgcgccactgcactccagcctggatgacagagcgagactccgtctcaaaaaaaaaaaaaaaaaaaagaagttatttctcctaatgctatccctcccctatcccaccctctgacaggtcccggaatgtgatgttcccctccctgtgtccatgtgttctcattgttcaactcccactttctttttctttttttttttttttgagacagtctggctctgtcacccaggctggagtgcggtggcgcaatctcggctcactgcagcctctgcctccagggttcaagcgactcccctgcctcaccctccggagtagctggaatcacaggtgggggccaccacacccagtggtttgtttgtttgtttgtttgtttgtttgtttgttttttgagacggagtctcgccctgttgccaggccggagtgcagtggtgagatctcggctcactgcaacctccacctcccgggttcaagcgattctcctgcctcagcctcttgagtagctgggactacaggcgtgtgccaccgtgcccagctcatttttgtatttttagtagaaacggtgtttcaccgtgttgaccagattggtctcaatcacttggcctcatgattcggacgccttggcctccctaagtactgggattacaggcctgagccacctcgcccggcattgatcaggttttttttgtattgttctgtttatttgtcccactttacgaaactcactgttctcctattgcccagggggacatgtcattttatctattctcagtaactcatgcctgtaattccagcacttttggatgcaaaagtgggcggattgcttcagtacagttcaaggctagcctgggcaacatagtgagaccctgtctctactaaagaggaaaaaaaaacaaaacctttctttaaataaaagttttaaattgggggaaggaaggaagaaggctctatctcaaaaaaaaaatcagaaaaccatgaagggtgtcctctgactgggcaaatttttgttgtaaaaacccatattgtaggctgggcatggtggctcactcttgtaatcccagcactttgggaggccgaggcaggtggatttgagatcaggggttcaagaccagcctgagtaacatggtgaaaccccgtctctacaaaactacaaaaaatagctaggcatggcggcgggtgcctgtaatcccagctactcatgaggctgaggcaggagaatcgcttgaacctggaaggcaaatgttgctgtgagctgatattgtgccactgcactccagcctgggcaacagagtaagactccgtctcaaaaaaaaaaaaaagccatatttcagttttactttttacaggccaacaaatggcatgattgtgtttcaatgacgtttggcttattctatgacctgaaaattatatgaaatgcaaatttgtgtccataagtaaaactttattgaaacacaatcatgccatttgttgacaaaaagagtgaaactctgtaaaatatgggccgggcgcggtggctcacgcctgtaatcccagcactttgggaggccgaggcgggcggatcatgaggtcaggagatcgagaccatcctggctaacacggtgaaaccctgtctctactaaaaatataaaaaattagccgggtttggtggcgggaacctgtagtcccagctactcgccaggctgaggcgggaaaatggcgtgaacccgggaggtggagcttgcagtgagccaagatcgcgccactgcactctagcctgggccacagagcgagactctctcaaaaaaaaaaaagaaactccgtaaaatatttaaagaggttaattctgagccaaacgtgagtgaccacggccctaggcacagccttttttttttttttttttttttttttttgagacagtctcgctctgtggcccagactggagctatctcggttcactgcaacctccacctctcgggttcaagagattaccctgcctcagcctcccgagtggctgggattacaggcgcccaccaccacgcccctggctaatttctgtatttttaatagagatggggttttaccatgttggccaggctggttttgaattcctgacctcaggtgatccagctgcctccgcctcccaaactgtttgggattacaggcgtgagccactgcgcctggccaatccccaccttcttgactgaccatttaaaaaatgtaagaaacacctttagctcatcatgagcagcacaaaacaggcagggacaggatttggccctgaggcaggagaataggtctggaggcagggaacataaggccaaatcaaatggaaacaattcagctatgacaggaaatatcttctccatttaaagagggcatacatccagtaaatgactttgtaactttacttcatcctcttcatttacataggacgtacattaagtaaccagtgaaaacctctagagggcatttaaaccccagaaaattcttaaacaggtctcttgagtccgtatgctccactggctcccaccctgcggagtgtactttcgttttcaataaatctctgcttttgttaagcttcattctttccttgctttgtttgtgcactttgtccaattctttgttcaagatgccaagaacctgcacaccttcaacagttaacagcccacaggcagtagtttgcgactctagtagagaatgcatagggatttccattgaaaatcattttttaagccagttacggtggttcacgcctatcatcatcccagcaccttgggaggccaaggcgggtggatctcttgaggtcaggagttcgagaccagcctggctaacatggcaaaacccctgtctagaccaaaaatacaaaattagttgggcgtggtggcccgtgcctgtaatcccagctgtttgggaggctgcgacacgagaatcgcttgaacccgggagggagaggttgcggtgagccgagatcgcgccaccgcactccagcctgggtgacagagcgagactccatttcaaaaaaagaaaaaaaataattgttccctacgggaacggtataattaggatataattgtttctggccacagatcacatcccttctggttaagtccaggagaatctggaaatacgtagggcaaccaggccagaaggcgttgtaactgcctaagattgaccaaccctaacgcgggaggcgggacgacggtcactgatttgccagcgtgacgccggtctgcgactggccagtgccgtcctgggcgtgtcggtaggacggggctgcgacggtttcccataggctggcacagaaaggggcggggaaacaagagtgcaacgttaccaatcggcatgcgggacgtaacgcaattcttttttccgattggtccgtgaagctcgggaggtcgttgggggctcgaccttgggatagaacgcctgccttttattggtcaatactcttcgggccgggcaatgtggctccccgaggctgcctgcgattggtgaacgcgtcgcggctcggggcggacctgcggactgaagatccttatgcgattggccggggagccggaggggcgggcaatttgggatcgacagtgactcgcgactggtcggcgcggcgaaagcagagcggcgcgccggttccttggttcctgagggcgatggcgcggggtggctggcgccggctacgccgcctgttatccgcggggcagcttctattccagggccgcgcgctgctcgtcactaacacgctgggctgcggcgcgctcatggcggccggtgatggcgtgcgccagtcctgggagatccgcgcccggcccggccaggttttcgacccacggcgctccggtgaggacgccacgctgcttagtccttcaccccgggcgacctttgatcccgacacccgactgcgggccgtgacccctgacccgtggcctcagtcccccgcaggacccttgccctgaccgcgcctctccccgggtgtctgtctccccgcagctctgggtctccatcacctcccaacccccggaggtctctgcccactacccaggagcctctggagccgcgcctcctggtggggcttgtagtggaagaatgcacgggtgggctcttccggttttcccggtgaggctgaggctccgggatggcattgggcttacccaggccttagccagggagggagagagggaatggactgaggaacttgccggcccgacccagccccctgacttacactcttatagcgagcatgtttgcggtgggctgcagcatgggtcccttcctgcactactggtacttgtcgctggaccgcctattccctgcgtctggcctccgaggcttcccaaatgtcctcaagaaggtcctcgtggatcagctggtagcctctccattgctgggcgtctggtacttcttgggtaaggagcctcctaagcctaggctttgcctctcataggtcgggaggggtggagccagctttgtgttaagaaggatgcagaggtgcatttccaatttgccccctgtttgggtcgccctggactaggagccaggtcacagcggggacaggacggactcggccgatgtgaacgctggcgagtgtaggagggacgaggactgtatctgttggggctgccctgggcgggaggttgagagcatttcccaaagaaggggaccacactcagttgagacatgaagagggaaccagcgggcagagggaacagctaatgcaaaggctctgaggcctgaaggaagagaaattgaggctagacttaatggggtgcaaccgtgccagccctaggctcggtaaagacagcggtattaatagaggagtctctcattctccacctcccagcccggcttcctggtctgtgatggaaaagtaacacaactccctcaacttcagggtgtctccattggggcacgtgtttatatgtttataacctctctttctctcactgggactgacttgctctgttttgtctctacaccagctaccctaattctctgtccatcccatctgaaagtccctgtccctctgcccggggtgggcggcgtgggctctcaggggcccaaccccgccccctccatcgtcagcccatcttgtcgtctcaacagtacttcctggcctctaacactctcatttcttggtttgcttcccaggccttggctgcctggagggtcagacagtgggtgagagctgccaggagctgcgggagaagttctgggaattctacaaggtgggagcacccgccccttgcacatgtccggccccgccccctgatggccgctccgcccccgcccagctctggccccgcccctcatcccccgcctctccccgcaggcagactggtgcgtgtggcctgctgcgcagttcgtgaacttcctcttcgtgcccccccaatttcgagtcacctacatcaacggcctgacgctgggctgggacacgtacctgtcctacttgaagtaccgggtgagtgtggagggcataccaggcacccaggggactccccagggggctacacgtgtgagctccaagtggcagtgtagccagccaccctggagggtgggagtctcctgtgctcctgacaacccacacccaacagtgggctggcggagagctcctcactagcagttaagacccagccgtggctgagcgccgtggctcatgcctgtaatcccagcactttgggaggccgaagcgggtggatcgcctgaaattggagttagagagcagactgggcaatatggtgaaaccccttctctactaaaaatacaaaaaattactggtacgcacctgtaattccagttacttgagaggctgaggcaggagaattgcttgaacccaggaggcagaggctgcagtgagccaagatcatgccactgcactccagcctaggtgacagagcgagactccgtttcaaaaaaaaaagacccatgccgggcgcggtggctcacgcctgtaatcccagcactttgggaggccgaggcaggcggatcacgaggtcaggagatcgagaccgtcctggctaacatggtgaaaccctgtctctactaaaaatacaaaaaaaaaattagccgggcgtggtggcgggcgcctgtagtctcagctactccggaagctgagaccggagaatggcctgaacccgggcagcgaagcttgcagtgagccgagatcgcgccactgcactccagcctgggcgacagttcgagactccgtctcaaacaaacaaaaagacccaacccttctctgctgtctgatgtgacctcagcccggtccctgccaagtctgttgagcagggctgacctctggcccaagggcaggtagagggacagggagggatgagccaggcttctgaccagatgccttgtcttgtgtggacagagcccagttcctctgacacccccaggctgtgtggccctggacacccgagcagactgaactgtctgcttcctggaccagatgcaagactgtctcctggcggaccaccccctctgacagaaggggaatgggctcctgcagcaagctcgggtcttgagccacgtcccagcaccacttcagctccggagcattgggctgagccgccctttccaagctcacttctgggactgagtttcctcaaccggaacacacccatgaagatggatgatcatcccctagcccttctcagcaggaacctcatgcgacctgtgaccaagatgtcccatcctcagcacagggcccactctgccaaccagtctcaagcaccagcccctcaacactgccatccacctggctctgggccaagccaccaatccagagctccctcaggtcctgggactaaggcggggacatgactgatcccctcagagcaggctcaggcctggagtcggcccccaaaagtttcacatagggccaggcagcctctgtgtttctttccctggtcctgaactgtggaaatgccattaaactctctctataatgtaactgaaactgctggctgggcgcagtggctcccacctgtaatctcagcccttcccgaggctgaggtggaaggattgctcgaggccaggtgttcgagaccagcctgggcaacatagcaagaccctgtctctatttatattgaaaaataaaaataacaaaagaaaatgctgtggatgatcaaaaccagggtgggcaggacccggtgctcacagggacacacatggatggtccattcgctttattgggtgcgtgtagtgttgtcatgacatctcctaaggaactggggggcacgtttgacactcatgaggtcagaacaggtctggtgggcggggggggggggggtcccagggtggtgaatacccacagcacacccccccaccaaaagagaaaacggggagaggagcctggcaggccagactctgatccccatggtccacacagggaaacccccaacagcggcctcggcccaccgcggcagagccgaggggctggcaggcctggccacctcccattgcccgatcagcctgctttagggtgtcatctggcccctcttcacaactgacaactgtggatgggggtgaattttaaaaaaaggcggggggggggggttcaggagggtgagcggtgagttcacggggccacgagacaccacagctgagtggggaaagggctatatgtacaggaggggcagggcttggggcgggcaggggagcctgggcccctgggggacatcttcaataaataaataaatagctacaataataaataagggtgacgggctaagtcaggagcaggggtcttgtgcccgtggctggtaggggccgggtcaggcccgggtagttgggggaaggtggggaagacagggaagaggggaaagggagtgggatggctctcagcaggcgcagtcctggtgcggtggcacctgctggtcactgagctgtgggccctgcttggcgcctgtgaccgcagggtccgccgtgtccaacgactcggacatcttctcgcagatgacatccaccaggcgctcaaaggtctgcttgacgttaatgttgtccttggcgcttgcctcaaagaactcgaaccctgtggtcagagaaggcagggatgaggaccctggccacgccctatgccaactcccagagatgcttctctgaggaaagggaacacctggagattcccagtgccaagcaacttattgaaggtactgacaaatcccacagagaagaaacttattgaaggtactgacaaatcccacagagaagcaacatggaactgggtcagctttgcatttcctgctttttttttttttttttttttttgagacagggccttgctctgctgcccaggatggagtatggtggcgtgatcatagctcactgcagtctcgacctcctgggctcaagtgatcctccacccccacctctcaaattgctgggattataggtgtgagccagcgcacctggcctcctgcccttccttcctaaaattgtgtctcgttgtccttagggacctggcaagacatgccctgcagcgtccagcccagccccgtgcactggccctggaaggctctgacactcaaatccagctgtgacctccccctgctcacacaccctctgtgactccctattgccctccaaagagtcccagcctctcagcacatggttgaggccctctgtgatcggccacatttcctccagctgaccctcatgttccagtcttgtgaaattattaccaaaacacacaggacctttctcactgcaagcctttgcccaagctatttcctctgcctgaaagacccttcttcactacccaccactccaggaagcctggctcctctcatgtgctcctcccatccaggtccctccctctacctcaggggtccctcgaggcacccctagatgcctcttgagcccagcaacacccaacaaagcgttggacggtgagtgtcagaataaatccttaaactttctgcatggcaaactcctacacatccctcaggatccaactcaaatggctcctggatgaaggctagtttgcagaaagtgtgaattacctggctttagctgtaagaccttgggtgtgtgccctcccctctcttagtgtcctttttctagacttgtgggtctccagcccagctgggcactcaccaaggtggtcagctagctgccggccacgttctgatgacaccacccgctcatcctccatgtcacacttgtttcctaccagcagcacctgggcattgtcccatgagtaggtcttgatctgggtggacctataggaggcaccaatgggggcaggtcagggcttggaggatcccagctccaccctgacgggctgatgtggagcctgtgtccttgtccgaggaagaaagacccagaagcttgcccctccatcctccccaccatcctttcccccaatgtgccccgctttcaccccactccagcccccgactgacccattattgtttctgtgttttggggttttttttgagatagagtctgggtctgttgcccaggctggagtatctgcctgccttcgcttctcaaagtactggaattacaggcatgagccacccagcccagaaattttctttttttgagatagagtcttgctctgtcgcccaggctggagtgcagtggcgcgatctaggctcactgcaatctccgcctcccaggttgaagtgattctcctgcctcagcctcctaagtagctgggactataggcatgagccaccatgcctggtaattttttgtgcttttagtagagacagggtttcactatgttggccacgatggactcgaactcctgagctcaagatctacccacctcggcctcccaaggtgctgggattataggcatgagccactgtgcccaacccagaaatttttttttaaagttattacttctgagcagaaaattgaaatgtttacaatctctaacctatgccaactctccttttttttttgagacagagttttgctcttgttgcccaggctggagtgcaatggcaatcttggctcactgcaacctccacctcccgggttcgagcgattctcctgcctcaggctcccaagtagctgggattacaggtgtgcgccaccacgtctggctaatttttgcattcttagtagagatggggtttctccatcttggtcaggctggtctcgaactcccgacctcaggtgatccacctgcctcagcctcccaaagtgctgggattataggtgtgagccaccgtgcccggccatgccaactctccttatagtctctatattctccaccctacacttgcagatatttgtttctatatggttatagttttacttttccatctgaaatccttctctgacccctacgttttatttattattttttgaagaaagtttggctcagagacaatggccccagaatgagtgtggaaggccagaagcgatggctcacgcctgtaatcccagcactttgggaggccaaggtgggcagatcacttgagccaaggagttcaagaccagcctgggcaacatgaggaaaccccatctcaactaaaaatacaaaaaaattagccaggtgtggtggtatatgcctgtagtcccagctacttgggaggctgaggcaggaggatcacttgagcccaggaggtcgaggctgcagtgagccctgatcgtgccactgcactccagcctgggtgacagaataaaaccctctctcaaagaaaagaaaagaaaaaaaaagagcaagtggggtacactcaccagtcctgcactgcattgaaggattcctcgttggtgatgtcatacatgaggatgaagcccatagcgccccggtagtatgcggtggtgatggtccggtaccgctcttgccctgctgtgtcctagggaggaagagatgaaggtcagagaggacctgcacataaggccctcgaagaggaaatgagctctgatatcatccagttcagccccctgggagaagcaggagcttgcccaggggcacaaagtgtcaggaagagcaggttgggtcaccagtgctcagaatatatgagtgctccattattccacagagtcattcaccaaacgtactgtgccaggtgctgtggctcacacctgtaatcccagcactatgggaggctgaggtgggcaggtggcttgaacccaggagttccagaccagcctgagcaacatagcaagaccccatctctacaaaaagtacaaaaattaacagggtgtggtggctcacacctgtagtcccaactactcaggaggctcaggtgagagggttgcttgagcccaggaggcagaggttgcagtgaggtgagatcgcgccactgcagttcagcctgggtgacagagtgaaaccctgtctcaaaaaacaaacagggggtcgggtgtggtggtggctcacgcctgtaatcccagcactttgggaggccaaggcaggtggatcacctgaggtcaggagttcgagaccagcctggccaacatggtgaaactctgtctctactaaaaatacaaaaattagctcggcgtggtggcatgcacctgtaatcccagctactcaggaggctgaggcaggagaatcgcttgaactcaggagacagaggttgcagtgagccgagatcgcgccattgcactccaccctgggtgacaagagcgagactccgtctcaaaacaataacaacaaaaaaaaaaaaaaaaagaaagaaagaaagaaagaaagaaagaaaacagaggccaggcgtggtggctcatgcttgtaatcccagcaccttgggaggccaagacaggtggatcacttgtggtcaggagttcaagactagcctggccaacatggcgaaaccctatctctactaaaaatacaaaaaaaaattagctgggcttggtggtgagcccctgtaatcccagctactcaggaggctgaggcaggagaatcgcttgaacccgggaggcagaggtttcagtgagccaagattgcactactgcactccagcctgggtgacagagcaaaaactctgtctcaaaaaacaaacaaacaaataaacaaacatggactgggcactgatcttttccacaccctgaactggacactggggacacagttgttaacaagatgggcacttcccttgctaagtgacactcagtgtgggaaatagaaaataacggtataaatgtatcctatattggagagtgacaaggaccaaggagaaaaatcaagccagatgaagatggagagaatttaactgtaggtttaaaaattaaaggaagctgacacttgcctgtactcccagctacttgggaagctgaggcgggaggattgcttgagcccacgagttcaaatccagcctgggcaacagagtgagactctgtctcttaaaactaacaaggccaggtggggtggctcatgcctgtaatcttagcactttgagaggctgaggtgggaggatcgcttgagcccaggagttcaagaccagcctgggcagacatagcccgaccctgtctctacaaaaaagaaaaaaatcagcaggcgtggtggtagaagcccgtggtcctagctactcaggaggctcaggtggaagaatggtttgagcctgggaagtcgaggctgcagagagccgtgatcacgtaactgcattccagcctaggggacagagcaagaccaccctgtctcaaaaaacaaacaaaaaaagagaatggggaccaagatccagctgaaacctcatacatggaagaacttgaagatggggaaactgagggaccaggattaggtgcttatgggagaacacaggtgctgtttctgccccggtacacagtgggcaccttactgataaatgcccagtgtgtaagtgaatgactccagtcaggaaagagatagacgaggttggggctgcttttccaagtacgggaatccaaccgagccgggcgggagccctccagctgggacccacccagatctgcagcttgatcctcttgtcgttgcgatagatggtcttgaccttgaagtcgatgcccacggtgctg

SEQ ID NO: 2462 - DNA, 97135 bp, Homo sapiens
gacctatgcttctacagggacacctcagcctggcccctctgctgggaggcctcccattgcttctgcataaatgtcacctccctagctactaaaatagctctgactcttgtgattttccattgtttcatcctgttttacatttctttgtagcacttaccatcccatgacatattgtatactgacttgtctgttggctgacttagcaatgagttgttcaattagtgggtgaacaatgcctattccccctctgcaccactctgtctgagcatcttattcatccatacattcattcagcaggtgtttactgagtgcctatgcctttctaggtcttgtgctgggcactgctggaaacacagggctgctccttgcccctactgtgcctgcagttgcccagttctttgaaacattgatttaaagatgggaggaccatgtctagcttaaagtagacctcagtggctgccatgtggagggcaggttggagcgggtaagagttgtggctgggaacccagagaggcaactgggctggggacccagatggagcggaacaagattagaccagggcgggaggtaagtaaacaggccatggagactgatgggctggagcgattttccaaaacaaagcccagggctctggcctggcagatgacagtgctgtccccaacatgggggcccagaggaagaacaaatttgagtcaggtgggtgtgaatagccccaagaaggtatacagtaggctttgaggtcgaagacaggttcaaaaggtaagaggttgaggctggagactgaggtgtgactgtcatgagttcaggggcaaagaccaaggctgtggggctgggtggaatcattgaagaagggtgtgaaggaaaacccagagggctcagggtggagttgctgctgaggaatctcacatttaaacatcaggtagaggctgggcgtggtggctcacgcctgtaatcccagtactttgggaggccaaggcaggtggatcatataagatcaggagttggagaccagcctggctaacatggtgaaatcccgtttctactaaaaatagaaaagttagctgggcgtggtggcgcatgcttgtaatcccagctacatgggaggctgagacatgagaatcgcttgaatccgggaggcagaggttgcagtgagccacaatcgcgccactgcactccagcctgggtgacagagcgagactctgtctcaatacatacatacataaattaattaaattaaattaaataagttaaattaaattaaataaaataagcagcaagtagaagagaaggagcccacaaaggaggctgaaaagaagggtggattgagaattaggagtagaaccagtagaaggtatttcataaaaccaaggtccgcagggttcgggtgtctgagcatctccatcctcctgcagattcgagagcctggaccaagagatgaacagcctgatgggccgcgttctggacgtgaaccacacagtccaggagctggtggaaggaggccaccccagttcagatgaggtgcgttcctgccaggaccacctcaacagcaggtaggagggcctggggctgggagtccctcccatccttcccttccacactcacacagccatggacagcaagatgtgcaatctcaaacccctggaatcataatggccacccgataaatcaacaaaatgttgaccaaaaatcataatccctgatactggtgatgacgtggtaaaattaaaacaacatttcagttggctgttcatttatttgtccagaaagaatgtattggatatctacaatctgccaggagtattcccaagcactttatatacctttctaaagtatcccaacattcttccgggcacagtggctcatactgtaatcccagcacttcaggaggctgagatgggtggatcacttgagctcatgaattcaagaccagcctgggcaacatggtgaaaccccgtctctctctctacgtgcgcgcacacacacacacacacacacacacacaaaatatatatatacacacacatatatatacacacatatatacgtatatatacacatatatacgtatatatacacatatatacgtatatatacacatatatacgtatatatacacacatatacgtatatatacacatatatatgtatatatatatacacactatatatatgtatatatatatacaaaatttagccaagcatggtggtgcacatttgtagtcccagctacatgggaggctgagttgggaggatgccttgagcccaggaggtagagattgcagtgagcagagattgtgccactgcactccagcctgggcaatagagccagaccttgtctcaaaaaaaaaaaaaaaaaaattcccaatatcccaatttccatagtaaagatcctagaattcagaactctctctctctctcttttgagacaggatcttgctctgttgcccaggttggaatacagtggcatgatcatggctcattgcagcctccaacacctaggctcaagcgatcctcccacctctgcctcctgaggaactgggactacaggtgcatatcaccatgcccagctaattaaaaaaaattttttttgtagagacagggtctcactgtgttggccatgctggtcttacaactcctgggctcggctgggcgtggtagctcacacctgtaatcccagcactttgggaggccaaggcaggtggatcacctgaggtcaggagttcgagaccagcctgaccaatatggtgaaaccccatctctactaaaaatacaaaaattatccgggcatggtggcatgtgcctgtagtcctagctactcaggaggctgaggcagaagaattgcttgaacccgggaggcagaggctacagtgagccaagatcacaccactgcactccagcctaggtgacagagcaagaatctataccaaaacagacaaacaaacaaacaaacaaacaaaaacctcctggcctcctcccaccttggccttccaaagagctgggattacagtgtaagctactgctcctagcccagaactctttaagataagtaacaaactaatatcagtacctctggaatactaccagcaattctcccagtgcaggtggggttcatagatgaagatacaagtccaaaaaggtgaactccttatccaagattactcagtctataagtaggagtcaaatacagttctggctgaatcctgagctgtagctgtttatctaatatatccagtcttcctggtaacactatgaggtggaaactaccccacattagagaggagaaaactggatctcagagaggcgaagatggaggcccaaggttacacagcaagttaggggatcaaaccgggctttgaagatggatatgtttgacttcaaagactgtgctctttttttttttttctttcttgagacagggtcttgctctttcgcccagactggagtgcagtggtacgatcatggctcactacagccttcaccgcccccgacccgagctcaagaaatcctcctgcctcagcctcttgagtagtgggactatggatgcacaccactgcacccggctaatttttgtattttttgtacagatggggtctcactctgttgcccagactggtctcgaactcctgggctcaagtgatcttctgccttggcctccgcaagtgctggaattacaggcatgagccactctgccccacccaaagactacgctcttgactctgtgctgcaagattccaatatccagggattttaaaacctctgtagccaagaccatcgcaaagcatccaggcctaaaaaaataactacaatcataacgatttacagcatgtagagagatctatatgccaagtgctttagccacatgatctcgttacacactcaatgaagtggactttattatccccattttccagatgaggaaactgaagatcagagaaggaaatgatttgcccaaggtcacatggcaaatctggccagagcagaacttgaactcgggtctgcctgatttcagagtcctaatctctgtcctcatggtgtgtccattctagagggggcagaaagacagttaaatacactaataaatggacaagatatttagagaatcataatggctttatgcaagaaacaggcagggcatggtggctcacgcctgtaatcctagcattttgggaggccgaggcaagcagatcacttgaggtcaggagtttgagaccagcctggccaatgtgatgaaaccccatctctattaaaaatataaaaactagccgggtgtggtggtgcacgcctgtaatcccagctacttgggaggctgaggcaggagaatcccatgaacctgggaggcggaggttgcagtgagctgagatcgtgccactgcactccagcctgggcaacagagcaagactctgtctaaaaaagaaaacaaaatttaaaaaacccaaactattgaggaccccaagagcttgttttagtgggtcatatctattgctatttactatattagaacttagtactgagaaaatttaaaatgtttttatttttatttatttattttgagacagggtctcattactctgtcacccaggctggagtgcagtggcacaatcatggctcactgcagcctcgacttcgcaggctccagcaatcctcccatctcagcctcccaagtagctgggaccataggtgtgcacccccacgcccagctaatttttgtattttaggagtctcaccatgttgcccaggctgctctccaactcctgagctcaagcgatccacctgcttccgtcttccaaagtgctgggattacaggtgtgaaccactgcacccggctgagaaatttgaaaacattatttaaaaataacaatacactgggagtggtgcgtgcctgttagacctgtgaggctgaggtgggaggaccgcttgagcctgcgaattggaggcttcagtgtgccataaacgagttcatgaatagccactgcgttctagcctgggcaacatagtgagatctcacgtcttaaaaaaatttttttaaatctaaatatctaacgtgttaatataacttttttattaaaaataacttttcataacacaaaatgtactaagagtggcattgtttcgtacctttgcaaatctctttaaagtctggtttaagagatggcagctgggcttctcttaaatcagagtcggcttctgctctcagtctctcctgccgcctctggaaaactccactgaacactcgggaaagaatgagagtgaaaaagcaaatggcgtcttaacacatttttatgaagatagttttgtcctctatcagattacatgttgagaatggctgccctaagcaaaagtgctgcgtagggttccattttacaccggcagaaactggagaaactttctgaggtcacacagtggctgggtggcttgggcctggattctaccctgggtcggcgggccctccgcgcccaagaggagtccctgtcctcctcaagtcactctctttcccctgggcaggtggaaccgcatcgtggagctagtggaacagcgcaaagaggaaatgagcgcggtgctgctggtggagaaccacgtgctggaggtggccgaggtgcgcgcccaggtgcgtgagaagcggagagctgtggagagcgcgccccgggccggcggcgccctgcagtggcgtcttagcggcctagaggccgctctgcaggcgctggagccgcgccaggcggcccttctggaggaggcagccctgctggctgagcgcttcccggcgcaggcggcgcggctgcaccagggcgcggaggagctgggcgccgagtggggcgcgctagctagcgcggctcaggcctgcggcgaggcggtggcggcagcagggcgcctgcagcgcttcctacatgacctcgacgctttcctggactggctcgtgcgcgcccaggaggcggcgggcggcagcgaggggcccctgcccaacagcctagaagaggcggacgcgctgctggcgcgccacgctgcgctcaaggaggaggtggaccagcgcgaggaagactatgctcgcatcgtggcggccagcgaggcgctgctggccgccgacggcgcagagctgggcccgggcctggcactagacgagtggctgccacacctcgaacttggctggcataaactgctcggcttgtgggaggcgcgcagggaggcgctggtccaggcgcacatctaccagctcttcctgcgggatctacgccaggcgctcgtggtgctgcgtaaccaggtgcccactcggggtgtacatttcggagagggagagtccgaggccgcggggggattgcagggacagggacatgcgggggtggggaggagggtgtttcctgggaccactgggttctgaggtgggtgggaggtgagagagtatccggaatggataactgagtttgtggaacatccagtgtgtgtggaagtgtgtatgtaacagaatttgaggagtatcatcagtggggtaggttggtgtcttatcggaggtgacagtttgtgggctatcccgagtaagtaatgcacgaggatatttattggagtggcttcctgggttcgtggattatctgaaaggaaataagactatgaggttgattggcgatggttaaatggggttcaaagaagatcttggtatggataacaaaggattaggattatggaggtaggtaacaggctgaggggttattggagtcagtcagtgattgtggattacatggtgtggatggctaaattagcacaatatcttcatttctgggaatgacaactatggattctctggagagagtaactgtgtctgtggcatgaggaaccaagtgcagtggttatctggggacagccaatccagttgggagatcactctgggatgggaaccaagtttgagaattttggcaagatggaacagccagttttcagattgtccagtgtttggggatcatgttagaaagggtgcctgcctgtactggttatataagggatgctgacccagtttgaggattatctacagcagtggtccccaatcttttttttttttctttagatagagtcttgctctgtagctaggctggagggcagtggcgtgatctcagctcactgaaacctcagcctcccgggttcaaacgattctcctgcctcagcctcccaagtagctgggactacaggcgcgagccaccatgaccagctaatttttgtatttttagtagagatggggtttcaccatgttggccaggatggttttgatctcttgacctcatgatccgcctgcctcggcctcccaaagtgttgggattacagacatgagccactgcaccaggcccagtccctaatctttttggcaccaaggactggttttctggaagacaattttttccacaaaccggtgggaaaaggaggaatgttttcaggatgattcaagcgaattacatttattgtgtgctttatttctattgttattacattataacatataatgaaataattataaaactcactataatgtagaatcagtgggagtcctgagcttgttttcctgcaactagacgttcccatctagtgacatctaggggtgatgggaggcagcgacagatcatcgggcattagattctcataaggagtgtgcaacctggatcccccacatgcgcagttcacaatagggtttgtgttcctatgagaatgtaaagctgctgctgatctgacaggaggcagagctcaggcagtaatgctcactcgccccccctccacctcctgctatgcggcccagtttttaacaggcgatggactagtacccctctgtggcccagggcttgggaaatcctgatctagggagtggaggagaaaggacagagagcccctgaatcataagattactaaatatggagctgaagtggccttgagagaccctttctgacccacccatttaaaaaatagagacaggatcttgctatgctgcccaggctggtctccagctcctgggctcaaacagtccccctgctttggcctcccaaagtgctgggattgcaggtgtgagccaccatgcccggccctgacccactcattttactagttagaaaactaaccccagagggaaaagaacttccttgagttcacacagtacccagtttagttgtcttctttttttgagacaggacctcactctgtcacccgggccagagtacagtggcacgatcatgactcactgcagccttgatctatggggctcaagcaatcctcccacgtcagccctccaagtagctgggactacaggcacgtgccaccatgcctggttaattttttgtatttttagtagagatgggatttcaccatgttgcccaggctggtcttgaactcctggggtcaagtgatcctcccgcctctgcctcccaaagtgctgggattataggcatgagccaccgtgcccagccttcagtcttcatagtaaccaattttttttttttttttttttgagatggggtcttgctctgtcacccaggctggagtgcagtggcgtgatcttggctcactgcacctcctccgccttctgggttcaagcgattctcctgcctcagcctcctgagtagctgggataacaggtgtgtgccactacacccggctaatatttgtatttgtagtagagatgaggttcaccatgttggccaggctggtctcgaactcctgacctcaggtgatccacccacctcggcctcccaaagtgctgggattacaggcatgagccaccatgtccggcctaatattaaccaaatatttactgagtgcctcctctgtgctgggcgctattttggggctgagcacacctcaggcaacaaaatacaaaatcctgccctcatgtggttgacattctagtatgtaggggaggagagagtaaacaagtcaatgcatcgctaatattgccaggtacatgctatgagaaataatacaggagggttggctgggtgtggtggctcacgcctgtaatcccagcacttcgggagtccaaggcaggtggattacctgcggtcaggagtttgagaccagcctggccaacatggtgaaaccccgtctctaccaaaaatacaaaaaaattagccgggcatggtggtatgcacctgtaatcccagatacttgggaggctgaggcgggagaatcacttgaacccaggaggtggaggttgcagtgagccgggattgcaccactgcatccagcctgggcaacagagtgagactccatctgctccctccctgccaaaaagaaataatacaggagggtagtgggatagggctggggtgggagttgataaatttggcaggttggtcagagacctgaagaaagtgaaggagccagccatgggggtatctggagggacagactcccaggcagaagcaccagcatgggcaacagccccgaggtgggaccacaactggaatgttctatgcttgcaaggttgcggggagtggtggcaagccaggctggcagcctctcccaggtcctggaatggaatgaggctgacctttgcaccacgctccctcctccccaggagatggcgctgtctggtgcggagctcccgggcacagtggaatcggtggaggaggccttgaaacagcaccgtgactttctcaccaccatggagctgagccagcaaaagatgcaggtggccgtgcaggctgcagagggcctgctgaggcagggcaacatctacggggagcaggctcaggaggctgtgacccggctgctggagaagtaggtcccctagacccatccaccccagggagggggcagaagatggggcccagcataggggagtggtgtgggaggccagggtcccactcctttcatcacgatttctgcttctctggggctctttcctatttctatttaattccatgttgtcttagatttgatttaagtggatttttttttttgagacggggtctcactgtgttgcccaggctggagtgcagtagcacgatctcggctcactgcaaccctcacctcccaggttcaagtgattctcctgcctcagcctcccgagtagctggggctacaggcatgagccaccacgctggctaatttttgtatttttagtagagacacggtttcaccatgttggccagactggtcttgaactcttgaccacccaccttggcctcccaaagtgctgtgattagcggcatgagccactgcacctggccttaagtggatatattgtgaaaaggtaacctgaggctgtcaacccaaaagatacagaaggatatacaatgaaaggtttctttcttaagtctgccctgagcatgggatagctggtcctgttgttaaaatgttaggctgggtgcagtgactcatgcctgtaatcccagcacttcggtaggctgagacgggaggattgcttgtgctgaagagttccagaccagcctgggcaacatagtgagaccccttctctaaaattaaaaaaaaaaaaaaagctgggcgtggtgatgcgtgcctgtagtcccagctactcttgaggctgagatgggaggactgtttgagtccgggagattgaggcagcaatgaactgtgatcatatcactgcagtccagcctggatgacacagcaacattctgtcccccctccaaaaaaaaaatgtgttaacttacttccctagatgcctcattatccatcctgctcttctgcaccctccttgggaacccccagacctccccagatccagcagctagaggccaggcacaggtgtgttccagctttccagatgggacagtgtcccctgccaggctggttgtcaaatattttgcataagcacctcttcctggccccagccactctaggaagcatgcaaagtgagtgtctgcatgtctctgtgtctctctcatctcttgaacctcattgttctctgcttctgtcgccatctgtctcttgccaccactctcttgtctgtccttgcactaatcaagcgaagatatttattgagcatctactgtgtgccaggcactattgtaggtaggcactgaacaaaacaacaccaccacctccagccatcatgggaagtcctttctcatcttccagacccagttctgtctgtcattagagctgtttctgctcctcctggtgaccctaaatttctcctctcaggctctctggctctctccggcatgatccaggccagaaggggacccagtacccctccttctgtcttcccatctcctgacagaaagcatccctggtcacttcactgtgccacccccagccccaggaccgctaccccttttctgtttacggctcagacatcctttccctagatttatctggggcaaggcagcatgcttctaaaggaaacttttatgggaattctgttcttgaggatgcaaactcatcatttagtgcccccttttccatccaggcctggatccttcctttgttccactttttttttttttttttttgagacagggatcttactctgttgcccaggctggagtgcagtggtgcaatcatagctcactgcagcctggaactcctgggctcaaccaactctcctgcctcagcctcctgagtagctggactataggtgtgagccactgagcatggcctgttccacatttcttgagcacctgctgcatgccaggctcagcaaaacgaggaggaggagcccgggggactgttcattccatgattcattcattcattacttttcagtcattcattaattgctcctttcactctattgtttattcactcatcctccagtcaattaaacatgtactgagcccgtgctctgtacggagtgggggtgtgttcacagaaatgaccaggacagaacatgattcctgcctcacagagctcgaacgttatctgacaaggatggcccagaatgctcggggctgggatggaggaagtccaggcagaaaggtcagggcccggatgggagacgtgcagccgctgtgggagaggcagcatttgtcccaggcttgtggtgggtgaggtgtggtcacagagggattgagacggactaatctctgcaccttcccaccatcccagtcatttatttgtctagggacacatttcccaccctgtgggaggagtgggaggagtgggaggagtttccacatccgccaagggggcagagccatacagagctggggactggggccctggggccctgggggtcttagacctggcttcacccctgaatccgtgacattcagggcaagtcacttagagcttcagcttgcctggcccctcacctggaacctgtgtgtgaggtgctgttctttttttttttttttttttttttgagatggagtctcactctgtcacccaggcaggagtgtagtggcgcgatctcgcctcactgcaacctctgcctccagggttcaagctattctcctgcttcagcctcctgagtactgggatcacaggaaagagccaccatgtccaactaatttttgtatttttggtagagacagggttttgccatgttggccaggctggtctcaaactcctgacttcaagtgatccacctgcctcggctccccaaagtgctgggattacaggcgtgagccaccgcgccggccgctaggtgctgttcttatctgcgttttgcatgtgaggctcagaggggaaaactgacttgcccagagtcatggccaggaagtgccacagcctagatttgaaccctgttgctttcttttcttttcttttttttaaagacagggtcttgctttgttgcccaggctggagtgcagtggtgcgatcactgctcactgcagcctcaatctcctgggctcaaacaatcctcctgcctcagccttctgagtagctgggactaaaagcatgtgccaccttgctcggctaatttttcattctttttttgtagagatgaagtctcactatattgcccagggtggtttcaaactcctgggctcaagcaatcctcctactttggcctccccaaagtgctcggattacaggcgtgagccatcgtgcccggcctactctgttgttctttcaccctcatggagactcagggtcttcctcatctctaggactgatgcttgacagtttggctgctgaaggcctggaaagattgatttcagctcaatttcagaggcattttatctttcctggctcctaagctaagttgggcaggaggcagtcagtgcttcgcttgcttgtctcaggcccttcctgttccttctctctggttctgtctctgcaactgtctcctatacactctgtctctttgcttccatctatccatctatttctgtatctctgtttcctgctccctctctgtttttctctccgtttttctctccctccatctgcacctctctaaccctgtcttttctgcctctgtctttcacagatactgtacttttgtttctcccatcttttttctctctgccactgtgtttcttgcattcattcatttaacaaatataagtcgagcgtgtactgtatgccaagccctttttctaagcattggggacacatctatgaacaaaacagacaaaaatccctgccctcatggaaatgatatatcctagcatgggagacagccaagataaataagtaacatatagcacgtgttagattgcgttaagtgctaaggagaaaattaaagaagggaagaaagccagaaagtgttggggagtggtcaggagggacctcacgaagaaggtgatctttgagtagatgttgggggaaggagcattcccagcagagggaacggctagtgccaagggcctgaggcttgctcaaggcacagcgagaagggcagtacagttaccacagagtgagggggaagagtgcaaggagaataagagtttggaaaggtgggggtgtggggcctggtaggtcagaaaggcctctgagattggccgagtgcaggagctcactcccatcccagcactttgggaggccaaggcgggtggatcacttgaggtcaggagttcgagaccagcctggccaacatggcgaaaactcgtctctactaaaaatacaaaaattagccaggcctggtggtgggcgcctgtaatcccagctagttgggaggctgaggccggagaatcgcttgaacctggggggtggaggttgtagtgagccgagatcacgccactgcactccagcctgggcgatggagcgagactccatctcaaaaaaaaaaaaaaaaaaaaaggactctaaggactctcatggagaccctgggaggatctctaaggactctcatggagaccctgggaggatagtctcattctctctctctccctgggggagacagatagcaacaggacagggatgcatgggagcccatgtgggatgccccagccccatccaccaggcctcttgggcactttgccttgcactgtgggcaggaggccagactgcccggggcccatggtcccagccggctccagagtggtacggcctgggtccagcctggtcagttcagtcaggccaagggcctcgctctgcctgcaggagtgcccacttcagcttctctgcgactctgctgtcatctctccccacactctgctctcttccctctctccaactctgcggccccctggtctgtctgtcgtctgtggggctgtcttttcctggtggcatttgccactcctctgcctgtctctctctgggctgtccctgaccggactcctcctgtcactttccctctctctgcctcctctctttcgtcgtctgctgctccctgagtttctttctggctctgccttgctccatctcttttctcgtctttttttattctctctctcgctctctttctggtgtctcctctcactttctcgtttgttttgttttgtttttgtccctaggtatgtctgtctttacttctctgttatctttctctctggacttgcctttttttctctccgtctatatctctttctttctaagtgcctgtctctgcctctccctttctcttcctctgtctgtctctctctctgcccttcttcagccccgtccctgcgtccctggctttgccccactaattcctccctctctcttacatattttccacgcccttcttcccctacccagcccagtgccctcacagtcctactgccagcgccgcaccccccaacccggggcctttccccagcccttatctccccatccccaggaaccaagaaaaccagttacgggcccagcaatggatgcaaaagctacatgaccaacttgagctgcagcacttcctccgagactgccacgaggtaggaactccaggtgtgctggggacggagacatcccctttagtcgggagggaagtgcttctcggccgaggtgggggtggggacgccccgtctaagtgggtcgcggagcgatgctcgctctaagccgccagggggcgcgcggagccgggtctcagtgcgcatgctccgcaagtccctgcccgcccacgccgactccgggaaacgaaggaggggccccgggcgcccctggcaaccgcgcgtgtccgcgcctacgggtcccgcggggacgcgcgctgatctcacctttctctcctgagatttgtgagaatcgctctaccccaggagaggggcggggcgggcggtggggataagggccgagggccgtgggggggccagcggccctgcgccctcctgcagccagcgatggctctgaaccaagccctcgcccctttaaaggtgttcagtaatcaagccccttcccttagggatgatctgcacacattagggacgatctcccctaatccgagatggtccaggcccccttccttattagtgacggttcaggagacctgctgtcttcccctccttcccttgcattccatagaaacgattctagactttggccacattagagatggcctagtaaacattttcctaaaccctaaacagagctaggcctggccctgagcccctccatctgtgtgacccaggatcatcccctcctccatcatcaccccgtacctaagtttcttccaaccaaagctggttcaggaaccaggtctaacccctaaacccctcagcctcaattaaagacgattcgaccctcccccctatgttgaacacccatgggagattgttctctccgcacacggaataaacaagggcctccataccgtgcccccctcccccataactggggtaggccgggacttgagccactggaggaaccccctgttccccctcgcccccactggagattgtgagatgttccaggtcgccctcccatatcccctgtccacatgtggtggccaggagcccgagcttcttcccattagagatggttcaggaggcccccacccagcccctcaccataatccccactcccttagtgaggcagtccaagccccaggcgctccctcccggcattagatttggtccaggagcaccccccatccctcatgagattgttctggatcaggcagcaatcatctgagatggcgcagaagccccccacccgaagccttggggcgagtggtggttcctcctgcacccccacctggggccccgcaaagaggcgggcagggaggcaggcagggggcgcacgcgggcgggcgcgcggccgccgcgcgggggcgagggagggggcgcgcggccgccggagcctcagccttcgccgccgctgccgctgccgtcgcagttgaggggcgagcacccgcccgcccgctgcagggacgccccgccaacgccactgccgcttcaggtctcgggggcgcccaggggagggggttggcgcgcaccccgcggacgcagacaggggagggggctcgggcgcgtgcccgcccgtcgtggccgcgggagggaggggcggggcggcgcgggggcgggccgggcaggcgcccggacccccaccctgggggaggggcaaggacgccgggagctgtccgcggtgctggcgcgggcgggactgaggggccggcccccaagggaggggagcgaagcggggggacttctaagaccacttctagggtaatctggatttgccctaagggttcagggcgtctcagcctttcgagggggggctcttctccgggtaatggggcatctaagatttgccctggggttgggggtttctcaaccttttggggggtttctttcttgttttgggaggatctgtatcagccttggatgatggaggtgaatcacttttggggggctctgccttggaagatgaggggccttggattttctctgggtctagggggctctgactttgtggggcttttcctgggttgttggatagtctggttttgccctccatcatgaaggaatcacttttgagggggctttactttgaggatggggtaccatctctttaagggctctgctttcactgcgggctgtggttgccgttggactcttccctgcacgtcgggaacctgtgaattgagttggggggttcagcactggacttggttctagtgtgtgtatgaaggagtgtgatgctgtcctggacccctggggagcacatgctcaggggacatgggctggggtttggccggctggggatctgggatttgtccttggctatgactgcatttgcctcccgggaccgcggagctggagtccagtgtttgtttttttttttttttttttttttttttttttttttgcaggagggaggagggaggatcttgtgactggagtggggaggagaaaggggaggagcaaactgtttcaggtgccaggtttggtcatgagtggggaagttctggcttggaggataagtctggttttttactggagggggttgggggaggctcaaaaagcagcctgtgattgatcctctctagtgccgtgagaggggcccactcttggtgcttgcgttttggatgactggttttgttggtgggtaggaggactagaactggctttagttgtaggggtgggggtgctggccgggcttgggaggtccgatctgatccacgatggagagtctgtggctagattttggggtagactggtttggagagccagaacacagctttgtttttcacatttggctggggttggctttggttgagggctagaactggtcatggtttggggatctatggtcttagagtcccagggctagaactggggagccctgtgggctcattaggggtgctagatctcgattatggaggatgggtctactccagattagagggttagtttagagagagctagagttggctttaattgggaggttgtttggggggtttatctggccatactggaggaactggggctagatatgggggcttcatttgatacccttgggaatgggttgaggctcttgaattggtccttattggggggtggctaagattgaatgaagtgtctaagtgttgctatgggaggggtggtcctggggatgaattgggagttagctaaattgggttggagagcttgttttggggggggtgatctgtccccaagtctaagaggctgactggccctgccttgggggcttgtggggagttgaggagggcttccctcaggacaggggacaggggagcaaaggattgggcattctggggacccttccatccatcctctatccaggaaagagcttgagctgcacccacccccaatataaaggcctcacttgcaaaggttttttcatcctttcctattccttccacccatacaccctagcagcccaggccctgaacctgggacttcctgaagggatggggggctgtggcaggttgaggggaccagctgagccctcctgccctgttctgcacagctggatggctggatccatgagaagatgctgatggcgcgggatggcacgcgggaggacaaccacaagctgcataagagatggctccggcaccaggcattcatggccgagctggctcagaataaggagtggctggagaagatcgagcgggtgaggaagctgatggcccctctgcctgtgccaggtgcaggaggcctccagggagcccacgtctcacctgctgcacccgctgctgccatcctgctggtcttacacctctggactgactcaaatcagctccagatctgctcctagctatgtggctttgagtgattcatgtaacatctttgagcctcaatttgctcatctgtaaagtggccagcatctcttctgaatggtgcctgtatcctactgtttgttaaatatttcacttcttaatataacctcctctaccaggttccttccataccatttggggcatttaagatggaaggttggggagatgggctgggacagaccctgggaagcccagggttaaagtaaactttggattcttagagccctgggttctaactgtgtctatgcctgttaccagctgtggggccttaggtaattgtgttaacctcttggagcctcagtttgctgttctataaaattaaggaaataataaatatagctacttcctgggctctgtgcacataaagtacttaacacaaggccacgcacctaagagctgtaattactgtggtcttgttacttttaatacttaatgttacctaagtagctctgggccactaagaaccttgacttcagtcttggagggactgaggtagatatttgctctaagcctcaaccctcagaacttccccctcctctggctgaacccctagacctgtagccctggatatacacacttttctgactcacacagagacacccatgttggccttaaacccttaaatggtcattgatgtttcataaatggtggcatatggcgaaggcagtcttcttgactttgagtttaatggaagttcattctctccctgcctctctggctccctctatctttctttcctgtctgtctatccctctatccttgtctttcttacggtcctctccccatgtttctgattttctgtgcctgtctctctgttgatcactctgtgactgtttgtctctccctgactccttcccatgtctctgtgtccatctgtctctccctgtatctttctgtctccctcccctcacttctgtctgtctgtctctctcttcttgtctctcttccttggttccttccatttctgggcctatctctgcatccacccctcatgtctctctctccctatgtgtctcccactccctgcctctgattctcttttcacatccttccctgtgtcctgtcactctcccacacttctctgattctccccaccatctatctatcttctccatctcctgccatccacccacttggggcaggagggccagcaactgatgcaggagaagcccgaactggcggcctccgtgcggaagaagctgggcgagatccgccagtgctgggcggagctggagagcaccacccaggccaaggcacggcagctctttgaggccagcaaagcagaccagctggtgcagagctttgctgagctggacaagaagctccttcacatggagagccagctgcaagacgtggaccctggaggagacctggccactgtcaacagtcagctcaagaagctgcaggtatggtcttcctggcccagatgagggctccctatgccacatgggggccaggtcagggtccaaccccactcaaggtatgtcaagtggaggggatttaatacagggatttatttcaaacttgtagaagatgagaaagggaatattgaagcaatccagctagtaataactgttggaagcagccaccactccctaaggtatggagtacaaagggaaaaggaaggatctagagccacaaagcagtaggtaaatgactagcatgctaaaggtttcacaggaccctgacactcatttcctggatggagaaaccaaggctcaggggtatgggaatggctttgcatggaataacaatgacattcattgagcatttctctaccagtctctgggccaagcactcactgaactcatcccagccacttctggagattggtactgttattatcctgttttaccaatggggaaactgaggcacagaaagtaaggcacctggcccaaggacacacagctaaccagtgtctcctttatgaaacagggcactcttagagaacagacgcagcgtctgcttgtatctgctcccagcttggcagctccatgcttggtacacagcagttcacgtggaatgaccagaggtgaacgtagccattgcttctcacctcccagggagtaatggctcctgcctttgattttctttttttgttgctgttgttgatgttgttgtttgtttttttcttcaagatagttactcactctgtcgcccaagctggagtacagtggcttgatctcagtccattgcagcctcaaactcttgggctcaagtgattctcccacttcagccttccaagtagctgagaccacaagcgcataccaccacgtctggataatctttttaaattttttatagagacagggtctcaccatattgcctagggtagtctcaaactcttgggctcaagcaaccctcccgcctcagccttccaaagtgcttggattacaggtgtgagccatggtatctggcccacgtgactcctgcttttacctgtcaggaacaatgcctgactgactgatgggaaactgaggttccaggaggtgagaggtgaacttacttgtccagagtagcaaatagcaaagcctggatttcagtccagtgcccttgactcttcactcctcctttttgatatatttcctatgtagttatatagtgcttggcatagtgtatggcaaaaaaaaaaaaaaaggctagtaagaaatacataatgacactgattagtatgtattcattcatctctgtggcaaataattattaggtaccagctgggtgtggtggctcacgcctgtaaccccagcacttcgggaggccgaggcgggcggatcacgaggtcaacagttcgagaccagcctgaccaatgtggtcaaacctcatctctactaaaaacacacacaaaaaaattagctgggcatggtggtgcacgcctgtaatcctagctactcaggaggctgtaatcccagctactcaggaggctgaggcaggagaatcacttgaacggggaggcagaggttgcagtgagctgagattgcatcattgcactccagcctgggagacagagcgagactccatctcaaaaaataaaaaaataaaaaaaataattaggtacctactatgtgcccggcacttttctgggtgttgggatatagcagtgggcaaaatggatgaaaagttactgccttcacggtgatcccattctggttgggggaacaagcaaaagaacaaaaagacaaacagatctgaatgtgatggccaatggggtcagttcgttctttttccctccgctcccctccccttcccctctcttttcttttcccctcccttccttccttccttccttgcttccttcgttggagtcttgctctgtcacccaggctggagtgtggtggtgcaatgtctgctcactgcaacctctacctcccaggttcaagcagttctcctgcctcagcctcctgagtagctgggattacaggcatgtgccaccacacccagctaatttttttatttttagtagagatggggtttcaccatgttggccaggctggtctcgaactcctgaccacaggtgattcacccgccttggcctcccaaagtactaggattacaggtgtgagccactgtgcccggccaatgaggtcactacttaatatagaatagcagttctcaaatgtctgggtctccaggaccccccttacactcttaaaccgcattgagatccttagaaagctttgtctgtgtgggttagacctattgacattcactgtattaaaaatgaaaatcgaggccaggcataatggctcatgcctgtatcccagcactttgggaggccgaggcaggaggattgcttgagcctaggagtttgagactagcctgggtaacggagcaacagcctgtctctattttattttatttagttatttgagccaggatctcgctctgttagcaggctggactgcagtggtgcaatcacggctcactgcagcctcaacctctggggctcaagtgatgctcctccctcagtcccgcaagtagctgggactacggacccacaccaccatgcctgattgattttttttttaagaaacagaatctcactatgttggccagtctttatctctatttattgaactaaaaaaaaaaactaaaacggagtctggctctgccacctaggctggagtgcagtggcttgatctcagctcactgcagcctctgcctcctgggttcaagcagttctcctgcctcagtctctggagtagctgggattacaggcctgtgccaccaagcctggctaatttttgtatttttagtagagatggggtttcagcatgttgcccaggctggtctcgaactcgtggcctcaggtgatcggcctgccttggcctcccaaagtgctgggattacaggcatgagccatggcatccagactgtagttctctttcatgtctagaatagaagagagctagcttctcccatccgtgtctgtattcaatccatttcactagcacaggtcatcaggtctctgaaaaacactgctgcatgctggagagagaatgagaatggtgaaggcaaataacatcttagtatttttataaaaatagttgtaaccttgcagatgccttgaaaagatctcagggatcccccaggggttccttggccacagtttgagaactgctgatgtacacaatgtgctgggcactgttaactcctctctcctccccaacagccccatgagggaggtcctgttattatccccacccagcagaaaaccacagcacagaaaggatctgtggctcacagaggtcacatggctaccaagtggctattcaataccacctttagtccctccctgagcctctgtcctccctcttaaataggactctatcatcagtgcaggtctcccagggccaggtggggatgtgcacagaaaggagccacttagcacagtgcccaggatgtggtaagcctgcaagaaaggggcatctgactgtcagggtcccagccagaaacagaagcaggctcacctgcagaaaacttgagtttcttgacaaaggtgtgagtggagaacggggaagctgcaggaagcatatagggctgtgggactcatggaggggagcttttgctcctccctagccagagaaggtagagaaggaaaagttattggaacttggaaggggagagttgccagacaggagctggcactcttagtcaagaacggcagccatggccagacgcagtggctcacgcctgtaatcccagcactttgggaggccaaggcgggtggttcacttgagatcaggaattcaagaccaacctgggcaacatggcaaaaccccgtctctactaaaaatacaaaaattagccgaacgtggtggcacatgcctgtaatcccagctactcgggaggctggggcatgagaatcgcttgaacttgagaggcggaggttgcagtgaggcaagattgcacctcactgcactccagcctgggtgacagagtgagactctgtctcaaaaaaaaaaaaaaagagaaagaaagaaagaacggcagccagaccatggcaccatagcagggaagagctggggagataataccccagactcactttcctctgggcttccctttgtcagccagggctggcttcatgggtgtttgcccgtgcagtgacacagggctccatgcttggtttaatgccctactattgatgtcttgaatttttttgtttttgaggcagtttctacctctgtcacccaggctgaagtgcaatggcgtgatcatggctcactgcagccttgaactcctggactcaagtgaacctgtcacctcagcctcctgagtagctgggactacaagcgtgtgccaccacgcccagataatttttgtagtattttatagagacgggggcctcactgtgttgcccaggctggtctcaaactcctggcctcaagtgatcctcctacgttagtctcccaaagtgctgggattacaggggtgaagcactgcccctggataaaattcttaataaatatttgaacaagggaccttgtgttttcattttgcactgaaaagtataagccatgtttgaggccaacccacatggaagccagaggacaggagggctggtccatgcaggtcagtcctgcacagggcagggtgaagaagcttggactatgggtctcaagatcccgggctgaagcatccatccacctcggcctcccaaagtgctgggatcacaggcgtgagccactgccccagcctattgctaggattcataattatcttgcagtgattactaattcttccccagcagtgttttgcagtggctgaaggcacagacttgggactccagcaggtctggttctgagtcacagctctcccacttgctgccttcgtctctccctctgagccttggatgccttctccttgcaatgggaaggacctcaatgctcaccccctggtggatagcaggagtgtgggaagcagcagagcatctcagtgaagggcatggatgctggcgctgggctgcctgggtcaagccctggctctgtgccttatcacctggatagcccaaggaggttacttttctctccatgcttcagtttctttttctttttttaagagggagtctcactctgttgcccaggctggagtgcagtggcaggacctcggctcactgcaacctccgcctcctggcttcaagtgattctcctgcctcagcgtcctcctgagtagctgggattacaggcacctgccaccacgcctggctaatttttgtatttttagtagagacggggtttcaccatgttggccaggctggtctcaaactcctgacctcaagtgatccacccacctccgcctcccaaagtgctgggattacaggcatgagccaccgcgcctggctgtgcctcattttcttcttcagtaaaatgggcataatgatatttctgacctcataaggacattgtgaaggtgaaaagacataatgcattaagtggtttcagaactgctgacccaacaaatctaagattcagtatttattcacaggtctttaatttttttttttttagaccaagttttgttcttgtcacccaggctggagcgcagtggcacaatctcggctcactgcaaccctctgcctcctgggttcaagtgattctcctgcctcagcctcccgagtagctgggactataggcacccgccaccatacccggctaatttttgtatttttagtagagatggggtttcgccatgttgtccaggctggtcccaaactcctgacctcaagtgatccgcccgcctcggcctcccaaagtgctgggataataggcatgaaccaccgtgcctggccagtctttaattttaactgtcataaaactgagagcatatcaccatcactctactgttttcaaaagctagttgtttcaccttccctttggttgttacttatgtgatacacggttacttcatttgtttttgttcatattccatttggggcatttacccctctccatgctgctttttaattttaatttatttttattttttgatagatggggtctcactatgttacccaggctggtcacaaactcctgggctcaaacagtcctcctgccttagcccctcaaagtgctgggattattcgcgtgagccactgcacctggccccaaaacacattttaaaaaagcaacatggatgattgggcacagtggctcatgcctgtaatcccagcactttgtgaggccaaggcaggaggatcgcttgagcccaggtgttccagaccagcctgggcaacatagcgagattcacatgcctgtgttcccagctactcagaaggctgaagtgggaggatcacttgagcccaggaggttgaagctgcagtgagctgtgatcgtgtcactgcactccaatctggtcgacagagtgagacccccatctcaaaaaaaaaaaaaaaaaaaaaaaaaagaaaagtaatttggaggtggtaaatgaaatatttatatagtgttaaaagttagaaccatctttagctcacttgcttttgccaaattgcctgcccaggtccttctgtggctgctcactctctccccagcagtacacatgagctcctgtttcctctcgtccttgccaacacttggttttgtcagacattttagatctttctcagtccgatggctgggaagtggtatctcactgcagtgtgtgtatttgtatttttttccaatgctactggcgagcttgaccatctttgaccttcttttgtactatttaggttttagaggaaggagttggggcctcctgctttagccagagtacagagttagctcttccctccctgtagggggttcagtctcaaccaagcccagcaaaccatgagatgggggtccccattgttcaagggaggggctgaagcccagaggagacaagggagtggccctggggtcacacagtgatgggtgccagaggcaggctccagcacgagactcctgggcccttttcccagcagagggagcccgaggcaggaagtgactgtgtgggccagggcacccagacggagcccagctgcccctcaggagctgctactggggaagggacctgccaaggccctgctgtcccctggggcatacacaggagaggggttggctgccatccagcctggcacgtttcctggctgtcccatccacccttagggcactggggccaggctgggctgagggaggtactggctcggggtctgaggggtgtagtggtgtgcagtgtgtgagcgatctgtccccctcagcctctctcctgtcctcccgtcgccatctctgtgtctctctcttccctttgtgtccctctctgtcctactctctcactcccttctctctgtctctttatttattttgagacagaatcttactctgtcacccaggctggagtgcagtggcgcgatcttggctcactgcaatctccgcctcccaggttcaagcgattccccagcctccccagtagctgggattacaggcacccgccaccatgcctggctaatttttgtatttttttatttttattttttctttttgagacggaatctcactctgtcacccaggctggagtgcaatggcacagtctcagctcgctgcaacctccgcctcccggattccagcgattctcctgcctcagcctcccaagtagttgtgattacaggcgtgagccaccacgcccggctaatttttgtatttttagtagagatggggtttcaccatgttggccaggttggtcttgaactcctgacctcaggtgatctgcctaccttggcctcccaaagttctgggattacaggcatgagccaccaccccagtctctctgtctctttttatttgacttctctgtctctgcctccttcccgtgttcctcatgtcctccttgtgtcctctccctcatcccgtaccacacccgctgctgcagcaggctctctgggaccccacctcccaggtcctggccacgtgacccagaatcctctctcggggcctgttgccaagctgtgcttcctggccaagaagccagatggtggagtctcaagtcctggctccccagccctcagggacctggccagctggtcggcctcagccacaggctcctgcttggagagatgggggactggtctcctgccagatgagaaaatgcactagaggctttgcagctgccaggctctgtccctggggaccccacactttttccaggcccacccccaccctaagcaaagctctttctctggccaaggaaacaccctcctcccccctgttctgcttctctgtcccatgtttttgtatccagctcagcatggcctaggagaggagtgcacattcagggactatacagtcccagtccttgccttattgggactcaaggcaagggaccccatcctttctttctttccttttttttttgtttttgtttttttgttttttgagacagagtctcactctgttgcccaggctggagtgcagtggcgcgatctcagctaattatgtcttcataattcacaaattatgtcttcaatttatgaaggtgctggctcggggtctgaggggtggagtgatcagtaactcaaattacgtcttcacaaatctccttgtcttcatttctgagcaccgctttcttctgtgttggcctcatggtcagggagtccctgatgttggcaggatgaccccaggatgcccggcctacctcctcccaacttaggaagcccatgggaaagagagcatctcttctgtgcacacacattttcctggcgaaaatggggagagtggccgggcacagtggctcacacctgtaatcccacactttaggaggccaagatgggaggattgcttgaggccaggagttggagacccgcctggccaacacagcgagaccccacctctaccaaaaaagaaaaagtgggaagagttttcattggcccatctaaggttacgtgctcatatctgacccaatctttatgaccagggtgttttcagtgttctgcttggccccacttgggtcatgtgattacccatgactctctaggtttcatttgcccttcaggaagctcaggacctgagagtgagttttgatgtatttggaaggagaggatggattttgggcaggcaaaaccaacaactctgcactacagaactttgaatcaagaagtcttggcttggttcttgagtttggggttttgttttgcagtcatttgtggtaatctgctaccacttaattttttaattgttattttgttttcttctctagctttcctccatctgtttagaattacaagggtaatatatgaatatattcttttgggaaaaaattttactaaccgagcagtcttcagtaaaacataaagtctcactcctatctgcctcccaatcccacatcccaaagagagcctcagttatttggtgtgcatccatctagacctctttctgtgcatttacaagtgtacctatatggatgtttaatgtttttatattatttgcttttcatgtttaatttcaatttttgaataaataaattttcatggtgaagacatcaaaacctctagggaaatcccatgggaaaattatcgccttcatccctgttccccattcattaagttctcatcccctcccccagtaagtaccatctgttatgaacttcttgtttactccagggaatttttatgcatgtgcaatccactataaatttatattcataggtaggttctaaattgcttcttcttcttcctcttttttttttttttttttgtttgtttgttgttgagactgagtttcgctctttttgccaaagccggagcgcaatggcgcgatctcagctcactgcaacctccgcctcccgggttcaagcaattctcctgcctcagcctcccaagtagctgggataacaggcgcctgccacaatgcccggctaattttttgtatttttagtagagactgggtttcaccatgttggccagcatggtgtctatctcttgacctcgtgatccgcccgcctcagccttccaaagtgctgggattacaggcatgagccattgtgcccggcttttttttttttttttttttttttgagatggagttttgcttttgttgcccgggctggagtgcagtggcatgatctcggctcactgcaacctctgcctcccgggttcaagtgattctcctgcctcaggctcccgagtagctgggattacaggtgtctgccatcacgcctggctaattttttgtgtttttagtagagatggggtttcaccatgttggccaggcaggtctcaaactcctgacttcaggtgatccacgcgccttggcctcccagagtgctaggattacaggcgtgagccaccgcacccagcatgctttttcttcttaacagtaacacttggctatttttccatactggtctggatttgtttaaccattttactcttttttattttttatttttttttaagagagggggtctagctgtgttgcccaggctggtctcaaactcctgggctcaagcatttctcccacctcaacctcctaagtagctgggattacaggcatgagctgctgcacctgacttaaccatttctctcttgatgggcattgaggttgcttccagttttttcccattataaactctgctgtgatactacaactttgtgcatctgtgccagtatttcttttttttcttaaaaaaatttttattattattatttaaaaatttttttttcaggatggagtcttgctgtgtcacccaggctgaattgcagcgacgtgatctcggctcactgcaacctccacctcccaagttcaagcaattctcctgcctcagcctcccaagtagctgggattacaggcgtgcatcaccacgcctagctaatttttgtatttttagtagagacagggtttcaccatgttggccaggctggtctcaaactcctgaccttgtgatctgcctgccttggcctcccaaagtgctgggattacaggcgtgagccactgcacttggcctatgacagtatttctttagttatattactagaaatgcaagtgctgggtcaagcagatgcatattttgcattttgatgcaaagacctgccaaattgccttctaaaaaggctctaccaatttatgccaccactgacagtggctgagtgtgcccatctcccaacatctttgccagcattagatactataagtcttttacatttttgccaacctaatgtgtagaaaagaatgccttggccaggcgcagtggctcactcctgtaatcccagcactttgggaggccgaggtgggtggatcacctgtagtcaagagttcaagactagcctggccaacatggtgaaaccccatctctattaaaaattcagaattggccaggcgtggtggctcacgcctgtaatcccagcactttggaaggccaaggcaggcagatcacaaggtcaggagatcgagaccatcctggctaacatggtgaaaccccatctctactaaaaatacaaaaaaaattagtcaggcgtggtggtgggcacctgtagtcccagctacttgggaggctgaggcaggagaatgccgtgaacccaggaggcagagcttggagcttgcagtgagccaagatagcaccattgcactccagcctgggcgaaagagcgagactctgcctcaaaaaaaaaaaaaaaaaaaatcaaaattaaccgggcgtggtgatgtgtgcctgtgatcccagctactcgggaggcggaggcaggagaatcacttgaactgaggaggcagaggttgcagtgagccgagatcatgccattgcactccagcctgggcaaaaagagcgaaactccatctcaaaaaaaaaaaaaaaagaaagaaagaaagaaaagaaaaaagaaaaggaagtcttgttttaatttctattttccagcttattaataagactgagcatcttttcatatgcttgttttgtctgttgcctgttcacatctgatgcccatttctctttttgggcagtcctttttttttgctgatgtcattcatgtatgcattgaacaaatcataactggaggcctattgtgtaccaaaaattgttctaggctttcaagaatatagcagtgagtgtgacacagcccctcccatcatgtgggtcacattctggaagcaagggaccaataaaaatacaaaagtacctgagtgcagtggctcacacctgtaatcccagcactttggaaggccaacgtgagaatagtttgagtccaggagttcaagaccagcctgggcaacatagcaagaccccatctttatgacaaatttcaaaaatgagctgggcatggtggtgtgtgcttgtagtcctagctacttgggaggctgaggcaagaggatcccttgagcccaggagttcaaggctgcagagagttattatcttactactgcatgccaacctggatgacagagcaagaccctatcaaaaaacaaaacacacacacacaaatcaagagagttgtctgatggtggtaagcactgtgaagacgaagcaggatggagggaaattctttgattgttaaactagttccttgcactgatacatatcaatttttacagtttgtcatttgccttctaactctatgaaattttggttgatgcagaagtattttttaattatttttttaattatactttaaattctagggtacatgtgcacaatgtgcaggtttgttacataggaattcatgtgccatgttggtgtgctgcacccattaactcgtcatttacattaggtatttctcttaatgatatccctcccccctccccccaccccatgacaggccccggtgtgtgatgttccctgccctgtgtccaagtgttctcattgttcagctcccacctatgagtgagaacgtgtggtgtttggttttctgtccttgcgatagtttgctcagaatgatggtttccagcttcacccatgtccctacaaaggacatgaactcatccttctttatggctgcatagtattccatggtgtatatgtgccacattttcttaatccagtctatcattgatggacatttgggttggttgcaagtctttgctaatgtgaatagtgccacaataaacatacgtgtgcatgtgtctttatagtagcatgatttataatcctttgggtatatacccagtaatgggatcactgggtcaaatggtatttctagttctagatccttgaggaatcgccacactgtcttccccaatggttgaaccagtttacattcccaccaacagtgtaaaagtgttcctgtttctccacatcctctccagcatctgttgtttcctgactttttaatgatcgctattctaactggtgtgagatgatatctcattgtggttttgatttgcatttatctgatgaccagtgatggtgagcattttttcatatgtctgttggctgatgcagaagtatttttatgtgatcaaattataaatctttccctttatgttttttatgcttggaaagatttttctccatcccaacattataaaagcatttgcccaggttttcttttagtgccttatggatttacttactctgtttaggtctttaatccatctggaattgttttcagtacaaacagcaaggaaaggatccagctaaattggttagccattggcccatgaccattcattaaataatccatctttcccttggggatttgaattggcacctatgaaacacatgaattttcctgtgtatttgggtctgcttttgcactttctgtctattcctaagacacagcagccatccaaattactatagctttgtatttatttttgataatttcttactatcaaatttttttatccggtaatcccagcactttgggaggccaagatgggcagatcacttgaggttatgagtttgagaccagcctgaccaacatggtgaaaccccatctctactaaaaatacaaaaaaaattagcaaggcatggtgtcaggtgcctgtagtcccagctacttgggaggtcaaggcacaagaatcacttgaacctgggaggtggaggttgcagtgagctgaggttgcccactgcactccagcctggatgacacagcacccaggctgatttgttcatcctgaggtcaggagttcaagaccagcctggccaatatggtgaaaccccatctctacaaaaatacaaaaattagccgggcatgatggcaggtgcctgtaatcccagctactcaggaggctgaggcgggagaatcacttgaagccaggaggtgaaggttgcagtgagccaagattacgccattgcactccagcctgggcaacagagcgagactccatctcaaaaaaaaaaaaagcgttaacaaaaaattattactatatttgatggtaataattttggaaagttgactctttggacaaattctttaacttctcttggccttggtttcctcctctgtaaaacagggagactaccaatcttgaaggttgttctgggaattagtgaattaatggaccactttagttccggggtcaggtaagcctctttgagaaggtaatactccagctgaaatctgattgacaaggaagagcatgcctggcagaggaaacagcaaaggcaaaggctccgaggcagggactagcttagtgtgatgcaggttcatgcggagcgcatcgctcctggaggggactgaacaaggagagggtggaagggtgggccgcggtgaggggtctggctgtcaccataagggtactggagagccacagcaggatcaggagggcgggtggggcccattgaccctgcctctgtccccacagtccatggagtcgcaggtggaggagtggtaccgcgaggtgggagagctgcaggcgcagacggcggcgctgccgctggagccggcgagcaaggagctggtgggtgagcggcagaacgcggtgggcgagcgcctggtgcgcctgctcgagccgttgcaggagcgccgccgcttgctgctggcttccaaggagttgcaccaggtggcgcacgacctggacgacgagctggtgaggccagcgcaggggcctggggcggggcggggcggggcggtggggcggagaaggtgggcatggggcggggctgaagatggagacggctgagaccctcccactcatacgctgaaagacgcattcagccgttcactcattcattcattcacactcatttactcactttgaatcattcgttgatttattcatgaagtcactcatttatttattcactcatccatagtttgttctttcctccactcatttatttacttaactattcattcattcactcctctgttcctcattccatcactcaatttcctgatttgctcattcatttgttcactcagttgatcattctagccccagccctgtgtttggatgatagtggggccacaggggtggccaaggcagaccccattgtgccccagagggttcagagtccaacggggaaaacagacttgtccccagacagtgacaattcagggtggttaggaatatgataggaaacaagacctgtatgtgcaaaggccaacggtgtgagcctggcttaagtgcagacagcaagaaagagtatgtcaacagaggagactgagacaggtgtggtggtgcctgttgtcccagctacatgggaggctgaggtaggaggattatttgagcctggggattcgatcccatctcaaagaaaaaaaaaaaacaaaaaatggaggaggctgaatattcaactgggctcttaggcaaggaagggcctgggatgccgtgcaggtttaaagtttagttgcgatgcaggggttcttggatgcattctccccttgacctgcttcctgtgtcctctccaggcatgggttcaggagcggctgccactggccatgcagacagagcgaggcaacggtttgcaggcggtccagcagcacatcaaaaagaaccaggtgagcagagccaggtgagggagcgagttaggacatttggatacatgtgatagaaacagctgaaggtggttaaagccaaaacaatgaatgtattggcttttggaattaacaagactgtggacagcagatacagatgtatccaggtgcttccatatattttcatgactcttggctctattttttttttttttttgagatggagccttgctttgttgcccaggctggagtttagtggcacaatctttgctcactgcaacctccacttcctgagttcaagcgattctcctgcctcagccatccaagtagctgggattacatgtgtgcaccaccacacctggctaatttttgtatttttagtagagatggacggcggggggtggggtgtttcaccaggttggccaggctgggctcgaactcctggcctcaagtgatccactcgcctcagcctcccaaagtgctgagattacaggtgtgagccaccgcgcccggcctgtttgtttttctgcatgagctttcttcttaggccagtcctcctctcctggtgataaaaggcctccagtggattcaggtttacctcccaccagcaaaactgaagagaatttcccacctcaataatgtcagcagtagtctcaggaataactctcattggctcaccatgcccatggcatcccacgcccatccctgaactaatcatgatggatggggtttcggactgctccttgggctggcctggttaagcgccctcccctggaacctgctgctggaatcagccttagcttaattaccaaggctgagatggaggcaaagggggtttcccaaaggaaaatcaggggcttgagactagaaggaaggggaatagctattggacaaggaaaaagtaaaacaacaacaaacaaaatcacaaaacatcgagttagcctggtgtgatggtgtacccctgtagtcccagctactctggaggctggggagggagggtcccttgagtccagaggtcaaagctgcagtgagccttgaacaccccactgcactccaccctgtgcaacagaatgagaccctatctctctctctctctcacacacacacacacacacacgtcccccaaaacaaacaaacaaaaacacccatagggacaaaggacagagataatcagcaagaggatactactgccccctaacctgagcaaggtgggggagggggcctttgagctcctaaaaaatctctgaatctgttcattcctctggggctcagtttccacatctaaagtagagttggtttagagcagtggttctcaaactgcatacgaagggaaccccttggtcaaagcaactatttcaccaaagcctaaagcaagacataaaagaggaataataataataaggcattgtgccaggtgtggtggctcatgcctgtaatcccagcactctgggaggccaaggcaggatgatcacttgagcccaggagtttgagaccagcctgggcaacatggggaaaccccgtctctaccagaaatacaaaaattagctgagcatagtagaaggtgcctgtaatcccagctacctgggaggctgaggcaggagaattgcttgaacccaggaggcagaggttgcagtgagccaagatcacaccactgtactccagcctgggtgacagagtgagaccctgtctcaaaaaaaaaaaaaaaacatcgattaaagatttactaagtgctggctgggtgcagtggctcatgcctgtaatcccagcactttgggaggctgaggtgggtggatcacctgaggtcaggagttcgagaccagcctgaccaacatggtgaaaccctgtctctactaaaaatgcaaaaaattaaggccaggtgcggtggctcacgcctgtaatcccagcactttgggaggccgaggcgagtggatcacgaggtcaggagatcgagaccatcctggctaacacggtgaaaccgcgtctctactaaaaacacaaaaaattagccgggcgaggtgtcgggcgcctgtaatcccagctactcgggaggctggggcaggagaatcgcttgaacctaggaggcggaggttgcagtgagccaagattgcaccattgcaatacagcctgagtgtcaagagcgagactccgtctcaaaaaaaaaaaaaaaaaaagattaaaaaaaaaaaaagatttactgtgtgctaagtactgtcttagggtttatgctgattatttaatttaatcccctctataaccctatgaggtagatattgtcattatcctcatttcaccaaacaatgtatgttggaagaatagggcactgaaggatggtggggaggtgggtctacagattattttggaagcttcctgatcattctgcagtaggtagagttatttaagagactggagttttgctgagattttgttttcctgtcttgatgaaaatactcttggctgtcaacagtgtgggcgacagaactggcttatcgttgtcatggttgaggaaactgatcaagtgcacttagtacttaaaattgggggagctcagctgtgtgtgcagtgagagtgctggatacacaggggctgttaagccaaaaatagctgcaaatatgatgcatttggtgcatgcagactcagttccaagtgctccatagtttatcaccttataacaaccccgcaaggtagattatctcagcctgatactagctgtgtgaccttagcaaattcctcaccctctctgtgcctcagtcttctcatctgtaaaatggagatggtaatgttgtctggctccataggttgggagtgaggaggtgtgaggctatattatgtaaagctcttacttagcaaagcacctggcaggtagcagggtagcagacactcaagaatcgttggctggccgggcacagtggctcatgcttataagcctagcactttgggaggccaaggtaggaggatcgcttgaggccaggacttcaagaccagcctgagtaacatagcaagacctcgtctctccaaaaatattttttaaaatagcagggcatggtggtgcacacctgtagtcccagccgcttgggaggctgaggcaggaggatcacttgagcccaggagtttaaagctgctgcattccatcctgggtgatagagtgacaccctgtctctaaaaaagcaaaataaggagaggacttgctggctgttattatctttatcagttgagtcacacaaaaagttaaataacgttaaggcacacaaaaagttaaaaaagactcacaaaaagttaaataaggtactctgtaagtaaataaggttaaggcacacaaaacgttaaataaggtactctgcaagtacagagctggttgagggaaccttctgggggatggaagtgttccgcacgctgatctgggcacaccggtgtatgtgtctgtacaaatgtgtgcaactgtatacctaagatttgtgcactctaccgtatacaaatgatacctcggctgctaagctgcagggtttctgtattagggcccatcttgggtcggcaagcggcttggctcagagcacagtctctggaaccagcctcctgtgttcaaatcctgtcactccttactggctgcttgttcttgggcgccgtacttcgcccctctgtgcctgttttcccacctgcagcaagcatagggttatgatgagtgagggagtatcagcaaaatgtttacatggtcttggcacgtggttagcgagctgggggtgcttgttaattgccccgtgggccgtgccagtagcagaggagcgtgtggtcttgcagggcctcggaacgccccctctccacccacatccccttacctcctgcccccagggcctgcggcgggagatccaggcgcatgggccgcgcctggaggaggtgctggagcgcgcgggcgcgctggcgtcgctgcgcagcccggaggcagaggcagtgcgccggggcctggagcagctgcagagcgcctgggccggactgcgggaggctgccgagcgacggcagcaggtgctggacgccgccttccaggtggagcagtactacttcgacgtggctgaggtggaggcgtggctgggcgagcaggagctgctcatgatgagtgaggacaagggcaaggtgcgcccgagctgggggtgcggagggcctgggggcgctggagccgggggccgccgctgccgcctcatcgtgggcgctttgtgcccccaggacgaacagagcaccctgcagctgctcaagaaacacctgcagctggagcaaggcgtggagaactacgaggaaagcatcgcgcagctgtcgcgccagtgccgggcgctgctggagatggggcacccggacaggtgggcgggcgcgtggccagttcacaggaatggtccagcaggacctgaagcttcgctgttgggagttggcgcagcgctggaattggacgttgggtgggagaggtcctccttgctgtgtgctggagccctcgaatttggcaagtgggcgggccggaatggggggacacggctcagggatggttgagagggtggggccaggagcacctggatttgagtgtagtagtggggaccttgtcgggggagaaaagagtaggcgatgtctaggactggggtagagaagaatttactcaggacaggcaaggggctctttctactcagtgtctgggaggacagaaaagcctgtgctgagattggctatggcggtggggctggagacctcctggtgcagtggggtgatgttgcctcgtgtaggcggatgctgagctccaggcctggaccagggatggaatctgtaaggaggtacagagagagacctctgtccaagtgggctcagagattggggctagaggtgggatgcattggctggggacccaacctgggagtccagagtcccaccgaggttcctggataggaggggcgtgagactgagatagaaaccgggtgaggctgccgaggtgggcggatcacttgaggtcaggagttggagaccagcttggccaacatggtgaaaccctgtctctactaaaaataaaaaattagctgggcatggtggcacgtgcctgtagtcctagctactggggaggctgaggcaggagaatggcttgaacctgggtggcagaggttgcagtgagccgagatcgcgccactgcactccagcctggtgacagagcaagactccgtctcaaaaaaaaaaaaaaaaaaagaaaagaaaaaaaaagaaaggaaactgggtgaggctggatagaggtgagcttatccatttagggaagcggagctttccctgcatgctgaaatgcagggctttctgaacccaagacttgcagaaaacagagtcctggccaggtgtagtggctcacacctgtaatctcaacactgggaggctgaggcaggaggatcgtttgagcccaggagtttgagaacagagggaacatagtgagacctcatctctacaaagaaatcaaaaagttagccaggtgtagagtcacgtgcctgtggtcccacttgggaggctgcaatgggaggattgcttgagcatgggaggtggaggctgcagtgagttgtgatcacaccactgcactccagcctgagcaacagagcaagaccctgtctccaaaaaaaaagaaaaaagaaaagaaaacagagctctacctggggacacagccgtgtctgaagattccaaggaaacacagccctgtcctggggagggggtttaggggggtcacgctctgccccagaagtctcaggggtccatccctgcccctccatgtcccccttcagcgagcagatcagccggcggcagtctcaggtggaccgcctgtacgtggcgctcaaggagctgggtgaggagcgccgggtggctctggaacagcagtactggctgtaccagctcagccgccaggtgagcgagcttgagcactggattgccgagaaggaggtggtggctggctcacccgagctcggccaggactttgagcatgtctcggtgagcatcattagtaataagtgataccaggagctaccactaaggttctctgggccttagtttcctcatctgtagtatgaggataataacagcacccgcctcatggctctgctgtgagacaaatgagttaatataacgtaaagcactgaggaccctgcttggcacacatgctgcctcacacagtgttggttattattatcagcttattattttattgttacttattgttatttttattgttactgttttgttactattcttgccaggtgttcagtaagtgttagatattattttttatgatgatgatgatgatgatgattatcattactcttacctgccacaaaatggtagcctctgccaggtgtggtggctcatgcctgtaatcccaacactttgggaggccaaggcaggtggatcacttgaggtcaggagtatgagaccagcctggccaacatagtgaaaccccgtctctactaaaaacacaaaaaaatcagctgggtgtggtggcacatgcctgtagtcctagctgtttgggaggctgaggcaggagaattgcttgaactggggaggtgaaggttgctgtaagtggctattgaaccactgcacgccaacctgggcgacagagcaagactctgtatcaaaaagaaaaaaaaacattgtaggctggagggggctggtgtatgctgcccctttgctcactttgctgtacccccccccccacttcctgatggcaggtgctgcaggagaaattctcagagtttgccagcgagacaggtatggcagggcgggaacggctggcagctgtgaaccagatggtggatgagctgatcgagtgtggccatacagcagcggccaccatggccgagtggaaggacggactgaacgaggcctgggctgagctgctggagctcatgggcacacgggcccagctgctggccgcctctcgggagcttcataagttcttcagtgacgcccgagagcttcagggacagattgaggagaagcggaggcggctgccccgcctgaccaccccgcctgagccgagacccagtgccagttccatgcagcggaccctgagagcctttgagcatgacctgcagctcctcgtgtcccaggtggggcgccggtggccatcagggcaggtgggagggcctggacagctgtgggcagcagagtgggcaaaaatcaggctgtggagcaggtcgaaattaggcagtggcacagacagaaagcggactacagaacaggaagaaattagataatggagcagatagaaaatggactgatggaatgatatatagaaatcaggtattggcagggaaaagtggtaccttagaaggtctcacagatattaaacagcttctggctgggcgtggtggctccctttgggaggccaacgcaggcggatcatctgaggtcaggagtttaagaccagcctggtcaacgtggtgaaaccccatctctactaaaaatacgaaaattagccaggtctggtggcgggcacctgtaatcccagctacttgggaggctgaggcaggagaatcacttgaacccgggaggaggaggttgcagtgagcccagatctcgccattgcactccagcctatgtgacaagagtgatactctgtctcaaaaaaaaaaaaaaaaaaaaaagcttccaatagatattgggcagtggttctcctaaaactgtgagttttgcctaaatccagatcaagggtctaaagggaattttgagaagtctgagaggaatttggctgtggtgtagatagaaattagacgacagacaaggccaggtgcggtggctcacgcctgtaatcccaacactttgggaggtcgaggcgggcagatcatgaggtcaggagttcaagaccagtctgaccaacatgatgaaaccccgtctctactaaaaatacaaaaattagcaggaatggtggcgggcacctgtaatcccagctacacaggagactgaggcaggagaatcgcttgaacccgggaggcggaggttgcagtgagccgagatcgcgccactgcactccagcctgggcgacagagtgagactccatctcaaaaaaaaaaaagaacttagataacaggtctctgatggaaatcatatgacttttctgaaattaatttgatgggggcgaatttaatgaaaaaggcaacagagatattagaaattaggcagaggttctggccagaattcggatgtggatctgagcagtcagatggaaatgaagctgcaggcccaatacaactcaggcagcaggaaattgggttgcagttctaatggaaggtagaagttgggcaatttttgtttgtttgtttgtttatttttgagacagggtctcactctgtcacccaggctggagtgcagtggcgcgatctcagctcactgcaccctctgcctcccaggcttaagcgattctcctgcctcagccttccaaatagctgggattacatgcacgcgccaccacacctggctaatttttatatttttagtagagacgggatttcaccatgttggccaggctggcctcgaaatcctgacctcaggtgatctacccgtctcggcctcccaaagtgctgggattacaggcatgagctactatgcccagctggcaattattattattattattattattattattattattatgaggcagagtctctctttgtcacccaggctggagtgtagtggtctaatctcggctcactgcaacctctgcttcccgggttcaagcaattctcccacttcagcctcgagtagctgggactacaggtgcaagccaccacacccagctaatttttgtatttttagtagagatggggtttcaccatgttggccaggctgatcttgaactcctgacctcaagtgatctgcccgccttggcctcccaaagtgctggggttataggcatgagccaccgcgcccagcccagttattttttataaatcctacaaatgacttagaaatcaggctgagagattcatagtaataagtggtggatctgttagagatggggaggtcacaccaaaataaatcaggagattgaaccaacagagtgagcagcaggctgagcacagtggcttatgcctataatctcagcactttgggaggccaacctgggaggattgcttgagcccaggagttcaagatgagcctgggcaacatagtaagactccatctctattacaacatatatgtatatatcctgatacagtggcatgcacctgtagttcagctattagtaggctgaggcaggaggatcacttgagcccgggatgtcaaggctgcagtgaattgtgtttgtgccactgcactgcagcctgggcaacagagcaagaccctgtctcagaaaaacaaacaaaaaacccaaaacccaaaagatagagtgagcagagctcatacagcagaatgaatggaaattgggcaggggagtaatggcaattgaacagccgtcgtgtaggaaactgggctactatgaaggagtgggtttgaaataaactgagttaaaaaaaaattagcacatctaaaagacatcaaagtggaaaggggtttcctgaaagacccaaggtaggggtgggcctgcctgaaaacacaggtggcagacccaatagaaataaagctctcagaccaaaagaaatcaggcagtgggttgaaagagatgtggtagtagatctaaaagaagtcagaatgcgggtaagtcaaagagaaatcaggcagcagatatgacaggagcctggctgtgggatcacagtgtgaggctccttatatcttgaggttctgcgctggagcagatggtgggagggagggcacagcctgggccccgtggagggctggcgcccgacctggcatgcccttcaggtacggcagctgcaggagggggcggcccagctgcggacggtgtatgcgggtgaacatgccgaggccatcgctagccgggagcaggaggtgctgcagggttggaaagagctgctgtcagcctgtgaggatgcccgcctgcatgtcagctccacagccgacgccctgcgcttccacagccaagtccgcgacctgctctcctggatggatggcatcgccagccagattggggcagccgacaagcccaggtgcccctcatccctcctcgggcttcctgcctccccctggtggcctaccccagccacccccagcccattgacagcccccttctcaatggaatgacaacagccaatatctgtgtggcgcctctgtgtgctaggcactgttctaggtgcttcgtgtgtattcagaccccttttttaggcctgtcattggggacttcggtcatggggcatccttctgtccgctgtccttcccagttgcctattattaccctctccatgggatgtcacagcatgaaacaggctaaagacaggatgggcaagggaggtgtgggactgtatttgtgagggtgggtgaagaattctaacaattccagcatctcagtggcttcattagtgggcatgggcttattgctcacatagtggttggatgtgagtgtccagcagaatcctgtcccctggtgattgggagccagggtccttccatcatgccaccctgggagtcacatgctggaccctctgcatcccgctgcagatgggaaaagatagcaggaggatcacacagaaggttttagggataaagccggcacccacacactgccagcccggtggcctaacctgtctgccagggaggctgcaaatttttttttctcttgagatggagtcttgctctgttgcccaggctggagtgcagtggcacaatatcacctcactgcaacctccgtctcccaggttcaagcgattctcctgcctcagcctcccaagtagctgggactacaggcgcccaccaccacgtctggctaattttgtatttttagtagagaaagggtttcaccgtgttggccactctggtctcaaactcctggcctcaagtggtccacctgcctcagccttccaaagtgctgggattacaggcataagccaccgtgcctgacctaggctggaaatttagtttcatggtgtggctaggaagaaaaggacctagggaatcagggacacctggcattgcttctgggaatgcagatcctgcagcctgcattcatttactcagcaaatatgtattaaatgcatatggtgtgccatgtggtgagcaaggccaagcacttgccctgagacagattgcattctcatagcacttattactttctgaaatatagcatggggatggggcacagtggctcacgcctgtaatcccagcactttgggaggctgaggcaggcagatcacctgagctcaggagtttgagaccagcctagccaacatggcaaaactccgtctctactaaaaatacaaaaattagccaggcatagtggtggacacctgtaatcccagctacttgggaggctgaggcaggagaatcgcttgaacccgggaggtggaggtcacagtgagccaagatcgtgccactgcactccagcctgggtgacaagagcaaaactccgtctcaaaaaaaaaaaaaagaaaagaaaaaaaaatgaaatatagcgtgggtatatatacatacataggaagggaatgatagctggcaaagtctctctgaggatgtgcgtttgactggagacctgaatgaagtgatgggtgagtcaggtaaagttttgagggaagagttttctaggtggagggacccacaagtgcaagggcccagaagtgggctgtagttaggcatgtgtgaggaaaagctagagatcactgtggccagatggagggagggagtgagggagtgtagggtgagaggaagtgagtacagaggggcactggggccctggaaaccacacatggtgaggagcatgccttctctatgaggaacgtgggagccatgcgagagtttagagcagagtggagtgatgtgatgtgtacatttgagaaaaataggccgggcatggtggcttatacctgtcatcccagcactttgggaggccaaggcgggtggatcacttgaggacaggactttgagaccagcttggccaatgtggcgaaaccccgcctctactaaaaatacaaaaattagctgggtgttgtggcatgtgcctgtagtcccagctactggggaggctgaggcaggagaattgcttgaacctggaaggtggaggttgcagtgtgctgagatcgtaccactgcactccagcctgggcaacagagcgagactctgtgtcaaaaaaaaaaaaaaaaaaaaaaaggctgggcacagtggctcacacctgtaatcccagcattttgggaggctgaggtgggtggatcacttgaggtcgggagttcgagagcagcctgaccaacatagagaaacctcatctctactaaaaatacaaacttagccgggtgtggtggcacatgcctgtaatcccagctacttgggaggctgaggcaggagaattgcttgaacccaggaggcggaggttgcggtgagccaagattgtgccattgcactccagcctgggcaacaagagcgaaattccatctcaaaaaaaaaaaaattaaatatacagggaagtaaaggtaacccacatgtgtatcgtgaacacttggcttgaacaaccatcaacatttggccaatctagccaaaagaggtggctcacgcctgtaatcccaacactgggaggccaaggcaagaggatcacttgaggccaggagtttgagactaccctacgcaacatagtgagaccccatctctacaaaaaagaaaaaaattagtcaagcatggtggtgtgcatgcctgttgtcccagctacttgggagtctgagggaggaggatcacttgagtccaggagggtcaggctgcagtgagccatgattatgccatttcactccagcctgggtgacagagcgagattctgtcttaaaaaaaaattttttttttttaattagctgggcattgtggtgcatgcctgtagtcccagctaccctggaggctaagccaggatgatcacttaagcccaggtggtagattcaaaccatagcatgaagctatgattgccaactgatggaaccttcagaaacttggaatttgttttggacataagatggcttagaatggtgctgtccaatagttatataacacgagccacaaatgcgagccacatatatactttaaaatcttcttgtggccatactaacaaagcaaagcaaatgaaacttaattttagtaatacatttttatttaacctgacatacccaaagtattatcacttcaacaggtagtcaatattaaaactattaatgaggccaggcagtttcgaacttctggcctcaggtgatccgcccgcctcagcctcccaatctcagccaagcggagatcgcaccactgcagtccagcctaggtgacagaaggagactccatctcaaaaacaacaacaaccaaaacaaagaaacaaaactattaatgaggccaggcgcagtggctcatgcctgtaatctcggctgagattgggaggctaaggcaggcggatcacctgaggccagaagttcgagaccagcctggccaacatgccaaaaatccatctctactgaaaatacagaacaaaaaattagccaggcttggtggcgggcacctgtaatcccagctactcgggaggctgaggcaggagaattgcttgaacccagaaggtggaggctgcagtgagccaagatcacgccattgcactccagcctgggcaagaagagcaaatctctgtctcaaaaacaaacaaacaaacaaacaaaggctgggtgcggtggctcacgcctgtaatccctgcactttgggaggcctaggcaggcggatcaactgaggtcaggagtttgagaccagcctgacaaacatgttgaaaccctgtttctactaaaaatacaaaaaaattagccaggcatggtggcaggtgcctgtaatcccagctactcaggaagctgaggcaggggaatcgcttgaacctacctagaagggggaggttgcagtgagcggagatcgcaccactgcacaacaacaacaaaaaactattaatgagacattttacattcttttttacattaactccacaaaatctggtgtgcattttacactttacaccaaaattcagactggccacatttcaagtgctcacatgtctagtggctactgccttggagagcacagacttggaacgttaaaatcattggctagtggaaccttcagaagcatagctagaaaaagtttgaaaatttggatcttggctgggtgtggtggcttatgcccatagccttgaactttgggaggctgaggcaggtggattgcttgagcccaggggtttgagaccagcctgggcaacatagcaagaccctgtctctacagaaaatgaaaaattagttgggtgtgatggtgtgcacctgtggtccccgctactcaggaggctgaggcaggaggattgcatgagcccaggaggttgagactgaagtgagctgcaatcttgccactgcactccagtctgggcaacagagcaagaccctattaaaaaaaaaaaaaaggaaaatttggatcttgaaatcctagaaggttagaatcaccaaagtgtgaaattttagaaacttggaaaatttgaatcattgaattagtgaaccatggaccctcagaatttggtcatcgaaagtaggtgtctcagtctggtttggtgactcaacgcctgtaatcccagcactttgggagactgagatgggaggatcacctgaggtcaggagttcaagaccagcctggccaacatggagaaaccccatctctactaaaaatataaaaattatctgggcgtggtggcaggtgcctgtaatcccagctactcaggaggctgaggcaggagaatcgcctgaactcgggaggtggagtttgcagtgagccgagatcgccccactgcactccagcctgggccatagggtgagactttatctcaaaaaaaaaaagaaaagaaaagaaaagaaaagaaagtaagtgtcttgaggtggtatgggatgtcagcctcaaggatttggggtcaccaggagccacatgtatggggcaggctgaggaggctccctgtggctcagatccctgcctgccacccactgcagggacgtgtcatcagtggaggtgctcatgaactaccaccagggcctgaagactgagctggaggcgcgggtgcctgagctgaccacctgccaggagctggggcgatctctgctgctcaacaaaagtgccatggctgatgaggtggggagcagggagggggtccccctctgccacccgggcacattggggtggaagccattccacaccctgacttccctcccacccacctgccactcccagatccaggcacagctggacaagctgggaaccaggaaggaggaggtgtcggaaaagtgggaccgccattgggagtggctgcagcagagtgagtgggggcccaggcacacgtggttcaagggcacagggacatgctccagcctgtccagccaaggcccagagggtgacaggagcatgctttgcaccctacccatgggtctccagaagcaaacataagggcctggaagggtggacaagggggctgccttgccattgaatacccacccttgaaaaaaaagtcttaaagtcctgggtggggggacattaaggaaggaggaatgggagtcagaaaggaggaatgatgcccactgaaatagccccagcctctgccattcctgcagagcccaggatggtcagggctcgggtatggaaagccggaggggtgtggaaggccaggggaacagccattgcccccaggaagggccccagatgccccagaatccttaccctgcatgcccctcctcagtgctggaggtgcaccagtttgcccaggaggcggtggtggctgatgcctggctgacagcccaggagccgctcctgcagagccgggagctgggcagcagcgtggatgaggtggagcagcttatccggcgacatgaggccttccgcaaagcggctgcagcctgggaagagaggttcagctctctgcggcgcctgaccacggtcagctccccagatactgccccattacccccacccccaccaagacccccacacccatggctctatatgagacagacacaccgagacatggtgcttggtcctgtgttgtgtgagtgccaagacagactcttgctaggctcccagtggagcagagggacagacctgtcaccagtgacagcccagaatgtcagggatgtgataggggaagaacaagcagagggatagtgcctgggatgggggagtgggagggggaactggcctgggggattctattctgagacttgaataattaggtgaagagaatgtagtaataaaaaggattaggccaggtgtgacggctcatgcctgtagtcccagcattttgggagaccaagatgggtggatcacttgaggccaggagtttgagaccagcctggccaacgtggtgaaaccccatctctactaaaaatgcaaaaattagctgggcgtggtggtgcacgcctgtaatcccagctactcgggaggctgaggcaggataatcacttgaacttgggaggcagaggttgcagtgagccaagatcgtgccactgcctgggtaacagaacaagactccatctcaaaacaacaacaacaataaaaaaaaaacaacaaaaaaaaaccgcttaaaggctgggtggggtggctcacacctgtactctctttggaagcctaggcgggaggatcacttgaacccaggagttcaagaccagccttggcaacatactgagaagccgtctctaccaaaaccaaaagcaaacaaagaaaaaacagccaggcgtgatggcacgtgcctgtagtcccagctactcagaggggtgactgagactcgaggatcacttgagcactggaggtcaaggctgcaatgagctatgatcttgctgcttgcactccagcctgggcgacagagcaagactgtctcaaaaataaataaataaataaataaataaataaataaataaataaataaagtcttaaagtcctgggtggggggacattaaggaaggagaaatgggagtcagaaaggcacgcagagcaattgatttacccaatttttaaaaaagtgatttagccaattcttaaaagagcaataggtgtttgccggagagaataggctttaagttcttggcagagagcaaagcatcgcacaggcctggacaccttgctttttcaaggaactggtcaattgagtgatgaggcagaaaaacccaggccgcctccccggacctcccccttaccccgccccggccccacgcctccaacctaaccctggtccctccatcctcagatcgagaaaatcaaagcggaacagagcaagcagccgcctaccccactgctggggcgcaagttctttggggaccccacggaactggcggccaaggcggcgcccctgctgcggccagggggctatgaaaggggcttggagcccctggcccgccgagcctcggacacgctctcggccgaggtgcggactcgggtggggtatgtgcgccaggagctcaagcccgagcgcctccagccgcgcattgaccggctgccggagatcccggggagggtggagcccgcggccctgccggccgcaccagaggacgcggcggagacccccgcgacccccgcggcggcggagcaggtgcggccacgaccggagcgccaggagtcagctgatcgcgcggaggagctgcccaggaggcggcggcctgagcggcaagagtcagtcgatcaatccgaggaggctgcgcggaggcggcggccggagcggcaggagtcagcggagcacgaggcggcacacagccttaccctgggccgctatgagcagatggagcggcggcgcgagcggcgtgagcggcgcttggagcggcaggagtccagcgaacaggagatgcccatcagaggagacctggtcaaggggtgaggtgcccgccttatgaccagaaagtgaggggaggggaaagcggagagctcctagaacccctcaggcccagtgaaagggcttcagggctcagaacttcccaaagaaggagatatcgccgcggtacccattttgcagaggtgtaaactgaagctgcaagataatcgatgtgcccattgttacacagaaaggggagcccttcctgttgaaagaaaaggcagactgcctttctccagacgtaggttctcggcccctgggttgtgactcctgcatcaagtctcccgggtgccccgaggcagggattttgtcctctctgtgcctcagtttgcccactgggctaatggtggaaccctcacctccttgattggagaggagaccctttatcacaattctctcagcagccttatgaagtgggggctgttgtcttctccattgtatgactagggcaactgaggcacaaaaagggcaagtcactcagcttaaacgaaccaggactttcagaatccagagttggccagtgtgtgttgtgcagatctgtccagtcagctgagtgtgtctccagaaagaggcctttggtcaggagacaatgacttcttgattctttttaaattgcacatttcatgaacatttgctgagtgcccactctgcctggcatgtgctgagtcgagcggtgactgaaccagtcccatccctgactttagagactcacagtccattgggaaaaacaggcttgtcatcaatgatgaccgagaattatctgggctggaatgggggcgattgggggactggagagtcaggggtgggtggagaaaggcaacgtttgcaagttgttctttgtgctgcttaaaattcaaaggggcatctgggcgcggtggctcacgcctgtaatctcagcactttgggaggttgaggcgggcagatcacttgaggtcagaagttcgagaccaacctggccaatatagcaaaaccctgtctctactaaaaatgcaaaaattagccggcatggtggcgcacgcctgtagtaccagctacttgggaggctgaggcaggggaatcgcttcaacacaggaggcagaggttgcagtgagccgagatcatgcaccactacactccagcctgggcaacagagaaagactccgtctcaaaaaaaaaaaaaaaaaaattcaaaggggcgagaggtttggtcttccattcagcagacacgtcccaaacacctgtggtacctaaggcgagcatctgagagaaacagctgcagaagtgggcaggggcctggcacttccagctaagaagtggaggctcctctgcccagccagacaggtccatgggagaaggaaccctggtttcactgggtctttctgtcccccatcccccaggaaggccaccctggctgacattgtggaacagctgcaggagaaagaggcaggcccagggctgcctgctggggtaagttgagcctcggatgggtggggataggaggacccctttttcagagcaggaggcaggatctcagaaacagccagtgcctagccctggcaggacccattccctacctggaccctgcagagacagcatggactctcagggtccccagaatctgaaaatgtcccccttagaaagacggggcacctacctaagagacccctactgcccctccacacacacacacacacacacacacacacacacacacagacacacacacacagacacacacacacagacacacagacacagatacacacacagacacacacacacagactcttcccacatctgtcctggactccgtatttcttcagctcagtggggtcccaaatttcttcatagcctcatacacacacacacagaaggaagccccaggtttctcctgcagacagtggggacacgccctgcttgcacccccacctccagagatctggctgcctctttccaccaccgagagagattccaaaccaatgagtcctaacagactcactcccaagacccatggggccctaagaattgggcctccaaccctgaggtcctcccatactcgcctccgagacaaatggccctgtagacagatgggaccccagacccatgactcccccaaacagatgacccccacaccctctccatggacagcacccctcttccccctcccttcacacagccgtcgctgcctcagccacgcgagcttcccccaggtcgcctgcccaacgggcttgagctgcccgagcggacacctcggccggaccggccccgggcgcgggaccggcccaagccgcgacggcggccgcggcccagagagggtggtgagggcgggggaagccggcgctcgcgctccgccccggcccagggcggctccgcccccgcgcctccgccaccgcccactcacacagtgcagcacgagggcttcctactgcgcaagcgcgagctcgacgctaaccgcaagtcgtccaaccggtgagcgtgtgggcggggctttggaaggcgggtctcaggctcagggtgaccattgcgtggagcggtgggactgaggagggggtgtggctcaacttcaggccctccagcaggtggcggtagtaggtggggccagagctggggggtggtggtggcttaaatcaagaaagccaaccaatgagcaggagggggtgtggtttaacgtcaggccctccaacccgtgggggtagtaggtggggccagatgaggggtggggctcaactttgatgattccaaccaatgaacaggaaggggcaggacctaaggttagtgcatctaatggatgatgggtagagcttaggtgggaacagaaggaaaatgttctgaaagtgagtaaattggaacctaacctcttagcaaccaacccaggagttgatcagctaaatagcaaagagggaggcatctagttgagaaggtttcaatggcttgtcgtggagcttggagaggtcactcaaccaatgagtggggtgggtctacccttgaagtttcaaattgggggagggtccgaaaacgggcagagcccaaactaatgagggtaggggttgggaagggggagtcatctcttacaggtttccaaatgagggtctagccatgatgtgcctgctcttggggagtccagctcctgcttgtccaccctctttttgtccaactgagaggcagaatctggggacaagtggagccaaaaaggggtatcaccggccagtaatggagtgagtcccaagatatgaagtgggcaggacagattcagattttgctagtggaatctgtaggtggtctttcttcctcgtacctaatgccaaggtaggaataaacaagggcacctagtatgttttgctttgggagggattcctccaggatcgaggctttggatgactggagagacaggaattctttattccagacagtagaccaatagactttccttgagaaagctccatgagtggggaggattgagtggagcaaaggcttatggaggagacagcttaagacttaccttcaggaaattcagtatgggaggggataaggaagggaaatctcagcctgggcaaaggcttgatactgagagacttaaatgctcccctcagggcagcaacagccttaaggaagagcattttaggtccaactagggcgcaactagggcgcaaaggtccagaggtaggaaggctcagacatattcagaccttgaggatgttaatgaagagttattaggcagagtgctgcggctctgccttgagccccatcttgtcgctccaggtcgtgggtgagcctgtactgtgtgcttagtaagggggaactgggcttctacaaggactccaagggcccggcatccgggagcacacacggtggggaaccgctgctcagcctgcacaaggccaccagcgaggtggctagtgactacaagaaaaagaagcatgtcttcaagctccagtgagccccccaatgggcaggagggagggatccaaggctcagcttcaactcccagtgggaccctggcttccctgggggacacttggtgggcaggtgggctgggccccttccccagatctctgaagtcctgtgtcccttcctgcaggacccaggatggcagtgagtttttgctccaggcaaaagatgaggtgagatctggtcctttcctccctctgtgtggacctcagtaatgacctggctgtctggctcctgacccagagtgatggggctgtgagaagggacactcacaggccagagttatcagggctgtaatgggaaagcccacaggcactgagagcccaaaggaggttcctaacccagtggggagtgggaagggcttcagggagggctgcctgcagatcctgatgacaaagtccaacatctttgccgtggtcactcaggtgagactggaatggagggagttcgctttaaaaaggggtgatttggccaggcgcggtggctcacgcttgtaatcccagtactttgggaggccaagacgggcagatcacctgaggtcaggagtttgagaccagcctggccaacatggtgaaaccccgtctctactaaaaaatacaaaaattaactgggcatggtggcaggtgccttaatcccagctacttgggaggcagaggcaggagaatcgtttgaacctggaaggcggaggttgcagtgagctgagatggagccattgcactcaagcctgggggacaacagcgagacttccttcgaaaataaaataaaaataaaaagggtgattcagagggacagtgggggtctaaaaaaaggagtgattcaggttgggcaccatggctcaggcctgtaatcccagcactttgggaggccaaggcaggagactgcttgagcccaggacttcaagatcagcctgggcaacacggaaagatcccatctctatgggtaataataataataaattagccgggagtggtggcacatgcctgtggtcccagctactcaggaggccgagtggaaggatcacctgaaccagggaggtcaaggctacaatgagctgtgattgtactatggcactccaggctgggtgacagagtgagattctgtctcaaaaacaagagggggtgggtgatctaggtagagggaactgcaagtgcagaggaccagaggtgcagtattgcaaagggttaactgctggagggcagagttcatggaagaaggtcccagaaaggttcccaggagataggtgtctcaggacaggatgggccatttggaggagattggattttttacctaagggcactggagagctaggggggattacagtgatgtgtaaaaaagattcctggctgggcgcagtggcttacgcctgtaatcccagcacttcgggaggccgaggcgggtggatcacctgaggtcaggagtttgaggccagcctgaccaacatggagaaaccccatctcttatggtgcatgcctgtaatcccagctactcgggaggctgaggcaggaggattgcttgaacccggaaggcagaggttgcagtgagctgagacagcgccattgcactccagcctgggtaacaagagcaaaactccatctcaaaaacaaaataaacaggccgggcatggtggctcacgcctgtaatcccagcattttgggaggccgaggcgggcagatcacaaggtcaggagatcgagaccatcctggctgacacggtgaaaccccgtctctactaaaaatacaaaaaaattagctgggcatggtggcgggcgcctgtagtcccagctacttgggaggctgaggcagaagaatggcttgaacccgggaggtggagcttgcagtgagctgagattgcgccactgcactccagcctgagcgacagagcgagactccatctcaaaacaaaacaaacaaacaaaacaaaacaaaacaaaacaaaacaaaaaaagattcctttggctacctgggtgggtagcccaggccgcggccagggcagggacccaagtgggagagcgcatggctgggccacacaggcctgtggggagaggaggaagaggagtctgagagaggcaagcataaaggtggtttgaagagatgttgagagtaataactaacacttgttatctcattcaatcttcacaagatgcaatgaagaagtgggctttttttttttttgagacagagtttctctcttgtcacccaggctggagtgccatggcgcaatctcagctcactgcaacctccacttcccgggttcaagcgactctcctgcctcagctacctgggtgactgggattacaggcttgcgccaccatgcccggctaatttatgtatttttagtagagacggggtttctccatgttggtcaggctggtctcaaactcctgacctcaggtgatccacccgcctcagcctcccaaagtgctgggattacaggcatgagccaccacacccggccagaagtaggcctttacccactacatgccttcttttacttatctgcacaatgaagattaaaaatagtttcttggcctggcatggtgcctcacacctgtaattccagcactttgggaggctgaggtgggcagatcatttgaggtcagaagttcaagaccagtgtggccaacgtggcgaaaccccatctctactaaaaatacaaaaagtagccaggcatggtggcacgtgcctgtagtcccagacactcaggagactgaggcacaagaatctcttgaacctgggagatggaggttgcagtgagctgacatcgagccattgcactccagcctgggggacagagcaagactctgtctcaaaaaaaaaaaaaaaaaagtctcttatcatagggttactgtgagaattaaattgctccatgtttaattgatacatgataaactgatacttagcacagggcctagtaaatatcagtgctctagtagtgcctgcccatattattatcattgtttgtgtcatttatctctgtagtaggaagtatatacaatcctattgcataggtttaagggaattaatccactaaagtgtttggaacagagcctggcacatattgctatgtaactgcatcatcatcatcatccctttttaatagatgagaaaactgaatttcagagagggtagtctgatctgaaattcacctattattccagcttctctcttccaaatacggcctctgtgccctgtttcttcccccaggaggagatgaacggctggctggaggctgtagcttcctcggtggcggaacacgcagagatcgcccgctggggccagacactacccactacttcatccacagatgagggcaaccctaagagggaaggcggagatcgcagggccagcgggcgcaggaagtgacttcccacccccaggacctgacacatctcgtctcccctcttttccgcactgtgggcacaaagacactttttcttccgcaggggcgggagcccctagttccaacactgaggacgcgtgacatggtgggcaccggaaaggaggggacttctcctgcaccccaagaagtggtggggagattgctgcccctatagccatatctcggccccttcccactcaccacccccaccccaggtgctgggggtcccttatttttatgcaataactgagcttgatgggggtgggcagggggccagttgagccaagcccccagccccgatctgcagatcctgccccaagaagctggggtggtgggggcagtaattcctgcccccctctctgccctagggatgggcacgggggcgctggtgaggtcccctggaccatccagggtgctagggggcagggaggggacaccccctccccgcctttacctcacttccaatgctgccttgatctctgtctgggaggggggagtgaaggggccctagccccctgcactccgccgcctcagagccatgcggttaattcctgacttagtttatttttgcaaaacgtcgatctcctcctcccccgccccgcatccgcgaaggcttttaatgggaggggcgtcaaagctcaaaactgttttcctctctcctcccccctccagttgtaaatgccacttcatgaggggaggggcgaggggaagcccacccctgcatgcttctggctggagcacctccctggggagtcgggggattgggttgtgggcagtccccatggccgcctggagaagccgctggggcccgggggtgtggggcggtgtggcgggcgcacactgtatgtacctataataaaccctttggctttgacggtctatggtcctttgtttgggttttctgggctgcgcccgggaggattgaaaggagggctgtggtggctgtaggggtgggtgcggggtggggagaggggcacgggggtaccgtggctgcggagaacatccagatgtacccttttatgtggacttaatttcggggtctaaacacacgccccttgacgagaacctagagggatggagaatatttcgttatgcttcgtaataaacttccccaaaggagactccgggtccgccccgtcaagttcaggaaaggcggacccctttaaggaggcggaaaagttaaccgcgatgggcaggcgctctgtccaatcgctagtgactcctggagtctctggcccaatgagcagcctatggaggcggggtccgggtgcacacccggaagtgggtgcgggccagccggctcgcccgggggccatggcagcagcggctactgcagccgagggggtccccagtcgggggcctcccggggaagtcattcatctgaatgtgggaggcaagaggtgagtgtgggagactcctgaggtcccatcctcgggggcgggaagcggggtgggagtatccgcctctcctgggggaatccctgtccatcaagggttgctccgccccccccccctttggaggcgcgagattctggaaaaacgccgggggagggggaaggggagggaaccctggatcctgcgggagggggacgcattcctcacccgctcctcttcatctcttgcgtccgtttaccttccccgcccagattcagtacctctcgccagactctcacctggatcccagactccttcttctccaggtgatcgggagagcgagtttggggcgagggtaggagggatggagagggcgtgggagacctaatatccactcccccggcccgtgacgcctgctcggtgtcccttccctgcagtcttctgagcggacgcatctcgacgctgaaagatgagaccggagcagtgagtcggacaagaactgaaatgggatgggggggaggggttggtaggaagaggggcaggaccccactcagtcctgccttttaccccatccatcctctgcccccctttcccgcagatcttcatcgacagggaccctacagtcttcgcccccatcctcaacttcctgcgcaccaaagagttggatcccaggttggcatggaaaaaggggagggagtccctcactgtcttcagtccctgaggagttctttcacctcctctgaatgtccacgtgagctccattctattagaattctcattcagaaccttgatcacaggccgggcgcgccgggattgctcacgcctgtaatcccaacactttgggaggccgaggtgggaggatcacttgagcccaggatttggagactagcctgggcaacatagcgagaccccttctctaaaaaagcaaacaggcaaaacttcatgagaatcttgatcatgttaaaattttatgtccttcgatttctccctacacacacacacacacacacacacacacacacacacacacacactcaacatttcctccacccatatcatcactccttagcatctttattccatcaaaactttctaccccttgacattctctgtgcagttttgaaaattaccctctcagcattctctgttcacccccacacctagaccctgacctctagtcaattctactacccaggggtgtccacggttccagcctcctccatgaagcccagttctatgggctcactcctctgggtaagtgggagcccccagctatcatcctcattgtatagaaaaccaactctgtgatgctacctgcccctcttccccttctctcctgaaagagggctggggtagaggtgggaggactggttatggccctggccgggtctgtattcgtactgggaggagtattggtactctgtgtagaaagaaatggggagggggaaatggggtggcctcagcatctccctaagtcccagcctttaagtcctcctgttgcagttcgtcgcctgcagcttcgagaggagttggatcgatcttcttgtggaaacgtcctcttcaatggttacctgccgccaccaggtaggcactcccaatggaatggaggggcgcggaggtgggccaaagactacatttcccataaggctgcagctctcgggtgcctgtgctgtgcgtcctgagatacagtgggaggtgtagttccctatcagatgcttgggctgatgcttggaaaggaagttggacacagcatttcccatgagacaatgggccagctaactcttgaggctcagaaggatgtcctggagccccatgggagttgtagtccgggtttggtttctttgtagggggggctttggaagacctgggattcttcgtatggaggggagaaatattaataggaagttattgacagtaatgcccatgatagccagcccactggccatggaaggtatgccccagtggttattggaactaggcttttctgattggtagaagtaacagagtagggaaatttcatctacagctttatttccctaactgcagtcagcacctgctaccttcatgaaagttgccagatataaagatctgtagtagtacttttccaacttagttttatcctgttttccgaaaaacaatcatttatttatttatttatttatttaattttatgagacagggtctggctttgtcacccaggctggagtgcagtggtgcgatcttggctcactgcaacctctgcctctcagattcaagccatccttccacctcagctctgccactgagtagctgagactacaagcactcgccaccatgcccggctaattaaaaaaataataatcattttaaatgcaagctttatattataaatacaaagtaaacatgaaaataaaacccaaacatagcagtgttattaaactctggcctgtagcagtggctcacacctgtaatcctagcagtttggaggccgagacaggtggattacttgagacctggagtttgagaccagcccaggtgacacagcaagacctcatctctactaaaaataaaaaaaaattagccaggtgtggtggtatgcacctgtggtcccagctacttaggatgctggagtgcgaggatcgcttgagcccaggaggtcaaggctgcagtgaactatgatcactcattacaccccagcctgggtgacagagcgagatgctgtctcaaaacaaaacaaaacgaaaaacaactctggctagatgctattgcttgccaagggtgcagtcttccatttattaaaagtgaaaattagggccaggcacattggctcatgcctgtaatcccagcactttgggaggctgaggtgggtggatcacctgaggtcaggagttcgagaccagcctggccaacatggtgaaaccttatctctgccaaaaatataaaagattagccatgtgtcgtggtgggtgcttgtaatctcagctacttgggaggctgaggcaggagaatcacttgaacccaggaggcagaggttgcagtgagccaagattgtgccattgcactccagcctgtgcaacgagcgaaactccaactcaaaaaaaaaaaaaaaaaaaaaaacggaaaattaggtaatactgcagattcattaatatcacagcagcactaaactcagtcttcctctgtgctgggctcaagggaactgaaagggaagtaacttgctatgtggttcagtgtcatttcatgctgtgtcactgcaccacttaaaatcttcacccggagactatgtcccacacatggggaaatcaatcaccgtcatattttaagtgcttgctgtgtgacagccacgattacaatgactgttactctacctcttattctcactgtagtgttcccagtgaagcggcggaaccggcacagcctagtggggcctcagcagctaggaggacggccagcccctgtccgacggagcaacacgatgccccccaaccttggcaatgcagggctgctgggccgaatgctggatgagaaaacccctccctcaccctcaggtacgtttctatctcgtggaaggttggggcagctgtggggtccctgtgaccctcttctgatccctactcttcccctcaaggacaacctgaggagccggggatggtgcgcctggtgtgtggacaccataattggatcgctgtggcctatacccagtttctagtctgctacaggtgcttggggagggagtggcaggaggtcccagccctgttgatgggaagggcatgcggtgagggttggtgatgtcccctcgatcctacaggttgaaggaagcctctggctggcagctggtgttttccagcccccgcctggactggcccatcgaacgactggcgctcacagcccgggtgcatggtggggctttgggtgaacatgacaagatggtggcagcagccaccggcagcgagatcctgctatgggctctgcaggcggaaggcggtggctccgagataggtatgaccccaagccttttccagaaccctctgtcctttaaattctactgcctgttaaaatgacccaccccataaaatcctcaaacccataagaattctctgctctattagatctgtttgtgtcattagaatgctccagcccttcagaattctgtatcctgttagaattccctggcttcctagaaaaatccacccacatacaattctccctccatcagaattccctgccctgttagatctcttggttttgttagaatgcgctattctgtgtggccatgagaaatgtctgacttggcccggtgcggtggctcatgcttgtaatcccagcactttgggaggctgaggcgggcagatcacttgaggtcaggagttcgagacccccttggccaacagggtgaaacccagtctttatttcaaaaatacaaaaaaattagctgggtgtggtggcacgtgcctgtaatcccagctactcaggaggttaaggcaggagaatcactggaacctgggaggcagatgttgcagtgagctgagatcgcaccactgcattccagcctgagcgacagagtggacagagtgagacaccatctcaaaaaaaaaaaaaaaacaaaaaaagaaatctctgacttatggctgggcacagtaactcacatctgtagttccagcactttgggaggccatggcaggaggattgcttgaggccaggagttcgaggctgccgtgagctatgtaagccatgattgcaccactgcactccagcctggacaacagagcaagaccctgtctcaaagccacagcaacaaatctcggacttattaatctgtccccaaataaatctcagccctcgtaagaatcccctgccaccagtggaggtttttttgccttattgcaaatctcagtgctgttagaattccagaccgttttagaatcccataccccatcagaaatcttctggcccattttatcttctctaattcctgctggaatcttcactttttttttttttgaaatggagtcattctctgttgcccagattggagtacagtggtatgatctcggctcactgcaacctctgcctcctggggtcacgcaattctccttcctcaacctcccaagtagctggggctacagttgtgtgctaccacactcagctaatttttatattttttagtagagatggagtttcatcatgttggccaggctggtctcaaactcctggcctcaaatgatccgcccacctgagcctctcaaagtgttgggattacaggtgtgagccactgtgcccagcccctgatggaatcttctatccttcaaggattctgtggtcccactgaaccctctggtccttggagttcttcctcccacctctcctcctccatgaggcagggttccagctgagccctttttgcccactgcaggggtctttcatctgggggtgcctgtggaggccttgttcttcgtcgggaaccagctcattgctacaagccacacagggcgcatcggggtgtggaatgccgtcaccaagcactggcaggtcagagttctggccagcctggctgcccccttcccagttttccagactgtacagacccaggaaggggttcacgtctgcccccacccccaccccctaagcctggaggaagccagagaaccagcagctggccagagcctggggatgtctgtgataaaggcctaaggagcaccagggaagccttcctggaggaggtgctgcagagcccacatgaagcatgaatgggtttgaaaaggagtagggaggattgtcttgggactgggtgagagagcaggttaggggggatgctgtagaagacaagaactggcttggctcggtggctcacacttgtaatcccagcactttgggaggctgaggtgggaggatggctttgggagaaagacagacagaggcagagaaagagacagagaggcagaaaaccaggcaaatagaaatagaaaatcagaaagaggtgacagagaagggtagacagagtcaaaccagactgaaccactgtggcagatgggggaactcagagagataaatggagatgaattagagtcatgtcagaagtacatagtggaggccgggtgcagtgactcccgcccgtaatcccagcactttgggaggccgaggcaagaggatggcttgagcccaggagtttgacgccagcctgggaaacataataagactctgtctctacaaaaaatttaaaaaattaaaactttaaaaagtacagagtccaggagaggccaagagtcagacagacagatgcatcaaagggaggaagggagggaacaagacagggacaaaggcaggcctggggtggacggggctggggagcagtgggtgggttctggaggtggaggagagggcccatcctctgtgaggggtcaccacggaaggaaaggaatggaagggctcccggctgcagcctgtcctgccccacccccaggtccaggaggtgcagcccatcaccagttatgacgcggcaggctccttcctcctcctgggctgcaacaacggctccatttactacgtgggtgagcagcagcctgtgtcccgggtgcccgagaccctcccctgggagaggggaagggagggagagaggctggggcacttggaacaaacccgctccaccctccctgcccaccccagatgtgcagaagttccccttgcgcatgaaagacaacgacctccttgtcagcgagctctatcgggacccagcggaggatggggtcaccgccctcagtgtctacctcacccccaagaccagtaagctatgacccggcttcccctgctgctgtcacctgccagccccagccccagcctgcagctgtcccccaacttgtgtagcatgacccagaggggtttatcgaggggcggcagattcaactctctctcatttttttttctgagacagactctcattctgttgcccaggctggagtgcagtggtgcaatcttggctcactgcaacctccacctcctgagttcaagcgattctcctgcctcagcctcccaagtagctaggattacaggcgcccactgccacgcctggctaatttttgtagttttagtagagatggggtttcaccatgttggccaggctggtcttgaactcctgacctcagatgatcctcccgcctcagccccccaaagtactgggattacagacgtgagccaccgcgcccagccagattcaactctcatccagtcattcaacaaatatttactgagtatccctgtatataagcacgttctaggtgctagatggtggccaccctctccactaggggcagaatggaccattaggagttaatctttgtgtttctttcccacctttgtgattaaggcatgatgttcacatgttcataaaacaacacagatgcaggttttacagcagatgaacctgagttctcttacttgagacagttttttgttttgttttcttgacatcaaatgcagaatgggttaatttttgagacgtaattctcataccataaaatttcccatttgaacgtgcacaattcagcggattttagtatattcacaaggttgtacaactatcaccatgaacaaattccagagtatgttcatcacccccgtaagaaaccccctgatctttagcagtaactccacatttctcacttctgataccctctagaaatcactaatatgctttctctttttgtttgagacaaggtctcgctctgctgcccaggctggagtgcagtggcatgatctcagctcactgcaatctctgcctcttgggttcaagcgattctcatgcctcagcttcctgagtaggggaggattacaggtgtgcatcaccatgcctggctaatttttctactttaagtagagactgggttacgccacgttggccaggctcaatatgcttcctatacctatggatttgcctgttctggacaattcctgtaaatgggatcatacattatatggtcttttgtgtctgcatttttcacttagcatatttttttaaatggttagtgttttctgggtcttaagatatccttacctattctaggttacaaagatcttctcctgaatttcttctagaagatttacagtttagtttttacatggaagtctgttctatcagaaattaaattttatgtatggtgtgaagcagggattattcttttttaaaaaaaaatagagacagggtcttgctctgttgcccaggctagagtgcagtggcatgatgtgagttctctgccacctccgccactcgggctcaagcgattcttctacctcaacctcctgaacagcagaaccacaggcatgcatcaccacacctgtctaatttttgtatttttttgtagagacagggttttgccatgttgcccaggctactcttgaactcctgggctcaagtgatcctcacactttggcctccaaagtgctggaaatacagacttgagtcactgtgcttggccatagctgctgctgctgcttttcttttttttttaaagcagaaataagttaataatacacctaacttcatgacacattatcacctttcttctttgtaaggcccttttcttatttcttttttttctttctttctttttttttttttttgtcttttcctgagacagagtatcgctctgtcattcaacccaggctggagtgcaatggcgcaatctcagctcactacaacctctgcctcctgggttcaagcaattctccagactcagcctcccaagtagctgggattacgggtgcctgccaccatgcccagctaatttttgtgtttttagtagaggcagggttttgccacgttggctaagcaagttttgaactcctgggattctcctctcgtcgtctcccaaagtgctggaattacaggcatgggctgctgcacccggcctctttcttatttcacttacttactcatttcctcctcatctcccttcccgccacatgccactattatgtcatttttctttgttttttgagacagtctcgcttcgtcacctaggctggagtgcagtggcgcaatcatagctcactgcagcctcaccccctgggctcaagtgatcctcctacttcagcctcttgagtagctgggatcataggtgaatgccatcacacccaactagttttttaaaaatcttttgtagagatgagggtctcactatgttgcccaggctggcctcaaacgcctggcctcaagcaatcttcctgcctcggcctctgttctctgttttactttctctttcctctcttatttgctgtttcactgttacaatttctgtctctgggcctctcctcctttgacctgtgcctttgtctccctgttcctccatttcccacatctcatcaccatctttttgtgtccttccctctctccttgctttctgactgtgtctctgttctgtgtctctttctttctttctttctttttttttttttgagacagagtcacattctgtcatgcaggctggagtgcagtggcgtggtcttggctcattgcaacctctgcctcctgggttcaagcaattctcatgcctcagccttctgagtagctgggattacaggtgcgtactaccaccaccagctaatttttgtatttttactagagacagggtttcagcacgttggccaggctggtcttgaacgcctgacctcaagcgatccacccgcctcagcttcccaaagtgatgggattacggcgtgagccaccgtgcccggcctctccttgctttctgactgtgtctctgttctgtgcctgtttctttctccctgccctggtttctgtctctgtggcccaggccctctcctcatccttggcccctcaccaggtgacagtgggaactggatcgagatcgcctatggcaccagctcagggggcgtgcgggtcatcgtgcagcacccggagactgtgggctcggggcctcagctcttccagaccttcactgtgcaccgcagccctgtcaccaagatcatgctgtcggagaagcacctcatctcaggtgagcctctgtggggtgctccagtgctgggagagacagctcagatgggagtgtggagacaggaggatgagaatttccactggggagggacattgtgtaggaagagagctctggcggagaggattgacctgggatgggactgtaattgcagaagtgagagaataccataggggatcagtctggggaagagtgaatctgtgtgtgtttgggaatccatcaattcagcaacgatttacggggcacccaccatgtgccaggcataggggatacagtgatgaacaagacaggccaagtccctgccctcgtggagctgacattctagcagcgatggcagacaataaatctataaaaatggacatcaatggccagctgcggtggctcacacctataatcccagaactttgggaggccaaggcgggtagattacttgaggtcaggagttcgagaccagcctggccaacatggtgaaaccccacctctaccaaaaatataaaaaattagccaggtgtggtggcacgtgcctgtaatccccgctactcgggaggccgagggaggagaattgcttgaacctgggaggcggagattgcagagagcccagatcatgctactgcactccagcctaggcaacagagcgagactccatctcaaaaataaatagataaaaatgcaaatcaggctgggcactgtggctcatgcctataatcccagcactttgggaggccaaggtgggaggattgcttgaggctaggagtgtgagaccaacctggacaacaaagtgagacattgtttctacaaaaaatttttaaaaaattagccaagtatggtggcatgcacctggggtcccagcttcttgggaggctgaggtggagggatcacttgagcccaagagtcaggggctgcaatcagctatgattgcacccctgcactccagcccaggcaacaaagcaagactctatctcataaaatattaataaaataatctaaatcaacaccaggcaatgataagggctatgaataaacatgaagctgtgtgtggctagagagtgtcaagtcgctggagaggggtcattcagggaaggcctgaggaaggacctttgagcagaaataacagaatgagcagtgcagattggtagggacaagcattcaggccgagggaacaggcattgcaaaggctctgaggtgagaggatgcctgaggaagtgcagggagccacttgtgcctggaacagagtaaatgagggggagaatgggaggagatgagggtatggaggtgacaagggcaggagccacagagggctccgagcaggggagggacatgactagcttcaggtgttcacaggctccacctggctgcccgtgggagcacactactgggataggacaggagcagggacctctgggaggggcgtgctgatacggtccaggcaggtgacgaaatggaccaggaccggtgtggggcagaggatagggcaaggtgagatcaggctctggaacagttttggaggcagaggcaacagggtttttaacatttggaattctggggaggaaaggattctctgaaagggaagaactcagcaagggctgaccctcctgaaacggggctgtcctgaggctctggacgggcaggcagcattgatgcctgcaccaggcctgacttcctgctctccttgtgcccctcagtctgtgccgacaacaaccacgtgcggacatggtctgtgactcgcttccgcggcatgatttccacccagcccggctccaccccactcgcttcctttaagatcctggctctggagtcggcagatgggcatggcggctgcagtgctggcaatgacattggtgcctactggctcctggccttcccaccccactgacccccttacctgacccctgttgacctccgctgattcccacttgcggccacctgacccaggagcctgcaacgattggggtgtcctgatccttgaggcacctgagctccactgactgccacaaccccccagccctctctggccctgcccaactctaacaacctggggatgggactggggtcttggggtggtgggtttcatcagtggggaaggaagtctgaggctgagggaatcccagctggccctgacccctgcccctgcctggcccaggcccctacggtgagcgggacgaccagcaagtgttcatccagaaggtggtgcccagtgccagccagctcttcgtgcgtctctcatctactgggcagcggtgaggacagtcctgtccaacagggagggaggacagtcctgtccaacagggagggaggtcaggggagaaggcaagatgctagccagatcactgaggccagaaaggggtcccagccaaggagcattgaaggagcaaaggctgggagggaggacaggcctggtaggtttgtcttctggtatcaaaggtgtgacaggtgttggtgggactgacctggcgcagtgccagcccagtgcaggcagggccaggttgaaggcacagggggtggggtcagggtgggatggggggcccaggcggagggggaggggtgggatgggggcccagggggagaggtcggggtgggatggggggaccagggggaggggttggggtgggatagggggaccaggggcaggggtcgggatgggatggaggagacccagggagctgtaggagccttgcttcagctgggaaaggggcctcggaggatgttctggatgaagggactctgagcagagacctagaggacaagtaggaaggagcagaagaaagaaggcaggggaagggggccccagcctgagggaactgtatgtgcagaggctgagaagggccaaatagggtcacatgggaaggacacgtgggctcctgggctggagcacagaacaggaggtgaggatggggtgcagatgcgggcgggccttgtcaggctgtggaagggctgaggctttgtcctgtgcggggagccgtggccactgcatgggggatgaaaggaggcttgatgggaggccaggagcccagggaggaggccaggaggctgataggaggtgggggagcagctgggacgggcctcaggtcttccctgcagtgggagcagggaagagcagaagctctgggagactccctgggtgtttggggctgcggtgtccaagagctgctggacccttgggactggaactcaaaagcaggctagggatggataaagattgggatggcccctggagaggcaggaactgcagccacagtggtggggactgggacgaggaagggtgagaaagcgagggtgaccacctcccccactgcaccccccagggtgtgctccgtgcgctccgtggacggctcacccacgacagccttcacagtgctggagtgcgagggctcccggcggctcggctctcggccccggcgctacctgctcactggccaggccaacggcagcttggccatgtgggacctaaccaccgccatggacggcctcggccaggcccctggtactccctgccccaccccaatcccgtcccaagccccacagcctcacccagaaccactctccactgccaactgcttgatctctctcccaggcccttgccctctgaccccttttcctttgaccccctctctgctccccatcccttcctgcccttgtttttcaacccctgtctcagcctctggcccccatgcattgatctctgcttcctctctcctgtcctgaccctcggtgcttgcactgcaatgcaacccaggcccttgccctatgacccctgtcttgccccctgaccctgcttccgtgccccccagcaggtggcctgacggagcaagagctgatggaacagctggaacactgtgagctggccccgccggctccttcagctccctcatggggctgtctccccagcccctcaccccgcatctccctcaccaggtagccacaactccactgccccttctgtgcaatgaggggagaggggacagcatggtgttcccggggacagagtggcccagctgccccgtgatgacgtgcacttactgtccttacttcctcagcctccactcagcctccagcaacacctccttgtctggccaccgtgggagcccaagccccccgcaggctgaggcccggcgccgtggtgggggcagctttgtggaacgctgccaggaactggtgcggagtgggccagacctccgacggccacccacaccagccccgtggccctccagcggtctcggcactcccctcacacctcccaagatgaagctcaatgaaacttccttttgaacaacgcagctgccatgatgccttgggatgccctggtcctgggggactcaggtgcctccctgattcctgtgggaaccccgggttcagggccagggcctccttggaataaatggttattgttactaggtccccaccttccctcttttctggaagccaaagtcaccctccccaataaagtcctcactgccaacatcttgcttattcttagcaggtttgggactccccaggaaaggggtggggaagatgtgggacccaacccgatatatgcaaaatcaggaacatctacctctcttgtttaagcaaagggaggccaggcatggtggctcacatctataatcctggcactttgggaggccagtttgcttgtgctcagaagtttcagactagcctgggcaacataacaaaaccccatctctacaaaaaaatacaaaaattaagcaggcatggtggtgcatgcctgtggtcccagcttcttgggaggctgaggtgggaggatcgcttgagcctaggaggccaaggctacagtgagccatgatcacaccactgcactccagcctgagtgacagagtgagatcctgtctcaaaaacaaaacaaaacaaaaaaggtgttgcaggggaggaatgtgttggcttttactctgccttcaggcatggctggatccggggcttcaaacactaattcagaatatctttttttcttttttcttttcttttttaaagtctcactctgtcatccaggctggagtgtagtggtatgatctcagctcactgcaacctccacctcccgggttcaagcaatcgcaatcctcctgcatcagcctcccgagtagctgggattacaggtgtgcaccaccatgcccagctaatttttttatttttagtagagacagagtttcaccatattggccaggctggtctcgaactcctgacctcaggtgatctgcccacctcagcctcccaaagtgctgggattacaggcgagagccactgtgtccggcccagaatatctttttatctcctaacttcacttacctctggaatacatcttcaatcaggttttctctctgtggcaaggtgactctaagcagctgcttagcaactctttcttccctagcaacagcaaaaatcacaagactgattttcattggcttgaattaagtcaggtggccattcctgaaccaattactgtggccagtgtgatgaaggccttccattattgcagcctggatcatgtgtcctgctgtatttttagtagaggcagggtttcaccatgttggccaggctggtctcaaactcctgacctcagatgatccacctaactcggcctcccagagtgctgggattacaggcgtgagccacctttcctggctggccttgggattttttttccccaaataatgcccgttcctacggcacttccttgaggagattttctgcatcttttttccttgtgccaataaaaaagggacagaaagtggggacagactaggagtagagaatactagaacatgctaattctagaattccatagtttctggaatgccagagcttctgaaacatagtagagaggggtctcgaacattaggacatctcggacacaaggatattctggagtgctcatggattaacaatattagagttctcccctgcttatcagagaatccagaatatagaagtttctgacaaaaaggacctgaaaaatcactgattctagaataggggagtgtcaaggggagttcatacccatgaatctccaccggtaggaatatcttgcatgccaggatgtctggaatgctgagaattataggatacagaaaggaacctggattactaggaaatctagagaatgggagagatcctggactatccgcccttccagagcactggaaggtttgtttgcgttccaagaaatccataatggcaggagattccggattatcagagaatctggaacacaaatgggagacgtaaaaggtgagtgcctctgaaaccggggtgttctgaaatagctgtgcacctcaaaccctaattttgtttttgtttgtttgtttttgagacagggtcttgctttgttgcccgggctagggtgcagtggtgcaatcatggctcactgcagcctcggccttctgggctcaagtgatcctcctgcctcagcctcctgagtatttgggactacaggtgtgtgccaccacagccagctactttttaagtttttttgtagagacattgtctcactatgttgcccaggctggtctcaaactcctgggctcaagccattctcctgccttagcctcccaaagtgctgggattacaggtgtgagctaccatgcccagcctcacactctagaaaattttttacatgccaggatattcagaatattgggggatattggcatgttaggaaatctagtatgtagggggagggcctggaaggtcaggaaatctagaatatggtggtgttttgtaatgctcacagatctagaatattagagtcatttttttttccaggccggagaatccagaacgctcgtgttgctgaaatgctggtcattctattcttatttcatgtttaaatttttattattttctttatttcttttttttgagacagggtctttctctgttgcccgggttggagtgcagtggtgtgatctcagctcacctcaacctctgcctcccgggttcaagtgatcctcccaccttagcctcttgagtagccgggattacaggcgtgcgccaccatgcctggataatttttgtattcttagtagagacagggtttcactgtgttggccaggctggcctgaaactcctgacctcaagtgatctgccctcccacctcggcctcccaaagtgctgggattacagacgtgagccggccttattctgggggagggggtggggggggagagagagagagggagagagagaggagaatttgggatgttagcaaatctagaacactgaagagctgggttttttaaatgctagagatagtattatcctagtatagtattaactctgtgtgtttttgtgcgtgagagggcatggggggaggggtggaagattctggaatgcggggggactagaactctgagggattctgaagggttgagatgagttaggattcaagaggtgacatagacacgatcctgggagatagtgacactgatgggagggatggggagctggggactccaaattctagggggaggggaggctaacgccggaagttgcagtggtgagccagaggatgttgcctagcaacaagcattgaagatgcgctggatcccggacagaagggagaaatttcagcagcgcccccagcaaatgctccagccacagggtaggaggtggtgaggggggaagcgggtagggatatgctgtcctgcagggtcatgtgagcaggggtcttgggggttatacaaaaacagggtcatggagtacagtcatggggcagagccgggctctgggacagcccacgaatagctgtgaatggagtgtgagtgccgtcgtcacctgccccagggactgtgtgtccctggacggtgctggacccagatttctgggtgtcagtgtgggatggaggcatggattgctgtaggtggcagtaatggtgtgtagccgtgtgagtcagcctgtgtgtctcacagtgagcgggggtgaagggcttccccgtcagtcctgcacaccctcctggattggaagaaggagcaggagtggggggtggggggtgcaactggatcagttgccattcttggtctggggtgggctctgtggtcacggcgtgtggcctagtaccctgtgtgggtggagcctgggatccacgaggtgggggcggggctaacgctacagaactgggaagcttaagaatccaactgctttgggatatggggcctggaaccccaaagcgaagcaaacatgaaaggggtgggcttgggatcctacatgtggtcacgtcccagttttctgtgggaaagggtgtggcctgaaactctggaaaaagaggtgattaggggcagagtgaagctctgagggtggtgccttagggagagaaggggcttgtatttcagagaatatagggtggagccttgaatttataatgatcttctcaaagaattgatcccttctcaaggccctaggcttcaggggttccaggctcaccatctgcaaaagcttgctccccgaagctctgtccctcagtgaacccagccaggctctgcccctgacccacaggatctgctcccagggggtcctgggggctcctggctctgccccctcctgcacctcacttattgccatccccagagggtatcagacccccttccttgcctgagtctttgaatgctcccaagagctttgagtctcaagctgggcttgagaccctgagtttgaaggcttgaagcctggaaccccggtgtggacggggtttaagggcccctgtggcttgcagctcctagtggtggagactcttaggcaaggaagggatcggtactctcttttatatagttttatgtatttatttattattgagatagggtctcactctatcgtccaggctggagtgcagtgcagtgcagtggtgccatctcaactcactgcagcctccacttaccaggctcaagtgatcctcctacctcatcctcccgagtagctgggactactggctcatgccaccatacccggctaatttttggatttttttttttttttttttttttttttttttttgagacagagtcttgctctgtcgcccaggctagagtgcagtggtgtgatcttggctcactgcaacctccacctcctgggttcaaacgattctcctgcctcagcctcccgagtcgctgggattacaggcgcccaccactgcacccagctaatttttgtattttttagtagagatggggtttcaccatcttggccaggctggtctcgaactcctgacctcatgatccacccgcctcggcctcccaaagtgctgggattacaggcatgagccaccgcgcccggcctaatttttggatttttaatagagatggggtcctatgttgtactatgttgctcaggctcacctcaaactcctggactcaagcgatccacctcggccttccaaagtgctgggattacaggcccgcgccagggcacctagccggaactgggaactctctaaggagaaagtctgcaattctgggtggtgggaggctgctcttgggagcattcaaagactcaggcaaggaagggggtctgataccctctgggggcggcgataagtggggtgcaggagggggcagagccaggagcaccctgggagcagagtttgtggatcaggggcagagcctggctgggttcactgagggacagagcttcggggagcaagcttttgcagatggtgagcctggaatccctgaagcccagggtcttgagaagagatcaattctttgagaagatccaatgtgaacttgggaccctcagaggggcaggacctgggggctggtgcagggttggtgctccatttgcagaatcctcagtctctctcgtggaaaggggtacccgtggggggcttccagcttctacgccagcgagggagctaaattctgaccgaattctcccagaactgggagcagagagctgaggactgccagatggagtccagcttaggggaccctgcccccaaccccgctcccgtatccctcccatttttaagcacccctacgcctgggacctctgttccacgagaaggttcacggagccagtatccgagtcctaatttccccccaccgcgtggggaactcgaggtcccccgcgcccctagtccggcacctgtccctgctgcctcctgattggccgcgcggcgagcgctggcggcgccgggctgtgattggcgggaagttcgcagcccgtggctggactgtggagaaagtgagtcggcctcgggcgggggcgggggcgggggcaggggcggggccggggctagcctgacccgctggacagaccgcccgcccggagcgggactcggcgcccgacacgatgccgaggcctggcaccagcggccgccgccccctcctgctggtgctgttgctgccgctcttcgcagccgccacctccgccgccagccccagccccagccccagccaggtcgtcgaggtcccgggggtccccagccgcccggccaggtaagccccctgcttccttgtgccccttccacccaataagtctggtggtccaggaggaccacggctttcggattcaggggaaactcgaacccactgcttcgatgtggagatgcaaagagggcccttggatttattaggcgccctcaatttgtaggggttagattcggggagtactgagatttttaggggaaagagtcccctttattgtggtggagaaggctaagtctccagagaatcctggggttagttcggggaaaggtctctagtttattggggcagggggtggggggctgagctctcctagaatgatagagacgtgtggggtcttcgagctaggatggagcgccccaagtttcttgggcgcgtaaggaggaaaggtgttgggggattctggagggactttatgaggccgctgagttgtcctggttttctaggatttgggggctctgtgttcatgaaaagcgacctttgggtttttcgaattggtcaggaagacatagactcttgcgttgatggtggaggggcttgtggggagtggggtcgggtgggggagtcctcaggcttcagaacggttggggatgctcaagtttcctagaattagaggactctgggattgaatgaggctccagtgatttcaccgcgagagatccaggattccctatagatctgggggctataggcgcccttcctgtctgcgggtgacgggactgaaggaagccgtctgcccagcacccccacccaccctccccgcctggcggcccagcgctccgttacaaaggccccgggctcctctcccgcctgggtctctgcgaatgcgtttagtaacccgagccgcggcgggggcggggccgggaaggggttaacctggagaaaaggcgggagggatgacggcaagatcggggatccccgaggctccccaccagatggcctcatcctccactcggccccacccacctgagaggggcccacgcgctggacacccccctctctgcacccccccactgctctcctctcggggtctgggcgcgcgccctcgtctctagacccccttagcctggggataatggacttgtctggggggccccttcattgcgacgcacttgaaccggagctggaagctccgccactgagaccctctgggctgggagatgtctgcaagaacggcacctttctcctggtcaggcgggaaactgaggcccaaagaccaagaaacgctggcttctggacacacatcgtggaagggcaagaacgggctagaactcaggctctgggattctcagtcctggactgtgactcccgttatccccctccacctcagcaccctgctggacccacagtcagagggaagagccttccctccccagctgccgaggcctgtgaaaatggcgccacctgtcggccaggctcaggatggcgtctgagtcccggaccgggatgtgcgggagggcggggttctagattcccagacagtgcgggcttagaaatgctcttagaaatcgagtcttttgtttttgtttttgttttttaatcacttttaaaaggctttaaaataacgtattttttcaataaaatcgtacgccaaaatctcttcataagacaaaagtacggtttctgtgcccttcagcccgaagtctaagccaatttgcctcccattgtacagatggagaaactgaggcgtggggagaagaacctcgttagtcatatacctgtttcaagccccctcaggatgcgtcttggtttcccctccccgattgccctcctttgcagagttctggggtgctaggggcctgagtgacttccactccactatttatagcgttgctgtttgtcgctgctgcccgggccagacgtctaggaggagccgctgcatccgaggtgggttctggaagatggagtatgagtagggggcaaaagggaataggaggagaggggcagggagctccccatccctcccctcatcccagtgggagagctggatgcatttggtagagaagtacttggtcccctccttccccacttagtccctggctgtctccgaagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgtgagtgggcagtccctcccctaccaaatcctccctcaggaactcctagctttgcccccgtttccgctcctcctcccttcccctctccctctctctcccccctccctccccggctctttcttttgctatcagcctgtctgtccgtttctatttcatcccttgcctgcctatctcaggctcttcccatctctgcattatttctgtctctttctgtttctttctagttacctgtctcttttcctctctctctttctccctgtgtctcactgcctgcctctatgtctaagtctctctgccccttctctctttctctcccccaacccccatcatctctctttctctcagggtctttgtttctctcccactagaggcctggtccccataaataggtgttgtggggggagggttgggcagagccgctactgaaagacattttcctggcatggaggccctttggtggggaggtcagtttaacccggtgacagcagcttttccgtcctctcccacccaggctccaggaggccagagctctactgaagcggcggcggccccgggggccagggggccggggactactgagaaggaggcccccacagcgtgcccccgctggcaaggccccgggtaagcacatccgcctttcctccgcctggggcgaggggggttccgggccagataaagccgtctggttcccacggtccagccgccgcctacccgccccccgttgtagctcagcacccacccccaggacgaggccccctctagggaccccagcgtccggccgtgcgaggtgagcccgggacaggaccagacacaggccagaggcactgacccgcgggggtggggccgggaagccaggcgtccgggctccccgcggccgaagagggagggcgctggcccgttagaaagctccgccgaaccagcccagacaacaaaagcgattgtgcgggttggcgcctgcctgggcaccaaatgctcaagattgtggggcggctgggggccaaaggcctcctcctgtttcccgaatcttccccctgccctcctcccgctccagctcttgacccctagtctagaacacccctcatctcaaacaccctcaaaaccctcctcttgctgtagccttcagcccagatgtgacccctccccctaaagtcttccagatgtgagcctcgggccagatgttagtacccccgcccacagcctccctttatccattgtgacttctcccgccaggtgtggcgttctggccagatgtggctacatcttcacatgtatcccccccacctccagcctcctgcccaggatctagacgcccaattcctttatgtgcccaggtgtagcgacccttctcccatccctcagatgtcccacctggctgtccagatgtaccatgatagccccctatcaagatgaagcccctttctctgtgccccgggcagaagaggatcaactcttagctgtctccccaaatgtggcccccactactcttaatggatttcctctttatggattcagctctgtctggggggaaacccgcccgcccccacctgttcccttccccgccgctcccctacaggcccggtccacttgttggtgcgcggatggggacagagggggcgccccgctcacccctgcgagtctagcgcccagcctgcgagcctctggctaagcgcccagccccacgcgcccccgcgcggccgccggggagggagtggtgaggagggggggcctgagcgggggcgcgggcgacctcccccgcgggcgggcgggcgggtgcggccgggcccctcgggcgggctggggcggcggcgcggcggagcgcggcgctgcagccatggcgggcggcgtgcggctgctctgggtgtcgctattggtgctgctggcgcagctagggccgcagcctggactgggccggctcggagagcgtctccgcgtgcgcttcaccccggtcgtgtgcggcctgcgctgcgtccatgggccgaccggctcccgctgtaccccgacctgcgcgccccgcaacgccaccagcgtggacagcggcgctcccggcggggcggccccggggggacccggcttccgcgcctgtgagtgcggggtggtggtcccgagagagcggctccgggggggaggaggatccctggggatggaggagacagtcctccagggagagggagcccagattccatatgcaatagtgcaagggaatatcaggggctatttgaggaagggggccccaaattcctggcttttggggttgggtcctgagggttccgattttgcaagcaatgagggttcttagaggcctgtgatgtcccacgtgagggaattggcgccagctttcatgctttgcgtcaaaatggggatctcagaattgaggggcctgagaacttttgggaggggggctcgaattctgagacgctgagtaaggagtccccggggaccaagcaagagtctcaggaccgcatgggggacgtctcagtttctgtgtgtttgggtgggaaggttctgtatgggaatgcctgtgaggtggggtactagagagaagaaagttaatccgaagaactaagagggagaggggacagagacgggggttgtgtgtgtgtgtgtgtgtgtgtgtgtgtgtgtgtgtggcggcgggggtggggtgggggtgtctccgcaggacctgagttgcaggggtcccacgtgcgacagaaatccagataagagggcttacggaaggggcgccccctgggggcggaggggacaggaggtgtatgcaccaggcactcctagagatggggagccttgggggttcaggtgaggtgggggagggcgcaccacctgttgttccaggatgcaaaagtgggcagactctctgggatcgggccttcctgccccctaccccgcagaccctatggagtggggagtgggggcccctggagcggagaactcgcccagcctggcccccagccagcccagcccggccggcgtgagctcatctcccgcctgagcccccgcccgctgccactccctctctcctccccttcctccctctttctttcactctttcccggcccagccccaacgtgcctgtgccaggcgccatgcccaggcgggtgccaagcccttgggggtgcaaggagtggcatgtgaagtgggggctgacctcaaagggacccctatgtcctcaactccccgcttggccagggctgtggggcatgacgttggctgtggccatctagtggcccaccctgggtgtaggcacccccagggagctggcctgcgggcctgcattcaggccaagagaaggcagagaaatgcctctggagcctgggaaataccctcagacctggctggtttcccaccccctccatcagagacccttaccattctgcaattttgattcctagttaagcctctcctaggccccactactcaattaaaagcccccattagaccaccctggagtcatggccccacactcctacctaagggagctgagtttttgctccaggccctagacccgctctccaaccatggcaacagactttagagaccactcctccagtgaaattccctctcattcttccctcccacctcccaaactgtgcctttccccagataactctgtagtattgtccagaagtcctgttcttctagctcacccccttccccaggaacttctgatcccatttatcttcagagaaccccagggttggtcttgataagtgggttctcgcaagaggactccagacattgtgctccttacaggcagccattaataaaaagcctttggcacttaatccttagctgggaggggaggggattccacagagggactcggccaattgagcctcttaagtgctgatgacttccaggaattccacttcactatctaaaccctgttttcagcaccgtcaaactggttgtctcctaggcggcactagagtcctgttttctaggtaactgtccacaaaaggactcctgctgaaaggacgcctcagtttcctctgagctaggttcctccatcccagaaacctccagccgtctttgaactcgagaggactgccctttagtcgatctcctcccaggactccagtccctttatccttctaaacggaggtggctctctgcgtcctttcctctctacagttgtggctcagaatcccacacgcgcctcccccggccgcctgcctcctccctcccctccgcacagctgtctccagctgttctctgcagccccgggagagagagggagggggtgccctcgcaggacagcccggcctcctttggctcaaaggtcccggggctccccaagggtccggaatgtggagcctccgccctgcccccgccgcacctctctctttgtttaccccgccgcacagctggcagtgccccgcccagaggtggcctggggcccagcgagggcgcgcagaggggagtggaggcgcgttcccgctcgtggctccgccccggtgctactggaggctgtaaggccgagctagaactctaaagccccagccagaaagaagttgggcggagacacagcgcggtgggcggaactagggcacccggacagcctggaggtggggtgggaggggcgtgaacaagtgagccgggcgaatcagagtgcggaaaggaaggtgggaggggctagaggcagcaggttaagctcctggataggcggggtttagaatcccgcgggtagaaggtaatgtgagaggggctacaaagggggcacagccagggggcggaggtaggacttcgtggaccaagcagagggagtgtgggcgggcatagaatgcgaaggagacagagttgggcggggagttatgccagggagtggttaaaatgtggtttgagtcaatggaagggatcagcattgggtcggaggggctggaacagcaaagggttccgtcggactacggaatgggcggggtcagcgccgtctgggctggtctggaactccgtggactcagccagaaattgggatccgagaggttgacatgaaagtgaataaacagcctgagggctggctgggctcacgcctgtaatcccagcactttgggagactgaggcagaaggattgcctgagcccaggagttcaagaccagcctggccaacatagtgagaccccgcctctaccaaatttttaaaaaacgtagcccgatgtggtgcacgcctgtcgtctcagctacttaggaggctcagatgggaggatcacttcagcttaggaggtcgaggctgcagagccataatcacgctactgcattccagcctgggcaatagagcgagatcctgccgacttagtgggtgggaccgtacctctgatggctgaacaactggactgggccaatgctgatgccagaattggggcggggccacatgacagctaagggcggagcgacttagaaatgaatgataccttgagggagtagggaccccaggagaacctgccaggaatggtggcgcccctgagtgtcctcgttctcctcccagtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggtgaggaaagggtggccagagtcccctccgacccctgtcaagcatttcactttgcccctgaccctcatatttcccgccttcccgagcacctttgcccagctcgccctccccgccttgtctagccccaccccgtaagaacccgtgtagacatccgtttgcccggccgtgcctcccctaggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaagtgagaggaggcccgtggggaggggcccggagcttgcctccgcgcgggggcgcgctcacccaacacttccccgcagtgcgcgtccccgctgcccgggctccggacgcaggaggtctgctgccgaggggccggcttggcctggggcgttcacgactgtcagctgtgctccgagcgcctgggtaagccccaggacgtccccgaagtgctcggagctggggagtggtgacaacctcaccgttcctcctactctgccctagataaacccagttcacaaattgtagccacgcctaccccattgtggaggcgacttccagtcctgagcttttcataccgctctgggaccacccaccccattttctgactttggccactctgttctcaccctgcctttgtgccttggccccccaccatatactttgggagtctccaatgttgccatttcaactgccaacctaaggctgtccctgcacttaaactacagccaacatcttttagtccctcccaccccgtcttcgtctctgcccactccattctcgctctgcccacctgtccctggcccacccctctcctctcgccacagggaactccgaaagagtgagcgccccagatggaccttgtccaaccggctttgaaagagttaatgggtcctgcgaaggtgcaacggggcaggggtgggaggggcttggttctgggggcgggatttgcagggatcaagttcctgactccacggtgacctccccaaccctggcagatgtggatgagtgcgcgactggcgggcgctgccagcacggcgagtgtgcaaacacgcgcggcgggtacacgtgtgtgtgccccgacggctttctgctcgactcgtcccgcagcagctgcatctgtgagcaaccagcagggagctgaggctgggtcccgccctccctgccctcagaagtcccagagcatcctggggcctttaattccctcggacccccccagactcccgggttcctctgtcagccttagagccccctcagaacttctcagattcttatacagcttcagcatccctggaccacctttagacctttcaagccttttggatccagatccctccagactcccagacttttttttttggagatggagtctcgctctgtcgcccaggctggagtgcagtggcgcgatctcggctcactgcaatctctgcctcctggtttcaagtgattctcctgcctcggcctcccgagtagctagaactacaggcgggcaccaccatgcccggctaaatttttttgtatttttggtagagacagggtttcgccacgttggccaggctggcctcaaacccctggcttcaagtgatctgcccacctcagcctcccaaagtgctgggattacaggcgtaagccactgcgcccagctctcccagactttctggaatccttctcagacccccaaatcctctcgtccccctcaacgactcgactatcttcagatcttgagatccttctcagagtctctcattcaccactgacaccccattgaggctccaagcccttctcagacctccagagcccactgctctccttcagaccctctcagacctctcccaaatgcccctcgcacccaccaaccccccacccccaaccccagaaccattcccctctctcccaaatccctcagtgctacagcattcccagccccgccctgaaggatttcctccctgctcctcgcagcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcaggtgagcccctgcggcagtgcctagccctacgcgcaacacatgtggcgctcattctacgccccaccctccaaccctgagttcactgccccaacctgactggctgggctccagccttggccacgcagcagcctctgagacccgcaggcctcagactggacagcatccatggctccacctccatctgtagccacagccacccctccattcgtagccacagctaccccggagctcccaagttagtttttgtctcctgagcgtcaacgcccagtcccaccctgtccctgaactttgaccaagtccttggcttctgagacactgccttcagcttagccccaccccaggcatgcccctccctgagacacctccctggcattctatcttctgcttaaaactaaatctcacaagggagctatttcctagcctccaactctgtccctgtagacccaaccggaccctgccctcaaccctgttcctaccaccatcccaaatgtgggaaaacgctcttggccccacctgtagcctctaagacattctactctttggccaggacaccaccccatcccagcctccagctcaaacccctgacactctccagccaagccctgcccctagccaaggccagagtctgggctggccatcgttttcttcccgctctcttgtcctctctctgtctctcttacctattcccagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggtgagctggctctggcagaagtgggtgccatcttcaaggggctgccccagccccatagtgaaaggaggcaagagaggatttgggctccactcgttgataccccttctttatcaggctttctgcccacccatcgcctggagccccggcctgaaccccggcccgatccccggcccggccctgagcttcccttgcccagcatccctgcctggactggtcctgagattcctgaatcaggtttgctagaaagaactgagggcattgggcctgcagcagtggctcacgcctgtaatcccagcattttgggaggctgaggagggtggatcaccaggtcaggagttcgagaccagcctggccaacatggcgaaaccctgtctctactaaaactacaaaaattaactgggcgtggtggcagatgcctgtaatcccagctacttgggaggctgaggcaggagaatcacttgaacccaggaggcagaggttgcagtgagctgagatcgtgccattgcactccagcttgagcgacactccatctcaaaaaaaaaaaaaaaaaaagaattcagggcattgatgggggtattacaggtgggattctggggtaaaagactccaaggtgaagattccaggttacagcaaataggaatggtatgggcagagataagcgtttgaagggttgggtggtagttagatcaggagctggagtcacagttgggctcttctgtgtcaatcgagcaagccatttaacctctgagactcagttttctcattggtaaaatggggatggttgttgagatgcctctgaagtgtctgacacctagtaagtgctcagataaatacttatggtagataattatttttcattatctaatattagataattatttctcaggtagggcactaagaatgtatctcaggcggagggttggagagcaaactattcaaagccagagaccttggggtggcatgatgaggggattcggccaaggatctgatgagaacgttccaggataaaaaagatggagatcagaagaagactgggcttgcttggggaggagacatccatgaaggtgttttatggatgtctccgggggtgggggttttactgggatgaaaggaacggaggattcagagatgggggaaccctggctgactggaccccccaggtccctcctccggcatgtgtcagcgcaacccccaggtctgcggcccaggacgctgcatttcccggcccagcggctacacctgcgcttgcgactctggcttccggctcagcccccagggcacccgatgcattggtgagcaagacggagggcgcggaaggaggcggggcggggggctttgcctggtcaccttgtcaccagccccctccgtgtcctcagatgtggacgaatgtcgccgcgtgcccccgccctgtgctcccgggcgctgcgagaactcaccaggcagcttccgctgcgtgtgcggcccgggcttccgagccggcccacgggctgcggaatgcctgggtgagaaatttgccccacccggctccaggcccaccccagggtctcgctcctgctctcactccagagcctctccagccctcccacgcttcccctctcgggtcccgccccaggactgctctgccctggcccttggccctgcccttccctgacccgcctccacccagctccagcctccctttgaccccacccctacccagctcccaaactgccagtttctatcggggcctggtcgcaactcgtattgctccgcccccacgcccaggccccgcccttattggccacgcccctccctgactaactccctcccccaggccccgccactgtcctgcaactgcggcaaccaatctcctgaccgcgaccccgattccaaccctgccacaccagagccctatccccaaactgctcctttcttctctagcccctaccccaccttcccttagcttggtccccaaagctctcctttctgcccttgcgctaccaaaccctgccctccacaattgcctctctcactgtgcccctctccggctgtcctggccgggtccccatcctggctctggcccaagcttggtcccgctcccgcttccctctacccctgcctccttgcgtcgcttctcccggggctgtctgccccagtcccagccgcctggtctgtgcctacagatgtggacgagtgccaccgcgtgccgccgccgtgtgacctcgggcgctgcgagaacacgccaggcagcttcctgtgcgtgtgccccgccgggtaccaggctgcaccgcacggagccagctgccagggtgagggcctgggaggggcagctgggaaggggtgtgagcggttgggtagagcgcagtgatgagggccagagagactgaacaatagggcaaagcgagttgatttggagacagaggccaggctctcgagcagacgtgtggcctgatggcagtagagagagacctgggatgcagaggccaagtgatgggaaacagaaaggctgagtcatgaaagatggagaagcagaatgaggagggatggagatgtcagtaatcgggtaaggggagcagagttatggaggaaaggggagaaggaggccttctcatggggactacagagacagaaccagccaggcagcttagtagggattggtggaggatgcagagtcagatgatggtga

SEQ ID NO: 2463 - DNA, 56347 bp, Homo sapiens
gacctgaagcttcgctgttgggagttggcgcagcgctggaattggacgttgggtgggagaggtcctccttgctgtgtgctggagccctcgaatttggcaagtgggcgggccggaatggggggacacggctcagggatggttgagagggtggggccaggagcacctggatttgagtgtagtagtggggaccttgtcgggggagaaaagagtaggcgatgtctaggactggggtagagaagaatttactcaggacaggcaaggggctctttctactcagtgtctgggaggacagaaaagcctgtgctgagattggctatggcggtggggctggagacctcctggtgcagtggggtgatgttgcctcgtgtaggcggatgctgagctccaggcctggaccagggatggaatctgtaaggaggtacagagagagacctctgtccaagtgggctcagagattggggctagaggtgggatgcattggctggggacccaacctgggagtccagagtcccaccgaggttcctggataggaggggcgtgagactgagatagaaaccgggtgaggctgccgaggtgggcggatcacttgaggtcaggagttggagaccagcttggccaacatggtgaaaccctgtctctactaaaaataaaaaattagctgggcatggtggcacgtgcctgtagtcctagctactggggaggctgaggcaggagaatggcttgaacctgggtggcagaggttgcagtgagccgagatcgcgccactgcactccagcctggtgacagagcaagactccgtctcaaaaaaaaaaaaaaaaaaagaaaagaaaaaaaaagaaaggaaactgggtgaggctggatagaggtgagcttatccatttagggaagcggagctttccctgcatgctgaaatgcagggctttctgaacccaagacttgcagaaaacagagtcctggccaggtgtagtggctcacacctgtaatctcaacactgggaggctgaggcaggaggatcgtttgagcccaggagtttgagaacagagggaacatagtgagacctcatctctacaaagaaatcaaaaagttagccaggtgtagagtcacgtgcctgtggtcccacttgggaggctgcaatgggaggattgcttgagcatgggaggtggaggctgcagtgagttgtgatcacaccactgcactccagcctgagcaacagagcaagaccctgtctccaaaaaaaaagaaaaaagaaaagaaaacagagctctacctggggacacagccgtgtctgaagattccaaggaaacacagccctgtcctggggagggggtttaggggggtcacgctctgccccagaagtctcaggggtccatccctgcccctccatgtcccccttcagcgagcagatcagccggcggcagtctcaggtggaccgcctgtacgtggcgctcaaggagctgggtgaggagcgccgggtggctctggaacagcagtactggctgtaccagctcagccgccaggtgagcgagcttgagcactggattgccgagaaggaggtggtggctggctcacccgagctcggccaggactttgagcatgtctcggtgagcatcattagtaataagtgataccaggagctaccactaaggttctctgggccttagtttcctcatctgtagtatgaggataataacagcacccgcctcatggctctgctgtgagacaaatgagttaatataacgtaaagcactgaggaccctgcttggcacacatgctgcctcacacagtgttggttattattatcagcttattattttattgttacttattgttatttttattgttactgttttgttactattcttgccaggtgttcagtaagtgttagatattattttttatgatgatgatgatgatgatgattatcattactcttacctgccacaaaatggtagcctctgccaggtgtggtggctcatgcctgtaatcccaacactttgggaggccaaggcaggtggatcacttgaggtcaggagtatgagaccagcctggccaacatagtgaaaccccgtctctactaaaaacacaaaaaaatcagctgggtgtggtggcacatgcctgtagtcctagctgtttgggaggctgaggcaggagaattgcttgaactggggaggtgaaggttgctgtaagtggctattgaaccactgcacgccaacctgggcgacagagcaagactctgtatcaaaaagaaaaaaaaacattgtaggctggagggggctggtgtatgctgcccctttgctcactttgctgtacccccccccccacttcctgatggcaggtgctgcaggagaaattctcagagtttgccagcgagacaggtatggcagggcgggaacggctggcagctgtgaaccagatggtggatgagctgatcgagtgtggccatacagcagcggccaccatggccgagtggaaggacggactgaacgaggcctgggctgagctgctggagctcatgggcacacgggcccagctgctggccgcctctcgggagcttcataagttcttcagtgacgcccgagagcttcagggacagattgaggagaagcggaggcggctgccccgcctgaccaccccgcctgagccgagacccagtgccagttccatgcagcggaccctgagagcctttgagcatgacctgcagctcctcgtgtcccaggtggggcgccggtggccatcagggcaggtgggagggcctggacagctgtgggcagcagagtgggcaaaaatcaggctgtggagcaggtcgaaattaggcagtggcacagacagaaagcggactacagaacaggaagaaattagataatggagcagatagaaaatggactgatggaatgatatatagaaatcaggtattggcagggaaaagtggtaccttagaaggtctcacagatattaaacagcttctggctgggcgtggtggctccctttgggaggccaacgcaggcggatcatctgaggtcaggagtttaagaccagcctggtcaacgtggtgaaaccccatctctactaaaaatacgaaaattagccaggtctggtggcgggcacctgtaatcccagctacttgggaggctgaggcaggagaatcacttgaacccgggaggaggaggttgcagtgagcccagatctcgccattgcactccagcctatgtgacaagagtgatactctgtctcaaaaaaaaaaaaaaaaaaaaaagcttccaatagatattgggcagtggttctcctaaaactgtgagttttgcctaaatccagatcaagggtctaaagggaattttgagaagtctgagaggaatttggctgtggtgtagatagaaattagacgacagacaaggccaggtgcggtggctcacgcctgtaatcccaacactttgggaggtcgaggcgggcagatcatgaggtcaggagttcaagaccagtctgaccaacatgatgaaaccccgtctctactaaaaatacaaaaattagcaggaatggtggcgggcacctgtaatcccagctacacaggagactgaggcaggagaatcgcttgaacccgggaggcggaggttgcagtgagccgagatcgcgccactgcactccagcctgggcgacagagtgagactccatctcaaaaaaaaaaaagaacttagataacaggtctctgatggaaatcatatgacttttctgaaattaatttgatgggggcgaatttaatgaaaaaggcaacagagatattagaaattaggcagaggttctggccagaattcggatgtggatctgagcagtcagatggaaatgaagctgcaggcccaatacaactcaggcagcaggaaattgggttgcagttctaatggaaggtagaagttgggcaatttttgtttgtttgtttgtttatttttgagacagggtctcactctgtcacccaggctggagtgcagtggcgcgatctcagctcactgcaccctctgcctcccaggcttaagcgattctcctgcctcagccttccaaatagctgggattacatgcacgcgccaccacacctggctaatttttatatttttagtagagacgggatttcaccatgttggccaggctggcctcgaaatcctgacctcaggtgatctacccgtctcggcctcccaaagtgctgggattacaggcatgagctactatgcccagctggcaattattattattattattattattattattattattatgaggcagagtctctctttgtcacccaggctggagtgtagtggtctaatctcggctcactgcaacctctgcttcccgggttcaagcaattctcccacttcagcctcgagtagctgggactacaggtgcaagccaccacacccagctaatttttgtatttttagtagagatggggtttcaccatgttggccaggctgatcttgaactcctgacctcaagtgatctgcccgccttggcctcccaaagtgctggggttataggcatgagccaccgcgcccagcccagttattttttataaatcctacaaatgacttagaaatcaggctgagagattcatagtaataagtggtggatctgttagagatggggaggtcacaccaaaataaatcaggagattgaaccaacagagtgagcagcaggctgagcacagtggcttatgcctataatctcagcactttgggaggccaacctgggaggattgcttgagcccaggagttcaagatgagcctgggcaacatagtaagactccatctctattacaacatatatgtatatatcctgatacagtggcatgcacctgtagttcagctattagtaggctgaggcaggaggatcacttgagcccgggatgtcaaggctgcagtgaattgtgtttgtgccactgcactgcagcctgggcaacagagcaagaccctgtctcagaaaaacaaacaaaaaacccaaaacccaaaagatagagtgagcagagctcatacagcagaatgaatggaaattgggcaggggagtaatggcaattgaacagccgtcgtgtaggaaactgggctactatgaaggagtgggtttgaaataaactgagttaaaaaaaaattagcacatctaaaagacatcaaagtggaaaggggtttcctgaaagacccaaggtaggggtgggcctgcctgaaaacacaggtggcagacccaatagaaataaagctctcagaccaaaagaaatcaggcagtgggttgaaagagatgtggtagtagatctaaaagaagtcagaatgcgggtaagtcaaagagaaatcaggcagcagatatgacaggagcctggctgtgggatcacagtgtgaggctccttatatcttgaggttctgcgctggagcagatggtgggagggagggcacagcctgggccccgtggagggctggcgcccgacctggcatgcccttcaggtacggcagctgcaggagggggcggcccagctgcggacggtgtatgcgggtgaacatgccgaggccatcgctagccgggagcaggaggtgctgcagggttggaaagagctgctgtcagcctgtgaggatgcccgcctgcatgtcagctccacagccgacgccctgcgcttccacagccaagtccgcgacctgctctcctggatggatggcatcgccagccagattggggcagccgacaagcccaggtgcccctcatccctcctcgggcttcctgcctccccctggtggcctaccccagccacccccagcccattgacagcccccttctcaatggaatgacaacagccaatatctgtgtggcgcctctgtgtgctaggcactgttctaggtgcttcgtgtgtattcagaccccttttttaggcctgtcattggggacttcggtcatggggcatccttctgtccgctgtccttcccagttgcctattattaccctctccatgggatgtcacagcatgaaacaggctaaagacaggatgggcaagggaggtgtgggactgtatttgtgagggtgggtgaagaattctaacaattccagcatctcagtggcttcattagtgggcatgggcttattgctcacatagtggttggatgtgagtgtccagcagaatcctgtcccctggtgattgggagccagggtccttccatcatgccaccctgggagtcacatgctggaccctctgcatcccgctgcagatgggaaaagatagcaggaggatcacacagaaggttttagggataaagccggcacccacacactgccagcccggtggcctaacctgtctgccagggaggctgcaaatttttttttctcttgagatggagtcttgctctgttgcccaggctggagtgcagtggcacaatatcacctcactgcaacctccgtctcccaggttcaagcgattctcctgcctcagcctcccaagtagctgggactacaggcgcccaccaccacgtctggctaattttgtatttttagtagagaaagggtttcaccgtgttggccactctggtctcaaactcctggcctcaagtggtccacctgcctcagccttccaaagtgctgggattacaggcataagccaccgtgcctgacctaggctggaaatttagtttcatggtgtggctaggaagaaaaggacctagggaatcagggacacctggcattgcttctgggaatgcagatcctgcagcctgcattcatttactcagcaaatatgtattaaatgcatatggtgtgccatgtggtgagcaaggccaagcacttgccctgagacagattgcattctcatagcacttattactttctgaaatatagcatggggatggggcacagtggctcacgcctgtaatcccagcactttgggaggctgaggcaggcagatcacctgagctcaggagtttgagaccagcctagccaacatggcaaaactccgtctctactaaaaatacaaaaattagccaggcatagtggtggacacctgtaatcccagctacttgggaggctgaggcaggagaatcgcttgaacccgggaggtggaggtcacagtgagccaagatcgtgccactgcactccagcctgggtgacaagagcaaaactccgtctcaaaaaaaaaaaaaagaaaagaaaaaaaaatgaaatatagcgtgggtatatatacatacataggaagggaatgatagctggcaaagtctctctgaggatgtgcgtttgactggagacctgaatgaagtgatgggtgagtcaggtaaagttttgagggaagagttttctaggtggagggacccacaagtgcaagggcccagaagtgggctgtagttaggcatgtgtgaggaaaagctagagatcactgtggccagatggagggagggagtgagggagtgtagggtgagaggaagtgagtacagaggggcactggggccctggaaaccacacatggtgaggagcatgccttctctatgaggaacgtgggagccatgcgagagtttagagcagagtggagtgatgtgatgtgtacatttgagaaaaataggccgggcatggtggcttatacctgtcatcccagcactttgggaggccaaggcgggtggatcacttgaggacaggactttgagaccagcttggccaatgtggcgaaaccccgcctctactaaaaatacaaaaattagctgggtgttgtggcatgtgcctgtagtcccagctactggggaggctgaggcaggagaattgcttgaacctggaaggtggaggttgcagtgtgctgagatcgtaccactgcactccagcctgggcaacagagcgagactctgtgtcaaaaaaaaaaaaaaaaaaaaaaaggctgggcacagtggctcacacctgtaatcccagcattttgggaggctgaggtgggtggatcacttgaggtcgggagttcgagagcagcctgaccaacatagagaaacctcatctctactaaaaatacaaacttagccgggtgtggtggcacatgcctgtaatcccagctacttgggaggctgaggcaggagaattgcttgaacccaggaggcggaggttgcggtgagccaagattgtgccattgcactccagcctgggcaacaagagcgaaattccatctcaaaaaaaaaaaaattaaatatacagggaagtaaaggtaacccacatgtgtatcgtgaacacttggcttgaacaaccatcaacatttggccaatctagccaaaagaggtggctcacgcctgtaatcccaacactgggaggccaaggcaagaggatcacttgaggccaggagtttgagactaccctacgcaacatagtgagaccccatctctacaaaaaagaaaaaaattagtcaagcatggtggtgtgcatgcctgttgtcccagctacttgggagtctgagggaggaggatcacttgagtccaggagggtcaggctgcagtgagccatgattatgccatttcactccagcctgggtgacagagcgagattctgtcttaaaaaaaaattttttttttttaattagctgggcattgtggtgcatgcctgtagtcccagctaccctggaggctaagccaggatgatcacttaagcccaggtggtagattcaaaccatagcatgaagctatgattgccaactgatggaaccttcagaaacttggaatttgttttggacataagatggcttagaatggtgctgtccaatagttatataacacgagccacaaatgcgagccacatatatactttaaaatcttcttgtggccatactaacaaagcaaagcaaatgaaacttaattttagtaatacatttttatttaacctgacatacccaaagtattatcacttcaacaggtagtcaatattaaaactattaatgaggccaggcagtttcgaacttctggcctcaggtgatccgcccgcctcagcctcccaatctcagccaagcggagatcgcaccactgcagtccagcctaggtgacagaaggagactccatctcaaaaacaacaacaaccaaaacaaagaaacaaaactattaatgaggccaggcgcagtggctcatgcctgtaatctcggctgagattgggaggctaaggcaggcggatcacctgaggccagaagttcgagaccagcctggccaacatgccaaaaatccatctctactgaaaatacagaacaaaaaattagccaggcttggtggcgggcacctgtaatcccagctactcgggaggctgaggcaggagaattgcttgaacccagaaggtggaggctgcagtgagccaagatcacgccattgcactccagcctgggcaagaagagcaaatctctgtctcaaaaacaaacaaacaaacaaacaaaggctgggtgcggtggctcacgcctgtaatccctgcactttgggaggcctaggcaggcggatcaactgaggtcaggagtttgagaccagcctgacaaacatgttgaaaccctgtttctactaaaaatacaaaaaaattagccaggcatggtggcaggtgcctgtaatcccagctactcaggaagctgaggcaggggaatcgcttgaacctacctagaagggggaggttgcagtgagcggagatcgcaccactgcacaacaacaacaaaaaactattaatgagacattttacattcttttttacattaactccacaaaatctggtgtgcattttacactttacaccaaaattcagactggccacatttcaagtgctcacatgtctagtggctactgccttggagagcacagacttggaacgttaaaatcattggctagtggaaccttcagaagcatagctagaaaaagtttgaaaatttggatcttggctgggtgtggtggcttatgcccatagccttgaactttgggaggctgaggcaggtggattgcttgagcccaggggtttgagaccagcctgggcaacatagcaagaccctgtctctacagaaaatgaaaaattagttgggtgtgatggtgtgcacctgtggtccccgctactcaggaggctgaggcaggaggattgcatgagcccaggaggttgagactgaagtgagctgcaatcttgccactgcactccagtctgggcaacagagcaagaccctattaaaaaaaaaaaaaaggaaaatttggatcttgaaatcctagaaggttagaatcaccaaagtgtgaaattttagaaacttggaaaatttgaatcattgaattagtgaaccatggaccctcagaatttggtcatcgaaagtaggtgtctcagtctggtttggtgactcaacgcctgtaatcccagcactttgggagactgagatgggaggatcacctgaggtcaggagttcaagaccagcctggccaacatggagaaaccccatctctactaaaaatataaaaattatctgggcgtggtggcaggtgcctgtaatcccagctactcaggaggctgaggcaggagaatcgcctgaactcgggaggtggagtttgcagtgagccgagatcgccccactgcactccagcctgggccatagggtgagactttatctcaaaaaaaaaaagaaaagaaaagaaaagaaaagaaagtaagtgtcttgaggtggtatgggatgtcagcctcaaggatttggggtcaccaggagccacatgtatggggcaggctgaggaggctccctgtggctcagatccctgcctgccacccactgcagggacgtgtcatcagtggaggtgctcatgaactaccaccagggcctgaagactgagctggaggcgcgggtgcctgagctgaccacctgccaggagctggggcgatctctgctgctcaacaaaagtgccatggctgatgaggtggggagcagggagggggtccccctctgccacccgggcacattggggtggaagccattccacaccctgacttccctcccacccacctgccactcccagatccaggcacagctggacaagctgggaaccaggaaggaggaggtgtcggaaaagtgggaccgccattgggagtggctgcagcagagtgagtgggggcccaggcacacgtggttcaagggcacagggacatgctccagcctgtccagccaaggcccagagggtgacaggagcatgctttgcaccctacccatgggtctccagaagcaaacataagggcctggaagggtggacaagggggctgccttgccattgaatacccacccttgaaaaaaaagtcttaaagtcctgggtggggggacattaaggaaggaggaatgggagtcagaaaggaggaatgatgcccactgaaatagccccagcctctgccattcctgcagagcccaggatggtcagggctcgggtatggaaagccggaggggtgtggaaggccaggggaacagccattgcccccaggaagggccccagatgccccagaatccttaccctgcatgcccctcctcagtgctggaggtgcaccagtttgcccaggaggcggtggtggctgatgcctggctgacagcccaggagccgctcctgcagagccgggagctgggcagcagcgtggatgaggtggagcagcttatccggcgacatgaggccttccgcaaagcggctgcagcctgggaagagaggttcagctctctgcggcgcctgaccacggtcagctccccagatactgccccattacccccacccccaccaagacccccacacccatggctctatatgagacagacacaccgagacatggtgcttggtcctgtgttgtgtgagtgccaagacagactcttgctaggctcccagtggagcagagggacagacctgtcaccagtgacagcccagaatgtcagggatgtgataggggaagaacaagcagagggatagtgcctgggatgggggagtgggagggggaactggcctgggggattctattctgagacttgaataattaggtgaagagaatgtagtaataaaaaggattaggccaggtgtgacggctcatgcctgtagtcccagcattttgggagaccaagatgggtggatcacttgaggccaggagtttgagaccagcctggccaacgtggtgaaaccccatctctactaaaaatgcaaaaattagctgggcgtggtggtgcacgcctgtaatcccagctactcgggaggctgaggcaggataatcacttgaacttgggaggcagaggttgcagtgagccaagatcgtgccactgcctgggtaacagaacaagactccatctcaaaacaacaacaacaataaaaaaaaaacaacaaaaaaaaaccgcttaaaggctgggtggggtggctcacacctgtactctctttggaagcctaggcgggaggatcacttgaacccaggagttcaagaccagccttggcaacatactgagaagccgtctctaccaaaaccaaaagcaaacaaagaaaaaacagccaggcgtgatggcacgtgcctgtagtcccagctactcagaggggtgactgagactcgaggatcacttgagcactggaggtcaaggctgcaatgagctatgatcttgctgcttgcactccagcctgggcgacagagcaagactgtctcaaaaataaataaataaataaataaataaataaataaataaataaataaagtcttaaagtcctgggtggggggacattaaggaaggagaaatgggagtcagaaaggcacgcagagcaattgatttacccaatttttaaaaaagtgatttagccaattcttaaaagagcaataggtgtttgccggagagaataggctttaagttcttggcagagagcaaagcatcgcacaggcctggacaccttgctttttcaaggaactggtcaattgagtgatgaggcagaaaaacccaggccgcctccccggacctcccccttaccccgccccggccccacgcctccaacctaaccctggtccctccatcctcagatcgagaaaatcaaagcggaacagagcaagcagccgcctaccccactgctggggcgcaagttctttggggaccccacggaactggcggccaaggcggcgcccctgctgcggccagggggctatgaaaggggcttggagcccctggcccgccgagcctcggacacgctctcggccgaggtgcggactcgggtggggtatgtgcgccaggagctcaagcccgagcgcctccagccgcgcattgaccggctgccggagatcccggggagggtggagcccgcggccctgccggccgcaccagaggacgcggcggagacccccgcgacccccgcggcggcggagcaggtgcggccacgaccggagcgccaggagtcagctgatcgcgcggaggagctgcccaggaggcggcggcctgagcggcaagagtcagtcgatcaatccgaggaggctgcgcggaggcggcggccggagcggcaggagtcagcggagcacgaggcggcacacagccttaccctgggccgctatgagcagatggagcggcggcgcgagcggcgtgagcggcgcttggagcggcaggagtccagcgaacaggagatgcccatcagaggagacctggtcaaggggtgaggtgcccgccttatgaccagaaagtgaggggaggggaaagcggagagctcctagaacccctcaggcccagtgaaagggcttcagggctcagaacttcccaaagaaggagatatcgccgcggtacccattttgcagaggtgtaaactgaagctgcaagataatcgatgtgcccattgttacacagaaaggggagcccttcctgttgaaagaaaaggcagactgcctttctccagacgtaggttctcggcccctgggttgtgactcctgcatcaagtctcccgggtgccccgaggcagggattttgtcctctctgtgcctcagtttgcccactgggctaatggtggaaccctcacctccttgattggagaggagaccctttatcacaattctctcagcagccttatgaagtgggggctgttgtcttctccattgtatgactagggcaactgaggcacaaaaagggcaagtcactcagcttaaacgaaccaggactttcagaatccagagttggccagtgtgtgttgtgcagatctgtccagtcagctgagtgtgtctccagaaagaggcctttggtcaggagacaatgacttcttgattctttttaaattgcacatttcatgaacatttgctgagtgcccactctgcctggcatgtgctgagtcgagcggtgactgaaccagtcccatccctgactttagagactcacagtccattgggaaaaacaggcttgtcatcaatgatgaccgagaattatctgggctggaatgggggcgattgggggactggagagtcaggggtgggtggagaaaggcaacgtttgcaagttgttctttgtgctgcttaaaattcaaaggggcatctgggcgcggtggctcacgcctgtaatctcagcactttgggaggttgaggcgggcagatcacttgaggtcagaagttcgagaccaacctggccaatatagcaaaaccctgtctctactaaaaatgcaaaaattagccggcatggtggcgcacgcctgtagtaccagctacttgggaggctgaggcaggggaatcgcttcaacacaggaggcagaggttgcagtgagccgagatcatgcaccactacactccagcctgggcaacagagaaagactccgtctcaaaaaaaaaaaaaaaaaaattcaaaggggcgagaggtttggtcttccattcagcagacacgtcccaaacacctgtggtacctaaggcgagcatctgagagaaacagctgcagaagtgggcaggggcctggcacttccagctaagaagtggaggctcctctgcccagccagacaggtccatgggagaaggaaccctggtttcactgggtctttctgtcccccatcccccaggaaggccaccctggctgacattgtggaacagctgcaggagaaagaggcaggcccagggctgcctgctggggtaagttgagcctcggatgggtggggataggaggacccctttttcagagcaggaggcaggatctcagaaacagccagtgcctagccctggcaggacccattccctacctggaccctgcagagacagcatggactctcagggtccccagaatctgaaaatgtcccccttagaaagacggggcacctacctaagagacccctactgcccctccacacacacacacacacacacacacacacacacacacagacacacacacacagacacacacacacagacacacagacacagatacacacacagacacacacacacagactcttcccacatctgtcctggactccgtatttcttcagctcagtggggtcccaaatttcttcatagcctcatacacacacacacagaaggaagccccaggtttctcctgcagacagtggggacacgccctgcttgcacccccacctccagagatctggctgcctctttccaccaccgagagagattccaaaccaatgagtcctaacagactcactcccaagacccatggggccctaagaattgggcctccaaccctgaggtcctcccatactcgcctccgagacaaatggccctgtagacagatgggaccccagacccatgactcccccaaacagatgacccccacaccctctccatggacagcacccctcttccccctcccttcacacagccgtcgctgcctcagccacgcgagcttcccccaggtcgcctgcccaacgggcttgagctgcccgagcggacacctcggccggaccggccccgggcgcgggaccggcccaagccgcgacggcggccgcggcccagagagggtggtgagggcgggggaagccggcgctcgcgctccgccccggcccagggcggctccgcccccgcgcctccgccaccgcccactcacacagtgcagcacgagggcttcctactgcgcaagcgcgagctcgacgctaaccgcaagtcgtccaaccggtgagcgtgtgggcggggctttggaaggcgggtctcaggctcagggtgaccattgcgtggagcggtgggactgaggagggggtgtggctcaacttcaggccctccagcaggtggcggtagtaggtggggccagagctggggggtggtggtggcttaaatcaagaaagccaaccaatgagcaggagggggtgtggtttaacgtcaggccctccaacccgtgggggtagtaggtggggccagatgaggggtggggctcaactttgatgattccaaccaatgaacaggaaggggcaggacctaaggttagtgcatctaatggatgatgggtagagcttaggtgggaacagaaggaaaatgttctgaaagtgagtaaattggaacctaacctcttagcaaccaacccaggagttgatcagctaaatagcaaagagggaggcatctagttgagaaggtttcaatggcttgtcgtggagcttggagaggtcactcaaccaatgagtggggtgggtctacccttgaagtttcaaattgggggagggtccgaaaacgggcagagcccaaactaatgagggtaggggttgggaagggggagtcatctcttacaggtttccaaatgagggtctagccatgatgtgcctgctcttggggagtccagctcctgcttgtccaccctctttttgtccaactgagaggcagaatctggggacaagtggagccaaaaaggggtatcaccggccagtaatggagtgagtcccaagatatgaagtgggcaggacagattcagattttgctagtggaatctgtaggtggtctttcttcctcgtacctaatgccaaggtaggaataaacaagggcacctagtatgttttgctttgggagggattcctccaggatcgaggctttggatgactggagagacaggaattctttattccagacagtagaccaatagactttccttgagaaagctccatgagtggggaggattgagtggagcaaaggcttatggaggagacagcttaagacttaccttcaggaaattcagtatgggaggggataaggaagggaaatctcagcctgggcaaaggcttgatactgagagacttaaatgctcccctcagggcagcaacagccttaaggaagagcattttaggtccaactagggcgcaactagggcgcaaaggtccagaggtaggaaggctcagacatattcagaccttgaggatgttaatgaagagttattaggcagagtgctgcggctctgccttgagccccatcttgtcgctccaggtcgtgggtgagcctgtactgtgtgcttagtaagggggaactgggcttctacaaggactccaagggcccggcatccgggagcacacacggtggggaaccgctgctcagcctgcacaaggccaccagcgaggtggctagtgactacaagaaaaagaagcatgtcttcaagctccagtgagccccccaatgggcaggagggagggatccaaggctcagcttcaactcccagtgggaccctggcttccctgggggacacttggtgggcaggtgggctgggccccttccccagatctctgaagtcctgtgtcccttcctgcaggacccaggatggcagtgagtttttgctccaggcaaaagatgaggtgagatctggtcctttcctccctctgtgtggacctcagtaatgacctggctgtctggctcctgacccagagtgatggggctgtgagaagggacactcacaggccagagttatcagggctgtaatgggaaagcccacaggcactgagagcccaaaggaggttcctaacccagtggggagtgggaagggcttcagggagggctgcctgcagatcctgatgacaaagtccaacatctttgccgtggtcactcaggtgagactggaatggagggagttcgctttaaaaaggggtgatttggccaggcgcggtggctcacgcttgtaatcccagtactttgggaggccaagacgggcagatcacctgaggtcaggagtttgagaccagcctggccaacatggtgaaaccccgtctctactaaaaaatacaaaaattaactgggcatggtggcaggtgccttaatcccagctacttgggaggcagaggcaggagaatcgtttgaacctggaaggcggaggttgcagtgagctgagatggagccattgcactcaagcctgggggacaacagcgagacttccttcgaaaataaaataaaaataaaaagggtgattcagagggacagtgggggtctaaaaaaaggagtgattcaggttgggcaccatggctcaggcctgtaatcccagcactttgggaggccaaggcaggagactgcttgagcccaggacttcaagatcagcctgggcaacacggaaagatcccatctctatgggtaataataataataaattagccgggagtggtggcacatgcctgtggtcccagctactcaggaggccgagtggaaggatcacctgaaccagggaggtcaaggctacaatgagctgtgattgtactatggcactccaggctgggtgacagagtgagattctgtctcaaaaacaagagggggtgggtgatctaggtagagggaactgcaagtgcagaggaccagaggtgcagtattgcaaagggttaactgctggagggcagagttcatggaagaaggtcccagaaaggttcccaggagataggtgtctcaggacaggatgggccatttggaggagattggattttttacctaagggcactggagagctaggggggattacagtgatgtgtaaaaaagattcctggctgggcgcagtggcttacgcctgtaatcccagcacttcgggaggccgaggcgggtggatcacctgaggtcaggagtttgaggccagcctgaccaacatggagaaaccccatctcttatggtgcatgcctgtaatcccagctactcgggaggctgaggcaggaggattgcttgaacccggaaggcagaggttgcagtgagctgagacagcgccattgcactccagcctgggtaacaagagcaaaactccatctcaaaaacaaaataaacaggccgggcatggtggctcacgcctgtaatcccagcattttgggaggccgaggcgggcagatcacaaggtcaggagatcgagaccatcctggctgacacggtgaaaccccgtctctactaaaaatacaaaaaaattagctgggcatggtggcgggcgcctgtagtcccagctacttgggaggctgaggcagaagaatggcttgaacccgggaggtggagcttgcagtgagctgagattgcgccactgcactccagcctgagcgacagagcgagactccatctcaaaacaaaacaaacaaacaaaacaaaacaaaacaaaacaaaacaaaaaaagattcctttggctacctgggtgggtagcccaggccgcggccagggcagggacccaagtgggagagcgcatggctgggccacacaggcctgtggggagaggaggaagaggagtctgagagaggcaagcataaaggtggtttgaagagatgttgagagtaataactaacacttgttatctcattcaatcttcacaagatgcaatgaagaagtgggctttttttttttttgagacagagtttctctcttgtcacccaggctggagtgccatggcgcaatctcagctcactgcaacctccacttcccgggttcaagcgactctcctgcctcagctacctgggtgactgggattacaggcttgcgccaccatgcccggctaatttatgtatttttagtagagacggggtttctccatgttggtcaggctggtctcaaactcctgacctcaggtgatccacccgcctcagcctcccaaagtgctgggattacaggcatgagccaccacacccggccagaagtaggcctttacccactacatgccttcttttacttatctgcacaatgaagattaaaaatagtttcttggcctggcatggtgcctcacacctgtaattccagcactttgggaggctgaggtgggcagatcatttgaggtcagaagttcaagaccagtgtggccaacgtggcgaaaccccatctctactaaaaatacaaaaagtagccaggcatggtggcacgtgcctgtagtcccagacactcaggagactgaggcacaagaatctcttgaacctgggagatggaggttgcagtgagctgacatcgagccattgcactccagcctgggggacagagcaagactctgtctcaaaaaaaaaaaaaaaaaagtctcttatcatagggttactgtgagaattaaattgctccatgtttaattgatacatgataaactgatacttagcacagggcctagtaaatatcagtgctctagtagtgcctgcccatattattatcattgtttgtgtcatttatctctgtagtaggaagtatatacaatcctattgcataggtttaagggaattaatccactaaagtgtttggaacagagcctggcacatattgctatgtaactgcatcatcatcatcatccctttttaatagatgagaaaactgaatttcagagagggtagtctgatctgaaattcacctattattccagcttctctcttccaaatacggcctctgtgccctgtttcttcccccaggaggagatgaacggctggctggaggctgtagcttcctcggtggcggaacacgcagagatcgcccgctggggccagacactacccactacttcatccacagatgagggcaaccctaagagggaaggcggagatcgcagggccagcgggcgcaggaagtgacttcccacccccaggacctgacacatctcgtctcccctcttttccgcactgtgggcacaaagacactttttcttccgcaggggcgggagcccctagttccaacactgaggacgcgtgacatggtgggcaccggaaaggaggggacttctcctgcaccccaagaagtggtggggagattgctgcccctatagccatatctcggccccttcccactcaccacccccaccccaggtgctgggggtcccttatttttatgcaataactgagcttgatgggggtgggcagggggccagttgagccaagcccccagccccgatctgcagatcctgccccaagaagctggggtggtgggggcagtaattcctgcccccctctctgccctagggatgggcacgggggcgctggtgaggtcccctggaccatccagggtgctagggggcagggaggggacaccccctccccgcctttacctcacttccaatgctgccttgatctctgtctgggaggggggagtgaaggggccctagccccctgcactccgccgcctcagagccatgcggttaattcctgacttagtttatttttgcaaaacgtcgatctcctcctcccccgccccgcatccgcgaaggcttttaatgggaggggcgtcaaagctcaaaactgttttcctctctcctcccccctccagttgtaaatgccacttcatgaggggaggggcgaggggaagcccacccctgcatgcttctggctggagcacctccctggggagtcgggggattgggttgtgggcagtccccatggccgcctggagaagccgctggggcccgggggtgtggggcggtgtggcgggcgcacactgtatgtacctataataaaccctttggctttgacggtctatggtcctttgtttgggttttctgggctgcgcccgggaggattgaaaggagggctgtggtggctgtaggggtgggtgcggggtggggagaggggcacgggggtaccgtggctgcggagaacatccagatgtacccttttatgtggacttaatttcggggtctaaacacacgccccttgacgagaacctagagggatggagaatatttcgttatgcttcgtaataaacttccccaaaggagactccgggtccgccccgtcaagttcaggaaaggcggacccctttaaggaggcggaaaagttaaccgcgatgggcaggcgctctgtccaatcgctagtgactcctggagtctctggcccaatgagcagcctatggaggcggggtccgggtgcacacccggaagtgggtgcgggccagccggctcgcccgggggccatggcagcagcggctactgcagccgagggggtccccagtcgggggcctcccggggaagtcattcatctgaatgtgggaggcaagaggtgagtgtgggagactcctgaggtcccatcctcgggggcgggaagcggggtgggagtatccgcctctcctgggggaatccctgtccatcaagggttgctccgccccccccccctttggaggcgcgagattctggaaaaacgccgggggagggggaaggggagggaaccctggatcctgcgggagggggacgcattcctcacccgctcctcttcatctcttgcgtccgtttaccttccccgcccagattcagtacctctcgccagactctcacctggatcccagactccttcttctccaggtgatcgggagagcgagtttggggcgagggtaggagggatggagagggcgtgggagacctaatatccactcccccggcccgtgacgcctgctcggtgtcccttccctgcagtcttctgagcggacgcatctcgacgctgaaagatgagaccggagcagtgagtcggacaagaactgaaatgggatgggggggaggggttggtaggaagaggggcaggaccccactcagtcctgccttttaccccatccatcctctgcccccctttcccgcagatcttcatcgacagggaccctacagtcttcgcccccatcctcaacttcctgcgcaccaaagagttggatcccaggttggcatggaaaaaggggagggagtccctcactgtcttcagtccctgaggagttctttcacctcctctgaatgtccacgtgagctccattctattagaattctcattcagaaccttgatcacaggccgggcgcgccgggattgctcacgcctgtaatcccaacactttgggaggccgaggtgggaggatcacttgagcccaggatttggagactagcctgggcaacatagcgagaccccttctctaaaaaagcaaacaggcaaaacttcatgagaatcttgatcatgttaaaattttatgtccttcgatttctccctacacacacacacacacacacacacacacacacacacacacacactcaacatttcctccacccatatcatcactccttagcatctttattccatcaaaactttctaccccttgacattctctgtgcagttttgaaaattaccctctcagcattctctgttcacccccacacctagaccctgacctctagtcaattctactacccaggggtgtccacggttccagcctcctccatgaagcccagttctatgggctcactcctctgggtaagtgggagcccccagctatcatcctcattgtatagaaaaccaactctgtgatgctacctgcccctcttccccttctctcctgaaagagggctggggtagaggtgggaggactggttatggccctggccgggtctgtattcgtactgggaggagtattggtactctgtgtagaaagaaatggggagggggaaatggggtggcctcagcatctccctaagtcccagcctttaagtcctcctgttgcagttcgtcgcctgcagcttcgagaggagttggatcgatcttcttgtggaaacgtcctcttcaatggttacctgccgccaccaggtaggcactcccaatggaatggaggggcgcggaggtgggccaaagactacatttcccataaggctgcagctctcgggtgcctgtgctgtgcgtcctgagatacagtgggaggtgtagttccctatcagatgcttgggctgatgcttggaaaggaagttggacacagcatttcccatgagacaatgggccagctaactcttgaggctcagaaggatgtcctggagccccatgggagttgtagtccgggtttggtttctttgtagggggggctttggaagacctgggattcttcgtatggaggggagaaatattaataggaagttattgacagtaatgcccatgatagccagcccactggccatggaaggtatgccccagtggttattggaactaggcttttctgattggtagaagtaacagagtagggaaatttcatctacagctttatttccctaactgcagtcagcacctgctaccttcatgaaagttgccagatataaagatctgtagtagtacttttccaacttagttttatcctgttttccgaaaaacaatcatttatttatttatttatttatttaattttatgagacagggtctggctttgtcacccaggctggagtgcagtggtgcgatcttggctcactgcaacctctgcctctcagattcaagccatccttccacctcagctctgccactgagtagctgagactacaagcactcgccaccatgcccggctaattaaaaaaataataatcattttaaatgcaagctttatattataaatacaaagtaaacatgaaaataaaacccaaacatagcagtgttattaaactctggcctgtagcagtggctcacacctgtaatcctagcagtttggaggccgagacaggtggattacttgagacctggagtttgagaccagcccaggtgacacagcaagacctcatctctactaaaaataaaaaaaaattagccaggtgtggtggtatgcacctgtggtcccagctacttaggatgctggagtgcgaggatcgcttgagcccaggaggtcaaggctgcagtgaactatgatcactcattacaccccagcctgggtgacagagcgagatgctgtctcaaaacaaaacaaaacgaaaaacaactctggctagatgctattgcttgccaagggtgcagtcttccatttattaaaagtgaaaattagggccaggcacattggctcatgcctgtaatcccagcactttgggaggctgaggtgggtggatcacctgaggtcaggagttcgagaccagcctggccaacatggtgaaaccttatctctgccaaaaatataaaagattagccatgtgtcgtggtgggtgcttgtaatctcagctacttgggaggctgaggcaggagaatcacttgaacccaggaggcagaggttgcagtgagccaagattgtgccattgcactccagcctgtgcaacgagcgaaactccaactcaaaaaaaaaaaaaaaaaaaaaaacggaaaattaggtaatactgcagattcattaatatcacagcagcactaaactcagtcttcctctgtgctgggctcaagggaactgaaagggaagtaacttgctatgtggttcagtgtcatttcatgctgtgtcactgcaccacttaaaatcttcacccggagactatgtcccacacatggggaaatcaatcaccgtcatattttaagtgcttgctgtgtgacagccacgattacaatgactgttactctacctcttattctcactgtagtgttcccagtgaagcggcggaaccggcacagcctagtggggcctcagcagctaggaggacggccagcccctgtccgacggagcaacacgatgccccccaaccttggcaatgcagggctgctgggccgaatgctggatgagaaaacccctccctcaccctcaggtacgtttctatctcgtggaaggttggggcagctgtggggtccctgtgaccctcttctgatccctactcttcccctcaaggacaacctgaggagccggggatggtgcgcctggtgtgtggacaccataattggatcgctgtggcctatacccagtttctagtctgctacaggtgcttggggagggagtggcaggaggtcccagccctgttgatgggaagggcatgcggtgagggttggtgatgtcccctcgatcctacaggttgaaggaagcctctggctggcagctggtgttttccagcccccgcctggactggcccatcgaacgactggcgctcacagcccgggtgcatggtggggctttgggtgaacatgacaagatggtggcagcagccaccggcagcgagatcctgctatgggctctgcaggcggaaggcggtggctccgagataggtatgaccccaagccttttccagaaccctctgtcctttaaattctactgcctgttaaaatgacccaccccataaaatcctcaaacccataagaattctctgctctattagatctgtttgtgtcattagaatgctccagcccttcagaattctgtatcctgttagaattccctggcttcctagaaaaatccacccacatacaattctccctccatcagaattccctgccctgttagatctcttggttttgttagaatgcgctattctgtgtggccatgagaaatgtctgacttggcccggtgcggtggctcatgcttgtaatcccagcactttgggaggctgaggcgggcagatcacttgaggtcaggagttcgagacccccttggccaacagggtgaaacccagtctttatttcaaaaatacaaaaaaattagctgggtgtggtggcacgtgcctgtaatcccagctactcaggaggttaaggcaggagaatcactggaacctgggaggcagatgttgcagtgagctgagatcgcaccactgcattccagcctgagcgacagagtggacagagtgagacaccatctcaaaaaaaaaaaaaaaacaaaaaaagaaatctctgacttatggctgggcacagtaactcacatctgtagttccagcactttgggaggccatggcaggaggattgcttgaggccaggagttcgaggctgccgtgagctatgtaagccatgattgcaccactgcactccagcctggacaacagagcaagaccctgtctcaaagccacagcaacaaatctcggacttattaatctgtccccaaataaatctcagccctcgtaagaatcccctgccaccagtggaggtttttttgccttattgcaaatctcagtgctgttagaattccagaccgttttagaatcccataccccatcagaaatcttctggcccattttatcttctctaattcctgctggaatcttcactttttttttttttgaaatggagtcattctctgttgcccagattggagtacagtggtatgatctcggctcactgcaacctctgcctcctggggtcacgcaattctccttcctcaacctcccaagtagctggggctacagttgtgtgctaccacactcagctaatttttatattttttagtagagatggagtttcatcatgttggccaggctggtctcaaactcctggcctcaaatgatccgcccacctgagcctctcaaagtgttgggattacaggtgtgagccactgtgcccagcccctgatggaatcttctatccttcaaggattctgtggtcccactgaaccctctggtccttggagttcttcctcccacctctcctcctccatgaggcagggttccagctgagccctttttgcccactgcaggggtctttcatctgggggtgcctgtggaggccttgttcttcgtcgggaaccagctcattgctacaagccacacagggcgcatcggggtgtggaatgccgtcaccaagcactggcaggtcagagttctggccagcctggctgcccccttcccagttttccagactgtacagacccaggaaggggttcacgtctgcccccacccccaccccctaagcctggaggaagccagagaaccagcagctggccagagcctggggatgtctgtgataaaggcctaaggagcaccagggaagccttcctggaggaggtgctgcagagcccacatgaagcatgaatgggtttgaaaaggagtagggaggattgtcttgggactgggtgagagagcaggttaggggggatgctgtagaagacaagaactggcttggctcggtggctcacacttgtaatcccagcactttgggaggctgaggtgggaggatggctttgggagaaagacagacagaggcagagaaagagacagagaggcagaaaaccaggcaaatagaaatagaaaatcagaaagaggtgacagagaagggtagacagagtcaaaccagactgaaccactgtggcagatgggggaactcagagagataaatggagatgaattagagtcatgtcagaagtacatagtggaggccgggtgcagtgactcccgcccgtaatcccagcactttgggaggccgaggcaagaggatggcttgagcccaggagtttgacgccagcctgggaaacataataagactctgtctctacaaaaaatttaaaaaattaaaactttaaaaagtacagagtccaggagaggccaagagtcagacagacagatgcatcaaagggaggaagggagggaacaagacagggacaaaggcaggcctggggtggacggggctggggagcagtgggtgggttctggaggtggaggagagggcccatcctctgtgaggggtcaccacggaaggaaaggaatggaagggctcccggctgcagcctgtcctgccccacccccaggtccaggaggtgcagcccatcaccagttatgacgcggcaggctccttcctcctcctgggctgcaacaacggctccatttactacgtgggtgagcagcagcctgtgtcccgggtgcccgagaccctcccctgggagaggggaagggagggagagaggctggggcacttggaacaaacccgctccaccctccctgcccaccccagatgtgcagaagttccccttgcgcatgaaagacaacgacctccttgtcagcgagctctatcgggacccagcggaggatggggtcaccgccctcagtgtctacctcacccccaagaccagtaagctatgacccggcttcccctgctgctgtcacctgccagccccagccccagcctgcagctgtcccccaacttgtgtagcatgacccagaggggtttatcgaggggcggcagattcaactctctctcatttttttttctgagacagactctcattctgttgcccaggctggagtgcagtggtgcaatcttggctcactgcaacctccacctcctgagttcaagcgattctcctgcctcagcctcccaagtagctaggattacaggcgcccactgccacgcctggctaatttttgtagttttagtagagatggggtttcaccatgttggccaggctggtcttgaactcctgacctcagatgatcctcccgcctcagccccccaaagtactgggattacagacgtgagccaccgcgcccagccagattcaactctcatccagtcattcaacaaatatttactgagtatccctgtatataagcacgttctaggtgctagatggtggccaccctctccactaggggcagaatggaccattaggagttaatctttgtgtttctttcccacctttgtgattaaggcatgatgttcacatgttcataaaacaacacagatgcaggttttacagcagatgaacctgagttctcttacttgagacagttttttgttttgttttcttgacatcaaatgcagaatgggttaatttttgagacgtaattctcataccataaaatttcccatttgaacgtgcacaattcagcggattttagtatattcacaaggttgtacaactatcaccatgaacaaattccagagtatgttcatcacccccgtaagaaaccccctgatctttagcagtaactccacatttctcacttctgataccctctagaaatcactaatatgctttctctttttgtttgagacaaggtctcgctctgctgcccaggctggagtgcagtggcatgatctcagctcactgcaatctctgcctcttgggttcaagcgattctcatgcctcagcttcctgagtaggggaggattacaggtgtgcatcaccatgcctggctaatttttctactttaagtagagactgggttacgccacgttggccaggctcaatatgcttcctatacctatggatttgcctgttctggacaattcctgtaaatgggatcatacattatatggtcttttgtgtctgcatttttcacttagcatatttttttaaatggttagtgttttctgggtcttaagatatccttacctattctaggttacaaagatcttctcctgaatttcttctagaagatttacagtttagtttttacatggaagtctgttctatcagaaattaaattttatgtatggtgtgaagcagggattattcttttttaaaaaaaaatagagacagggtcttgctctgttgcccaggctagagtgcagtggcatgatgtgagttctctgccacctccgccactcgggctcaagcgattcttctacctcaacctcctgaacagcagaaccacaggcatgcatcaccacacctgtctaatttttgtatttttttgtagagacagggttttgccatgttgcccaggctactcttgaactcctgggctcaagtgatcctcacactttggcctccaaagtgctggaaatacagacttgagtcactgtgcttggccatagctgctgctgctgcttttcttttttttttaaagcagaaataagttaataatacacctaacttcatgacacattatcacctttcttctttgtaaggcccttttcttatttcttttttttctttctttctttttttttttttttgtcttttcctgagacagagtatcgctctgtcattcaacccaggctggagtgcaatggcgcaatctcagctcactacaacctctgcctcctgggttcaagcaattctccagactcagcctcccaagtagctgggattacgggtgcctgccaccatgcccagctaatttttgtgtttttagtagaggcagggttttgccacgttggctaagcaagttttgaactcctgggattctcctctcgtcgtctcccaaagtgctggaattacaggcatgggctgctgcacccggcctctttcttatttcacttacttactcatttcctcctcatctcccttcccgccacatgccactattatgtcatttttctttgttttttgagacagtctcgcttcgtcacctaggctggagtgcagtggcgcaatcatagctcactgcagcctcaccccctgggctcaagtgatcctcctacttcagcctcttgagtagctgggatcataggtgaatgccatcacacccaactagttttttaaaaatcttttgtagagatgagggtctcactatgttgcccaggctggcctcaaacgcctggcctcaagcaatcttcctgcctcggcctctgttctctgttttactttctctttcctctcttatttgctgtttcactgttacaatttctgtctctgggcctctcctcctttgacctgtgcctttgtctccctgttcctccatttcccacatctcatcaccatctttttgtgtccttccctctctccttgctttctgactgtgtctctgttctgtgtctctttctttctttctttctttttttttttttgagacagagtcacattctgtcatgcaggctggagtgcagtggcgtggtcttggctcattgcaacctctgcctcctgggttcaagcaattctcatgcctcagccttctgagtagctgggattacaggtgcgtactaccaccaccagctaatttttgtatttttactagagacagggtttcagcacgttggccaggctggtcttgaacgcctgacctcaagcgatccacccgcctcagcttcccaaagtgatgggattacggcgtgagccaccgtgcccggcctctccttgctttctgactgtgtctctgttctgtgcctgtttctttctccctgccctggtttctgtctctgtggcccaggccctctcctcatccttggcccctcaccaggtgacagtgggaactggatcgagatcgcctatggcaccagctcagggggcgtgcgggtcatcgtgcagcacccggagactgtgggctcggggcctcagctcttccagaccttcactgtgcaccgcagccctgtcaccaagatcatgctgtcggagaagcacctcatctcaggtgagcctctgtggggtgctccagtgctgggagagacagctcagatgggagtgtggagacaggaggatgagaatttccactggggagggacattgtgtaggaagagagctctggcggagaggattgacctgggatgggactgtaattgcagaagtgagagaataccataggggatcagtctggggaagagtgaatctgtgtgtgtttgggaatccatcaattcagcaacgatttacggggcacccaccatgtgccaggcataggggatacagtgatgaacaagacaggccaagtccctgccctcgtggagctgacattctagcagcgatggcagacaataaatctataaaaatggacatcaatggccagctgcggtggctcacacctataatcccagaactttgggaggccaaggcgggtagattacttgaggtcaggagttcgagaccagcctggccaacatggtgaaaccccacctctaccaaaaatataaaaaattagccaggtgtggtggcacgtgcctgtaatccccgctactcgggaggccgagggaggagaattgcttgaacctgggaggcggagattgcagagagcccagatcatgctactgcactccagcctaggcaacagagcgagactccatctcaaaaataaatagataaaaatgcaaatcaggctgggcactgtggctcatgcctataatcccagcactttgggaggccaaggtgggaggattgcttgaggctaggagtgtgagaccaacctggacaacaaagtgagacattgtttctacaaaaaatttttaaaaaattagccaagtatggtggcatgcacctggggtcccagcttcttgggaggctgaggtggagggatcacttgagcccaagagtcaggggctgcaatcagctatgattgcacccctgcactccagcccaggcaacaaagcaagactctatctcataaaatattaataaaataatctaaatcaacaccaggcaatgataagggctatgaataaacatgaagctgtgtgtggctagagagtgtcaagtcgctggagaggggtcattcagggaaggcctgaggaaggacctttgagcagaaataacagaatgagcagtgcagattggtagggacaagcattcaggccgagggaacaggcattgcaaaggctctgaggtgagaggatgcctgaggaagtgcagggagccacttgtgcctggaacagagtaaatgagggggagaatgggaggagatgagggtatggaggtgacaagggcaggagccacagagggctccgagcaggggagggacatgactagcttcaggtgttcacaggctccacctggctgcccgtgggagcacactactgggataggacaggagcagggacctctgggaggggcgtgctgatacggtccaggcaggtgacgaaatggaccaggaccggtgtggggcagaggatagggcaaggtgagatcaggctctggaacagttttggaggcagaggcaacagggtttttaacatttggaattctggggaggaaaggattctctgaaagggaagaactcagcaagggctgaccctcctgaaacggggctgtcctgaggctctggacgggcaggcagcattgatgcctgcaccaggcctgacttcctgctctccttgtgcccctcagtctgtgccgacaacaaccacgtgcggacatggtctgtgactcgcttccgcggcatgatttccacccagcccggctccaccccactcgcttcctttaagatcctggctctggagtcggcagatgggcatggcggctgcagtgctggcaatgacattggtgcctactggctcctggccttcccaccccactgacccccttacctgacccctgttgacctccgctgattcccacttgcggccacctgacccaggagcctgcaacgattggggtgtcctgatccttgaggcacctgagctccactgactgccacaaccccccagccctctctggccctgcccaactctaacaacctggggatgggactggggtcttggggtggtgggtttcatcagtggggaaggaagtctgaggctgagggaatcccagctggccctgacccctgcccctgcctggcccaggcccctacggtgagcgggacgaccagcaagtgttcatccagaaggtggtgcccagtgccagccagctcttcgtgcgtctctcatctactgggcagcggtgaggacagtcctgtccaacagggagggaggacagtcctgtccaacagggagggaggtcaggggagaaggcaagatgctagccagatcactgaggccagaaaggggtcccagccaaggagcattgaaggagcaaaggctgggagggaggacaggcctggtaggtttgtcttctggtatcaaaggtgtgacaggtgttggtgggactgacctggcgcagtgccagcccagtgcaggcagggccaggttgaaggcacagggggtggggtcagggtgggatggggggcccaggcggagggggaggggtgggatgggggcccagggggagaggtcggggtgggatggggggaccagggggaggggttggggtgggatagggggaccaggggcaggggtcgggatgggatggaggagacccagggagctgtaggagccttgcttcagctgggaaaggggcctcggaggatgttctggatgaagggactctgagcagagacctagaggacaagtaggaaggagcagaagaaagaaggcaggggaagggggccccagcctgagggaactgtatgtgcagaggctgagaagggccaaatagggtcacatgggaaggacacgtgggctcctgggctggagcacagaacaggaggtgaggatggggtgcagatgcgggcgggccttgtcaggctgtggaagggctgaggctttgtcctgtgcggggagccgtggccactgcatgggggatgaaaggaggcttgatgggaggccaggagcccagggaggaggccaggaggctgataggaggtgggggagcagctgggacgggcctcaggtcttccctgcagtgggagcagggaagagcagaagctctgggagactccctgggtgtttggggctgcggtgtccaagagctgctggacccttgggactggaactcaaaagcaggctagggatggataaagattgggatggcccctggagaggcaggaactgcagccacagtggtggggactgggacgaggaagggtgagaaagcgagggtgaccacctcccccactgcaccccccagggtgtgctccgtgcgctccgtggacggctcacccacgacagccttcacagtgctggagtgcgagggctcccggcggctcggctctcggccccggcgctacctgctcactggccaggccaacggcagcttggccatgtgggacctaaccaccgccatggacggcctcggccaggcccctggtactccctgccccaccccaatcccgtcccaagccccacagcctcacccagaaccactctccactgccaactgcttgatctctctcccaggcccttgccctctgaccccttttcctttgaccccctctctgctccccatcccttcctgcccttgtttttcaacccctgtctcagcctctggcccccatgcattgatctctgcttcctctctcctgtcctgaccctcggtgcttgcactgcaatgcaacccaggcccttgccctatgacccctgtcttgccccctgaccctgcttccgtgccccccagcaggtggcctgacggagcaagagctgatggaacagctggaacactgtgagctggccccgccggctccttcagctccctcatggggctgtctccccagcccctcaccccgcatctccctcaccaggtagccacaactccactgccccttctgtgcaatgaggggagaggggacagcatggtgttcccggggacagagtggcccagctgccccgtgatgacgtgcacttactgtccttacttcctcagcctccactcagcctccagcaacacctccttgtctggccaccgtgggagcccaagccccccgcaggctgaggcccggcgccgtggtgggggcagctttgtggaacgctgccaggaactggtgcggagtgggccagacctccgacggccacccacaccagccccgtggccctccagcggtctcggcactcccctcacacctcccaagatgaagctcaatgaaacttccttttgaacaacgcagctgccatgatgccttgggatgccctggtcctgggggactcaggtgcctccctgattcctgtgggaaccccgggttcagggccagggcctccttggaataaatggttattgttactaggtccccaccttccctcttttctggaagccaaagtcaccctccccaataaagtcctcactgccaacatcttgcttattcttagcaggtttgggactccccaggaaaggggtggggaagatgtgggacccaacccgatatatgcaaaatcaggaacatctacctctcttgtttaagcaaagggaggccaggcatggtggctcacatctataatcctggcactttgggaggccagtttgcttgtgctcagaagtttcagactagcctgggcaacataacaaaaccccatctctacaaaaaaatacaaaaattaagcaggcatggtggtgcatgcctgtggtcccagcttcttgggaggctgaggtgggaggatcgcttgagcctaggaggccaaggctacagtgagccatgatcacaccactgcactccagcctgagtgacagagtgagatcctgtctcaaaaacaaaacaaaacaaaaaaggtgttgcaggggaggaatgtgttggcttttactctgccttcaggcatggctggatccggggcttcaaacactaattcagaatatctttttttcttttttcttttcttttttaaagtctcactctgtcatccaggctggagtgtagtggtatgatctcagctcactgcaacctccacctcccgggttcaagcaatcgcaatcctcctgcatcagcctcccgagtagctgggattacaggtgtgcaccaccatgcccagctaatttttttatttttagtagagacagagtttcaccatattggccaggctggtctcgaactcctgacctcaggtgatctgcccacctcagcctcccaaagtgctgggattacaggcgagagccactgtgtccggcccagaatatctttttatctcctaacttcacttacctctggaatacatcttcaatcaggttttctctctgtggcaaggtgactctaagcagctgcttagcaactctttcttccctagcaacagcaaaaatcacaagactgattttcattggcttgaattaagtcaggtggccattcctgaaccaattactgtggccagtgtgatgaaggccttccattattgcagcctggatcatgtgtcctgctgtatttttagtagaggcagggtttcaccatgttggccaggctggtctcaaactcctgacctcagatgatccacctaactcggcctcccagagtgctgggattacaggcgtgagccacctttcctggctggccttgggattttttttccccaaataatgcccgttcctacggcacttccttgaggagattttctgcatcttttttccttgtgccaataaaaaagggacagaaagtggggacagactaggagtagagaatactagaacatgctaattctagaattccatagtttctggaatgccagagcttctgaaacatagtagagaggggtctcgaacattaggacatctcggacacaaggatattctggagtgctcatggattaacaatattagagttctcccctgcttatcagagaatccagaatatagaagtttctgacaaaaaggacctgaaaaatcactgattctagaataggggagtgtcaaggggagttcatacccatgaatctccaccggtaggaatatcttgcatgccaggatgtctggaatgctgagaattataggatacagaaaggaacctggattactaggaaatctagagaatgggagagatcctggactatccgcccttccagagcactggaaggtttgtttgcgttccaagaaatccataatggcaggagattccggattatcagagaatctggaacacaaatgggagacgtaaaaggtgagtgcctctgaaaccggggtgttctgaaatagctgtgcacctcaaaccctaattttgtttttgtttgtttgtttttgagacagggtcttgctttgttgcccgggctagggtgcagtggtgcaatcatggctcactgcagcctcggccttctgggctcaagtgatcctcctgcctcagcctcctgagtatttgggactacaggtgtgtgccaccacagccagctactttttaagtttttttgtagagacattgtctcactatgttgcccaggctggtctcaaactcctgggctcaagccattctcctgccttagcctcccaaagtgctgggattacaggtgtgagctaccatgcccagcctcacactctagaaaattttttacatgccaggatattcagaatattgggggatattggcatgttaggaaatctagtatgtagggggagggcctggaaggtcaggaaatctagaatatggtggtgttttgtaatgctcacagatctagaatattagagtcatttttttttccaggccggagaatccagaacgctcgtgttgctgaaatgctggtcattctattcttatttcatgtttaaatttttattattttctttatttcttttttttgagacagggtctttctctgttgcccgggttggagtgcagtggtgtgatctcagctcacctcaacctctgcctcccgggttcaagtgatcctcccaccttagcctcttgagtagccgggattacaggcgtgcgccaccatgcctggataatttttgtattcttagtagagacagggtttcactgtgttggccaggctggcctgaaactcctgacctcaagtgatctgccctcccacctcggcctcccaaagtgctgggattacagacgtgagccggccttattctgggggagggggtggggggggagagagagagagggagagagagaggagaatttgggatgttagcaaatctagaacactgaagagctgggttttttaaatgctagagatagtattatcctagtatagtattaactctgtgtgtttttgtgcgtgagagggcatggggggaggggtggaagattctggaatgcggggggactagaactctgagggattctgaagggttgagatgagttaggattcaagaggtgacatagacacgatcctgggagatagtgacactgatgggagggatggggagctggggactccaaattctagggggaggggaggctaacgccggaagttgcagtggtgagccagaggatgttgcctagcaacaagcattgaagatgcgctggatcccggacagaagggagaaatttcagcagcgcccccagcaaatgctccagccacagggtaggaggtggtgaggggggaagcgggtagggatatgctgtcctgcagggtcatgtgagcaggggtcttgggggttatacaaaaacagggtcatggagtacagtcatggggcagagccgggctctgggacagcccacgaatagctgtgaatggagtgtgagtgccgtcgtcacctgccccagggactgtgtgtccctggacggtgctggacccagatttctgggtgtcagtgtgggatggaggcatggattgctgtaggtggcagtaatggtgtgtagccgtgtgagtcagcctgtgtgtctcacagtgagcgggggtgaagggcttccccgtcagtcctgcacaccctcctggattggaagaaggagcaggagtggggggtggggggtgcaactggatcagttgccattcttggtctggggtgggctctgtggtcacggcgtgtggcctagtaccctgtgtgggtggagcctgggatccacgaggtgggggcggggctaacgctacagaactgggaagcttaagaatccaactgctttgggatatggggcctggaaccccaaagcgaagcaaacatgaaaggggtgggcttgggatcctacatgtggtcacgtcccagttttctgtgggaaagggtgtggcctgaaactctggaaaaagaggtgattaggggcagagtgaagctctgagggtggtgccttagggagagaaggggcttgtatttcagagaatatagggtggagccttgaatttataatgatcttctcaaagaattgatcccttctcaaggccctaggcttcaggggttccaggctcaccatctgcaaaagcttgctccccgaagctctgtccctcagtgaacccagccaggctctgcccctgacccacaggatctgctcccagggggtcctgggggctcctggctctgccccctcctgcacctcacttattgccatccccagagggtatcagacccccttccttgcctgagtctttgaatgctcccaagagctttgagtctcaagctgggcttgagaccctgagtttgaaggcttgaagcctggaaccccggtgtggacggggtttaagggcccctgtggcttgcagctcctagtggtggagactcttaggcaaggaagggatcggtactctcttttatatagttttatgtatttatttattattgagatagggtctcactctatcgtccaggctggagtgcagtgcagtgcagtggtgccatctcaactcactgcagcctccacttaccaggctcaagtgatcctcctacctcatcctcccgagtagctgggactactggctcatgccaccatacccggctaatttttggatttttttttttttttttttttttttttttttttgagacagagtcttgctctgtcgcccaggctagagtgcagtggtgtgatcttggctcactgcaacctccacctcctgggttcaaacgattctcctgcctcagcctcccgagtcgctgggattacaggcgcccaccactgcacccagctaatttttgtattttttagtagagatggggtttcaccatcttggccaggctggtctcgaactcctgacctcatgatccacccgcctcggcctcccaaagtgctgggattacaggcatgagccaccgcgcccggcctaatttttggatttttaatagagatggggtcctatgttgtactatgttgctcaggctcacctcaaactcctggactcaagcgatccacctcggccttccaaagtgctgggattacaggcccgcgccagggcacctagccggaactgggaactctctaaggagaaagtctgcaattctgggtggtgggaggctgctcttgggagcattcaaagactcaggcaaggaagggggtctgataccctctgggggcggcgataagtggggtgcaggagggggcagagccaggagcaccctgggagcagagtttgtggatcaggggcagagcctggctgggttcactgagggacagagcttcggggagcaagcttttgcagatggtgagcctggaatccctgaagcccagggtcttgagaagagatcaattctttgagaagatccaatgtgaacttgggaccctcagaggggcaggacctgggggctggtgcagggttggtgctccatttgcagaatcctcagtctctctcgtggaaaggggtacccgtggggggcttccagcttctacgccagcgagggagctaaattctgaccgaattctcccagaactgggagcagagagctgaggactgccagatggagtccagcttaggggaccctgcccccaaccccgctcccgtatccctcccatttttaagcacccctacgcctgggacctctgttccacgagaaggttcacggagccagtatccgagtcctaatttccccccaccgcgtggggaactcgaggtcccccgcgcccctagtccggcacctgtccctgctgcctcctgattggccgcgcggcgagcgctggcggcgccgggctgtgattggcgggaagttcgcagcccgtggctggactgtggagaaagtgagtcggcctcgggcgggggcgggggcgggggcaggggcggggccggggctagcctgacccgctggacagaccgcccgcccggagcgggactcggcgcccgacacgatgccgaggcctggcaccagcggccgccgccccctcctgctggtgctgttgctgccgctcttcgcagccgccacctccgccgccagccccagccccagccccagccaggtcgtcgaggtcccgggggtccccagccgcccggccaggtaagccccctgcttccttgtgccccttccacccaataagtctggtggtccaggaggaccacggctttcggattcaggggaaactcgaacccactgcttcgatgtggagatgcaaagagggcccttggatttattaggcgccctcaatttgtaggggttagattcggggagtactgagatttttaggggaaagagtcccctttattgtggtggagaaggctaagtctccagagaatcctggggttagttcggggaaaggtctctagtttattggggcagggggtggggggctgagctctcctagaatgatagagacgtgtggggtcttcgagctaggatggagcgccccaagtttcttgggcgcgtaaggaggaaaggtgttgggggattctggagggactttatgaggccgctgagttgtcctggttttctaggatttgggggctctgtgttcatgaaaagcgacctttgggtttttcgaattggtcaggaagacatagactcttgcgttgatggtggaggggcttgtggggagtggggtcgggtgggggagtcctcaggcttcagaacggttggggatgctcaagtttcctagaattagaggactctgggattgaatgaggctccagtgatttcaccgcgagagatccaggattccctatagatctgggggctataggcgcccttcctgtctgcgggtgacgggactgaaggaagccgtctgcccagcacccccacccaccctccccgcctggcggcccagcgctccgttacaaaggccccgggctcctctcccgcctgggtctctgcgaatgcgtttagtaacccgagccgcggcgggggcggggccgggaaggggttaacctggagaaaaggcgggagggatgacggcaagatcggggatccccgaggctccccaccagatggcctcatcctccactcggccccacccacctgagaggggcccacgcgctggacacccccctctctgcacccccccactgctctcctctcggggtctgggcgcgcgccctcgtctctagacccccttagcctggggataatggacttgtctggggggccccttcattgcgacgcacttgaaccggagctggaagctccgccactgagaccctctgggctgggagatgtctgcaagaacggcacctttctcctggtcaggcgggaaactgaggcccaaagaccaagaaacgctggcttctggacacacatcgtggaagggcaagaacgggctagaactcaggctctgggattctcagtcctggactgtgactcccgttatccccctccacctcagcaccctgctggacccacagtcagagggaagagccttccctccccagctgccgaggcctgtgaaaatggcgccacctgtcggccaggctcaggatggcgtctgagtcccggaccgggatgtgcgggagggcggggttctagattcccagacagtgcgggcttagaaatgctcttagaaatcgagtcttttgtttttgtttttgttttttaatcacttttaaaaggctttaaaataacgtattttttcaataaaatcgtacgccaaaatctcttcataagacaaaagtacggtttctgtgcccttcagcccgaagtctaagccaatttgcctcccattgtacagatggagaaactgaggcgtggggagaagaacctcgttagtcatatacctgtttcaagccccctcaggatgcgtcttggtttcccctccccgattgccctcctttgcagagttctggggtgctaggggcctgagtgacttccactccactatttatagcgttgctgtttgtcgctgctgcccgggccagacgtctaggaggagccgctgcatccgaggtgggttctggaagatggagtatgagtagggggcaaaagggaataggaggagaggggcagggagctccccatccctcccctcatcccagtgggagagctggatgcatttggtagagaagtacttggtcccctccttccccacttagtccctggctgtctccgaagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgtgagtgggcagtccctcccctaccaaatcctccctcaggaactcctagctttgcccccgtttccgctcctcctcccttcccctctccctctctctcccccctccctccccggctctttcttttgctatcagcctgtctgtccgtttctatttcatcccttgcctgcctatctcaggctcttcccatctctgcattatttctgtctctttctgtttctttctagttacctgtctcttttcctctctctctttctccctgtgtctcactgcctgcctctatgtctaagtctctctgccccttctctctttctctcccccaacccccatcatctctctttctctcagggtctttgtttctctcccactagaggcctggtccccataaataggtgttgtggggggagggttgggcagagccgctactgaaagacattttcctggcatggaggccctttggtggggaggtcagtttaacccggtgacagcagcttttccgtcctctcccacccaggctccaggaggccagagctctactgaagcggcggcggccccgggggccagggggccggggactactgagaaggaggcccccacagcgtgcccccgctggcaaggccccgggtaagcacatccgcctttcctccgcctggggcgaggggggttccgggccagataaagccgtctggttcccacggtccagccgccgcctacccgccccccgttgtagctcagcacccacccccaggacgaggccccctctagggaccccagcgtccggccgtgcgaggtgagcccgggacaggaccagacacaggccagaggcactgacccgcgggggtggggccgggaagccaggcgtccgggctccccgcggccgaagagggagggcgctggcccgttagaaagctccgccgaaccagcccagacaacaaaagcgattgtgcgggttggcgcctgcctgggcaccaaatgctcaagattgtggggcggctgggggccaaaggcctcctcctgtttcccgaatcttccccctgccctcctcccgctccagctcttgacccctagtctagaacacccctcatctcaaacaccctcaaaaccctcctcttgctgtagccttcagcccagatgtgacccctccccctaaagtcttccagatgtgagcctcgggccagatgttagtacccccgcccacagcctccctttatccattgtgacttctcccgccaggtgtggcgttctggccagatgtggctacatcttcacatgtatcccccccacctccagcctcctgcccaggatctagacgcccaattcctttatgtgcccaggtgtagcgacccttctcccatccctcagatgtcccacctggctgtccagatgtaccatgatagccccctatcaagatgaagcccctttctctgtgccccgggcagaagaggatcaactcttagctgtctccccaaatgtggcccccactactcttaatggatttcctctttatggattcagctctgtctggggggaaacccgcccgcccccacctgttcccttccccgccgctcccctacaggcccggtccacttgttggtgcgcggatggggacagagggggcgccccgctcacccctgcgagtctagcgcccagcctgcgagcctctggctaagcgcccagccccacgcgcccccgcgcggccgccggggagggagtggtgaggagggggggcctgagcgggggcgcgggcgacctcccccgcgggcgggcgggcgggtgcggccgggcccctcgggcgggctggggcggcggcgcggcggagcgcggcgctgcagccatggcgggcggcgtgcggctgctctgggtgtcgctattggtgctgctggcgcagctagggccgcagcctggactgggccggctcggagagcgtctccgcgtgcgcttcaccccggtcgtgtgcggcctgcgctgcgtccatgggccgaccggctcccgctgtaccccgacctgcgcgccccgcaacgccaccagcgtggacagcggcgctcccggcggggcggccccggggggacccggcttccgcgcctgtgagtgcggggtggtggtcccgagagagcggctccgggggggaggaggatccctggggatggaggagacagtcctccagggagagggagcccagattccatatgcaatagtgcaagggaatatcaggggctatttgaggaagggggccccaaattcctggcttttggggttgggtcctgagggttccgattttgcaagcaatgagggttcttagaggcctgtgatgtcccacgtgagggaattggcgccagctttcatgctttgcgtcaaaatggggatctcagaattgaggggcctgagaacttttgggaggggggctcgaattctgagacgctgagtaaggagtccccggggaccaagcaagagtctcaggaccgcatgggggacgtctcagtttctgtgtgtttgggtgggaaggttctgtatgggaatgcctgtgaggtggggtactagagagaagaaagttaatccgaagaactaagagggagaggggacagagacgggggttgtgtgtgtgtgtgtgtgtgtgtgtgtgtgtgtgtgtggcggcgggggtggggtgggggtgtctccgcaggacctgagttgcaggggtcccacgtgcgacagaaatccagataagagggcttacggaaggggcgccccctgggggcggaggggacaggaggtgtatgcaccaggcactcctagagatggggagccttgggggttcaggtgaggtgggggagggcgcaccacctgttgttccaggatgcaaaagtgggcagactctctgggatcgggccttcctgccccctaccccgcagaccctatggagtggggagtgggggcccctggagcggagaactcgcccagcctggcccccagccagcccagcccggccggcgtgagctcatctcccgcctgagcccccgcccgctgccactccctctctcctccccttcctccctctttctttcactctttcccggcccagccccaacgtgcctgtgccaggcgccatgcccaggcgggtgccaagcccttgggggtgcaaggagtggcatgtgaagtgggggctgacctcaaagggacccctatgtcctcaactccccgcttggccagggctgtggggcatgacgttggctgtggccatctagtggcccaccctgggtgtaggcacccccagggagctggcctgcgggcctgcattcaggccaagagaaggcagagaaatgcctctggagcctgggaaataccctcagacctggctggtttcccaccccctccatcagagacccttaccattctgcaattttgattcctagttaagcctctcctaggccccactactcaattaaaagcccccattagaccaccctggagtcatggccccacactcctacctaagggagctgagtttttgctccaggccctagacccgctctccaaccatggcaacagactttagagaccactcctccagtgaaattccctctcattcttccctcccacctcccaaactgtgcctttccccagataactctgtagtattgtccagaagtcctgttcttctagctcacccccttccccaggaacttctgatcccatttatcttcagagaaccccagggttggtcttgataagtgggttctcgcaagaggactccagacattgtgctccttacaggcagccattaataaaaagcctttggcacttaatccttagctgggaggggaggggattccacagagggactcggccaattgagcctcttaagtgctgatgacttccaggaattccacttcactatctaaaccctgttttcagcaccgtcaaactggttgtctcctaggcggcactagagtcctgttttctaggtaactgtccacaaaaggactcctgctgaaaggacgcctcagtttcctctgagctaggttcctccatcccagaaacctccagccgtctttgaactcgagaggactgccctttagtcgatctcctcccaggactccagtccctttatccttctaaacggaggtggctctctgcgtcctttcctctctacagttgtggctcagaatcccacacgcgcctcccccggccgcctgcctcctccctcccctccgcacagctgtctccagctgttctctgcagccccgggagagagagggagggggtgccctcgcaggacagcccggcctcctttggctcaaaggtcccggggctccccaagggtccggaatgtggagcctccgccctgcccccgccgcacctctctctttgtttaccccgccgcacagctggcagtgccccgcccagaggtggcctggggcccagcgagggcgcgcagaggggagtggaggcgcgttcccgctcgtggctccgccccggtgctactggaggctgtaaggccgagctagaactctaaagccccagccagaaagaagttgggcggagacacagcgcggtgggcggaactagggcacccggacagcctggaggtggggtgggaggggcgtgaacaagtgagccgggcgaatcagagtgcggaaaggaaggtgggaggggctagaggcagcaggttaagctcctggataggcggggtttagaatcccgcgggtagaaggtaatgtgagaggggctacaaagggggcacagccagggggcggaggtaggacttcgtggaccaagcagagggagtgtgggcgggcatagaatgcgaaggagacagagttgggcggggagttatgccagggagtggttaaaatgtggtttgagtcaatggaagggatcagcattgggtcggaggggctggaacagcaaagggttccgtcggactacggaatgggcggggtcagcgccgtctgggctggtctggaactccgtggactcagccagaaattgggatccgagaggttgacatgaaagtgaataaacagcctgagggctggctgggctcacgcctgtaatcccagcactttgggagactgaggcagaaggattgcctgagcccaggagttcaagaccagcctggccaacatagtgagaccccgcctctaccaaatttttaaaaaacgtagcccgatgtggtgcacgcctgtcgtctcagctacttaggaggctcagatgggaggatcacttcagcttaggaggtcgaggctgcagagccataatcacgctactgcattccagcctgggcaatagagcgagatcctgccgacttagtgggtgggaccgtacctctgatggctgaacaactggactgggccaatgctgatgccagaattggggcggggccacatgacagctaagggcggagcgacttagaaatgaatgataccttgagggagtagggaccccaggagaacctgccaggaatggtggcgcccctgagtgtcctcgttctcctcccagtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggtgaggaaagggtggccagagtcccctccgacccctgtcaagcatttcactttgcccctgaccctcatatttcccgccttcccgagcacctttgcccagctcgccctccccgccttgtctagccccaccccgtaagaacccgtgtagacatccgtttgcccggccgtgcctcccctaggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaagtgagaggaggcccgtggggaggggcccggagcttgcctccgcgcgggggcgcgctcacccaacacttccccgcagtgcgcgtccccgctgcccgggctccggacgcaggaggtctgctgccgaggggccggcttggcctggggcgttcacgactgtcagctgtgctccgagcgcctgggtaagccccaggacgtccccgaagtgctcggagctggggagtggtgacaacctcaccgttcctcctactctgccctagataaacccagttcacaaattgtagccacgcctaccccattgtggaggcgacttccagtcctgagcttttcataccgctctgggaccacccaccccattttctgactttggccactctgttctcaccctgcctttgtgccttggccccccaccatatactttgggagtctccaatgttgccatttcaactgccaacctaaggctgtccctgcacttaaactacagccaacatcttttagtccctcccaccccgtcttcgtctctgcccactccattctcgctctgcccacctgtccctggcccacccctctcctctcgccacagggaactccgaaagagtgagcgccccagatggaccttgtccaaccggctttgaaagagttaatgggtcctgcgaaggtgcaacggggcaggggtgggaggggcttggttctgggggcgggatttgcagggatcaagttcctgactccacggtgacctccccaaccctggcagatgtggatgagtgcgcgactggcgggcgctgccagcacggcgagtgtgcaaacacgcgcggcgggtacacgtgtgtgtgccccgacggctttctgctcgactcgtcccgcagcagctgcatctgtgagcaaccagcagggagctgaggctgggtcccgccctccctgccctcagaagtcccagagcatcctggggcctttaattccctcggacccccccagactcccgggttcctctgtcagccttagagccccctcagaacttctcagattcttatacagcttcagcatccctggaccacctttagacctttcaagccttttggatccagatccctccagactcccagacttttttttttggagatggagtctcgctctgtcgcccaggctggagtgcagtggcgcgatctcggctcactgcaatctctgcctcctggtttcaagtgattctcctgcctcggcctcccgagtagctagaactacaggcgggcaccaccatgcccggctaaatttttttgtatttttggtagagacagggtttcgccacgttggccaggctggcctcaaacccctggcttcaagtgatctgcccacctcagcctcccaaagtgctgggattacaggcgtaagccactgcgcccagctctcccagactttctggaatccttctcagacccccaaatcctctcgtccccctcaacgactcgactatcttcagatcttgagatccttctcagagtctctcattcaccactgacaccccattgaggctccaagcccttctcagacctccagagcccactgctctccttcagaccctctcagacctctcccaaatgcccctcgcacccaccaaccccccacccccaaccccagaaccattcccctctctcccaaatccctcagtgctacagcattcccagccccgccctgaaggatttcctccctgctcctcgcagcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcaggtgagcccctgcggcagtgcctagccctacgcgcaacacatgtggcgctcattctacgccccaccctccaaccctgagttcactgccccaacctgactggctgggctccagccttggccacgcagcagcctctgagacccgcaggcctcagactggacagcatccatggctccacctccatctgtagccacagccacccctccattcgtagccacagctaccccggagctcccaagttagtttttgtctcctgagcgtcaacgcccagtcccaccctgtccctgaactttgaccaagtccttggcttctgagacactgccttcagcttagccccaccccaggcatgcccctccctgagacacctccctggcattctatcttctgcttaaaactaaatctcacaagggagctatttcctagcctccaactctgtccctgtagacccaaccggaccctgccctcaaccctgttcctaccaccatcccaaatgtgggaaaacgctcttggccccacctgtagcctctaagacattctactctttggccaggacaccaccccatcccagcctccagctcaaacccctgacactctccagccaagccctgcccctagccaaggccagagtctgggctggccatcgttttcttcccgctctcttgtcctctctctgtctctcttacctattcccagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggtgagctggctctggcagaagtgggtgccatcttcaaggggctgccccagccccatagtgaaaggaggcaagagaggatttgggctccactcgttgataccccttctttatcaggctttctgcccacccatcgcctggagccccggcctgaaccccggcccgatccccggcccggccctgagcttcccttgcccagcatccctgcctggactggtcctgagattcctgaatcaggtttgctagaaagaactgagggcattgggcctgcagcagtggctcacgcctgtaatcccagcattttgggaggctgaggagggtggatcaccaggtcaggagttcgagaccagcctggccaacatggcgaaaccctgtctctactaaaactacaaaaattaactgggcgtggtggcagatgcctgtaatcccagctacttgggaggctgaggcaggagaatcacttgaacccaggaggcagaggttgcagtgagctgagatcgtgccattgcactccagcttgagcgacactccatctcaaaaaaaaaaaaaaaaaaagaattcagggcattgatgggggtattacaggtgggattctggggtaaaagactccaaggtgaagattccaggttacagcaaataggaatggtatgggcagagataagcgtttgaagggttgggtggtagttagatcaggagctggagtcacagttgggctcttctgtgtcaatcgagcaagccatttaacctctgagactcagttttctcattggtaaaatggggatggttgttgagatgcctctgaagtgtctgacacctagtaagtgctcagataaatacttatggtagataattatttttcattatctaatattagataattatttctcaggtagggcactaagaatgtatctcaggcggagggttggagagcaaactattcaaagccagagaccttggggtggcatgatgaggggattcggccaaggatctgatgagaacgttccaggataaaaaagatggagatcagaagaagactgggcttgcttggggaggagacatccatgaaggtgttttatggatgtctccgggggtgggggttttactgggatgaaaggaacggaggattcagagatgggggaaccctggctgactggaccccccaggtccctcctccggcatgtgtcagcgcaacccccaggtctgcggcccaggacgctgcatttcccggcccagcggctacacctgcgcttgcgactctggcttccggctcagcccccagggcacccgatgcattggtgagcaagacggagggcgcggaaggaggcggggcggggggctttgcctggtcaccttgtcaccagccccctccgtgtcctcagatgtggacgaatgtcgccgcgtgcccccgccctgtgctcccgggcgctgcgagaactcaccaggcagcttccgctgcgtgtgcggcccgggcttccgagccggcccacgggctgcggaatgcctgggtgagaaatttgccccacccggctccaggcccaccccagggtctcgctcctgctctcactccagagcctctccagccctcccacgcttcccctctcgggtcccgccccaggactgctctgccctggcccttggccctgcccttccctgacccgcctccacccagctccagcctccctttgaccccacccctacccagctcccaaactgccagtttctatcggggcctggtcgcaactcgtattgctccgcccccacgcccaggccccgcccttattggccacgcccctccctgactaactccctcccccaggccccgccactgtcctgcaactgcggcaaccaatctcctgaccgcgaccccgattccaaccctgccacaccagagccctatccccaaactgctcctttcttctctagcccctaccccaccttcccttagcttggtccccaaagctctcctttctgcccttgcgctaccaaaccctgccctccacaattgcctctctcactgtgcccctctccggctgtcctggccgggtccccatcctggctctggcccaagcttggtcccgctcccgcttccctctacccctgcctccttgcgtcgcttctcccggggctgtctgccccagtcccagccgcctggtctgtgcctacagatgtggacgagtgccaccgcgtgccgccgccgtgtgacctcgggcgctgcgagaacacgccaggcagcttcctgtgcgtgtgccccgccgggtaccaggctgcaccgcacggagccagctgccagggtgagggcctgggaggggcagctgggaaggggtgtgagcggttgggtagagcgcagtgatgagggccagagagactgaacaatagggcaaagcgagttgatttggagacagaggccaggctctcgagcagacgtgtggcctgatggcagtagagagagacctgggatgcagaggccaagtgatgggaaacagaaaggctgagtcatgaaagatggagaagcagaatgaggagggatggagatgtcagtaatcgggtaaggggagcagagttatggaggaaaggggagaaggaggccttctcatggggactacagagacagaaccagccaggcagcttagtagggattggtggaggatgcagagtcagatgatggtga

SEQ ID NO: 2464 - DNA, 24729 bp, Homo sapiens
tgcctcagtctcctgagtagctgggactacaggtgtgcaccaccatggtaatttttttgtgttgtcgtagggatgaggtctccctatattgcccaggttggtctcaaacacctgacctcaagcaatcctcccacttcaatctcccaaagtgttgggattacaggtgtgagccactgcacccagttaacttactatttagctgttgattagtgtctagactcagtaaagttagataataatttgtgtaagaatctcctttgtaataactggtctggcatcacagacaagcctgaaagaaatttgccagttttgtatccaatttcccaacataattgcaacatccttccagcccccccaccccccagaatatccactgctccttctttcagccatctctatttttctgctgctttcatcattaatgagttcaataacacctttgacatctgctcaccctgtttttgtatgagtcatgtttgtttgttctttgagacagggtctcattctgtcacccaggctggaggacagtggcacaatcatggctcactgcatcatggacctcctaggctcaagcagtcctcctgcctcagcctcatgagtagctgagaccacaggtcgtgccaccacacccagctgtttttgaatttttggtggagatggagtttcaccatattgcccaggcgggtcttgaactcctgaactcaagtgatctgccttcctcagactcgtaaagttctgggattactggcatgagccaccacgcccagcctggggacatttttttttttttttgagacagcgtcttgctctgtcgcccaggctggagtgcagtggtgggatctcggttcactgcaagctccgcctcccgggttcatgccgttctcctgcctcagcctcccgagtagctgggaatacaggcgcccgccaccacacccggctaattttttttttgtatttttagtggagacggggtttcaccgtgttagccaggatggtctcgatctcctctcctcgtgatctgcccgcctcggcctcccaaagtgctgggattacaggcgtgagacactgcgcctggccttttttttttttttttttttgagacagagtctcgccctgttgcccaggctggagtgcagtggtgggatctcggctcactgcaacctccacctcccgggtccaagcgattctcctgcctcagcttcctgagtagctgggattacaggtgcccaccgccacgcctggctaacttttgtaatttaagtagagacggggtttcaccatcttggccaggatggtctcaatttcctgacctcctgatctgcctgcctcggcctcccaaagtgttgggattacaggcatgagccactgtgcctgaccagggacacattttaaaagttaaaaacatgactcttagccaggtgcgatggctcatgcctgtaatcccagctacttgggaggctgaggcaccagaatcacttgaacccaggaagtggaggttgcagtgagccgaaatagtaccactgcactccagcctgagtgacagagcaagactctgtctcaaaaaaacagaaaatgtatacgtgtgtgtgtgtgtgtatatatatacacacacacacacacacacacacacatatccctgttttatttcatttttattatggggtttttgttgttttctgtttttgtttttgtttttgtttttgttttgagacagtcttgctctgtggcccaggctggatcggctcactgcaacctccacatcccacttccaagtgattctcctacctcaacctcctgagtaactgggactataggtgcccactgccacacctggctaatttttgtatttctagtagacagggtttcaacatgttggccaggctggtctggaactcctgacctcaggtaatccgcccacctcagcctcgggctattttttattgaagaataacatacgtacagaaaaagcatataatcacaggtacgcagcttgacacatttacgcaaagtgaatattctatgtaaccagcagctaaatcaagaaacagaaaattataagcagagcagagtccccgtcctgttcccatgtagtcactggtccttctaaagcaatcaccattctaacttctagctacatacataaatattctcttaatttgtcttaattttctcataaaaatggaatccataatatgtactcttttgtgtctggcttctttcattccacattatgtttgtggcatgtagttatatttcattcattctcatttctctatagtattccacagtgtgactaaactaggtattacatgattatgtggaatgattggaatgctctgacaccgctgcaactttaaataaccactttgcgctgtgtacagtggctcatgcttgtaaccccagcattttgggaggccgaggcagaaagattgcttgagcctagaggtttgagaccagtagggcaacatagtgagtccctgtctctacaaagaataaaaaaattaacaaaccatggtggctcacgtcagcagtcccagctacttgggaggttgagggaggaggatcacttgagtccaggaggtggaggttgcagtgagctggaaaacaaaacaaaacaaaacaaaacaaaaaacagaaaagaaaagaaatagcccctaagtggccagatgcggaatcccagcgctttgggaggccaaggagggcggatcatttgaggtcaggagttcgagaccagcttgacctacatgtcagaccctgtctctactaaaatacaaaaattagctggacgtggtggtgggcacctataatcccagctcctcgggaggctgaggcaggagaatcgcttgaatccaggaggcggaggttgcagtcagccaagattgtgccactgcactctagcctgggtgacacagccagattccttatcaaaaacaaacaaacaaacaaaaaatgcccctaactgggaactgcttaaatgtccataataaaagaagacaggggccaggcacggtggctggtggctcatgcctgtaatcccagtactttgggattcctaggtgggcagatcacttgaggtcaggagttcgagaccagcctgaccaacatggtgaatatccatttctactaaaaatacaaaaaatttagctgggcgtcatggggcatgcctgtaatcccagctactcgggaggctgaggcgtgagaatcgcttgaacctgggaggtggagattgcagtgagctgaaattgtgccactgcactccagcctgggagacagagtgagactctgccttaaaaaaaaaaaaaaaaaagaacagtgtattgtactgcacgcacatattttgtgcatctgctgggttataagacctaaatggtagagtcatttgcaccacatcctggacaggctagagaatctcctcttgctctgggctccaccggccttacagttcacttcgctgatgagtgagagcaggtctcccggccatgatacaagctgcccccaaaattccaaagggctttttcttaccaccttttccatcaaaggatgggggtataggggatgaaagtttcagtagcttgccctgtgtttagggaaaaaacaaaattctaacaaaactcttctcccggacctccaaaatatctctgggctggcaggtctctgtattttttttttttttattgaacttccttaaatgcacataagtcagctaatacttccatggtacctgtttctttctgctcttggtacatcgatattattattattataattatttaattattatgaaacaaggtcttgctctgtcgcccaggctggagtacagtggcacaatcacagatcactgcagcctccacctccttggctcaagtgatcctccagccttagcctcctaagtagctgagaccacaggtgcacaccaccatgcctgataattttttttttttttttttttggagacggagttgccctctgttgcccaggctggagtgcagtggtgtgatctcagctcactgcaagctccgcgttccgggttcacaccattctcctgcctcagcctcctgagtagctgggattacaggcacccgccaccactcccggccaattttctttcttttttttttttttttgtattttagtagagacggggtttcaccatgttagccaggatggtctcgatctcctgacctcatgatccacctgcctcagcctcccaaagtgctgggattacaggtgtgagccaccgcgcctggcccaatacccggctaattttgtgtgtgtgtgtgacgcagtctcgctctgtcgcccaggctggagtgcagtggcgctatctctgcttgctgcaagctctgccttctggcttcatgccattctcctgcctcagcctcccgagtagctgggactacaggcacccgccaccacgcccggctaatttttttttttgtaattttagtagagacggggtttcaccgtgttagccacgatggtctcaatctcctgaccttgtgatccgcctgcctcggcttcccaaagtgctgggattacaggcctgagccaccgcgcccggccaattttgtatttttagtagagatggggtttcaccatattgtccaggctggtctcaaactcctgacctcgtgatccgcctgcctcggactcccaaagtgctgggattacaggcatgagccaccacgcccagccagaattttttcttttttctagagaagggggtctccgtatgttgcccagtctggtcttgaccacctgaccttcattgattttcctacgtcggcctcccaaagtggtgggattacaggtgtgagccactgccaccggccagtaattatgctgatgaaagacctgttttttctccagttcctgggatggctctagggagggttatttacactgtgagtgaggaggcattcacagagaagttcctccagagtgtggaagaagcactaccatttggcaccaacgcctggagaacaaaggaggagaccattggccaaagagaggcatttccattttgttggaacctgctgaccaccaacccatagcattttttccctttcttccttgctaatccaatcgcagattcattgaggaggtgagaggtcctgagatccaggctggaagaggagtgattggtctacctggttctcaagggataatgttgccccctagaggacattttggaaattattaaggaaaattaacgactggttttttggttgtcatctggttctcaagggaacagtattgcttccttgggagaatttggaaacttaccttttttcatcgtcacaatggtgaagggtttgttactgggattagaggacaaggaccagacatgccaagatgttctacaatatagcattcctaattaataatcacctaatgaataaagctcagatagcacttaaaaagtggggaaaggactgtttatactaaattatgctaagctgtaacactgaactattccagttcttttgaaattgtttacatagcaaaatcatagttgactcctggccatttaagacttatgccaccactcttgggatagtgaaaatgttttgcaactagattgaggtggtgattgtataatatggtgaaagtactaaaagccactaaattgtgcacttcaaaatgctgcctaattttatattatgtgaatttcacctcaataaaaatgtctttttttttttttttttgagagggagtcttgacctgttgccaggctggagtgcagtggcgcaatctcagctcactgcaacctccacctctcaggttcaacccattctcctgcctcagcctcgcaagtagctgggactacaggtatgcgccaccacacccagctaatttttttgtatttttagtagagacagggtttcaccatgttgaccagcatggtctcaatctcctgaccttgtgatccacctgcctcggcctcccaaagtgctgggattataggtgtgagcccccgggcccagccaataaaaatgtttttttaaaaggatgcatatttccaaacatgagactataccatcacatttaatttttcccagaaactataaaaagtagaagtgaagagaggaaagggagacacttttagaccttcaatgagtctgcaagtacaggagaaaataatttatgcagcaattagctttattttcagggctctttttcttttcttttttttttgttgagacggagtctcgctcttttgcccaggccggagtgcagtggcgctatcttggctcagtgcaagctctgcctcctgggttcataccattttcctgcctcagcctcccgagtagctgggactacaggcacccgccaccatgcccagctaattttttgtatttttagtagacacggggtttcaccgtgttagccaggatggtctcgatctcctgacctcatgatccgcccgcctctgcctcccaaagtgctgggattacacgcgtgagccaccgcgcctggccaacaaagtgatcattttacaagagttatggcatagtcacaggtaagaacctgggtcactgggtcactccctaaccaattacgaattactatatgccatggaccttcaggattactttcttttttgttttgtttttgtttttttttttgagacagagtctcgctctgtcacccagaccggggtgcagtggcgcgatctcagctcactgcaacctctgcctcccggattcaagcaattctcctgcctcagcctcccgagtagctgggattacaggcatgtgccaccacgcctggctaatttttttgtatttttagtagagaccgggtttcaccatattggccaggctggtctcgaactcctgaccttgtgatccacccaccttgacctcccaaagtcctgggattacaggcgtgagccaccgcgcccagcccaggattactttctttctttcttttgagacagagttttgctcttgttgcccaggctggagtgcaatggcacaatctcggatcactgcaacctccacctctcaggttcaagcgattctcctgcctcagcctcccaagtagctgggattacaggcatgcggcaccatgcctaaaattttgtatttttagtagagatggggtttctccactttggtcaggatggtctcgaactcccgacctcaggtgatccgcccgcctcggcctcccaaagtgctggtattacaggcatgagccaccgtgcctggcctctatttttctttctataatccatgtacattttcctttaataatataaggcaactaaacagcactttattttcagaggcttatctaaaagatacttgacacagccctttgcagctgggtcattctctgaattctaaatgtcgtttcctgcacaaagtggttatttgatcttgtaactggcattttccccggagattaggaagtggcacaccaaagtgcaaaaaactttggaatcagaactttaatttttaatctttattttatttatttatttatttttgtgacagagtctcgctctgttgcccaggctagagtgcaatggcaagatctccactcactacaaactccacctcccgggttcaagtgattctccgccttcagcctcctgggtagctgggatcacaggcgcacaccaccacactcggctaatttttgtattttgagtagagatggggtttcaccatgttggccaggctggtctctaactcctgacctcaggtgatcctcccgtccatgcctcccaaagtgctgggattacaggtatgagtcactgtgcccggcctaatttttatatttttttgtagagacggggtctggctgtgtttgacagcctcaaactcctggcctcaagtgatcctctcaaagtgttgggattacagacatgagccacagtgcctggcctattgaaagcttttccatcataataggtccttccccccaatgcttgcagcaagtcaatagtaggagaccccaggttgcagcagagaaagaggtttaatcataggggccactgaaaaccaagagaggagatggaaggaaccacgaatccacttccccagggagttcggggctttttaagggttttggagtgggttgaagtgtggaggtcattggttggttgaagtgtgcagggtgaagtaatgaaacagggagttgaagaaactctattctcctgtcgatttggttcctctgcggggtcttcacactggttggtatcagctgttttgctggaattcaggatctgaaaaatatcttaagcttttttttttttttttttttttttgagacaaggtctgttgtccaggctggagtgcagtggtgccatcatagctcattgcagcctctaacgcctgggctcaaaggatccttccaccttagcctcccaagtagctgggattacaggcacgcaccaccacacccagctaattaaaaaatttttttttttgtagagacaggggtcttgtcatgttgcccaggctggtcatgaactcctgacttcaagtgattttcctatctcagtctcctaaagcgcatggattacaggcatgagccaccatgccgggcgctaagcaattcttattatttatttatttatttatttatttatttttttctgagacggagtcttgctctgttgcccaggctggagtgcagtggcgcgaactcggctcactgcaagctccatctcccaggttcatgctattctcttgcctcagcctcctcagtagctgggactacatgcgcctgccaccacgcccggctaattttttgtagttttagtagagacaaggtttcaccatgttagccaggctgatctcgaactcctgacctcgtgatccgcccacctctgcctcccaaaatgctgggattacaggcgtgagccaccacctccggcctaagcaattcttaaataaaaatctatgattccgccaggcatggtggctcacacctgtaatccgtgcactttgggaggccgaggcgggtggatcacaagttcaggagttcgagaccagcctggccaacatggtgcaatccctgtctctactaaaaatacaaaagttaggtgggcatggtggcttttttttttttttttttagacgggagtctctgtcatccatgctggagtgcagtggcaggatcttggctcactgcaacctctgcctcccaggttcaagcgattctccggcctcagcctcccaattggctgagactacaggcgtgtgccaccacgcccggctaattttttagtattagtagagatgggggtttcaccatcttggccgggctggtctcgaactcctgacttcgtgatctgccctccctggcgtcccaaagtgctgggattacaggcatgagccactgtgccctgccaaaaagcctatgattctaacatcagaaatccttccacctcagcctcccacgtagctgggactatagactcagtaccaccacaccaagctaatttttgtatttttaatagagatagcgtttccctatattgaccacctggggccatccctggttttttttttttttcccttccttccttcctttccctctctctttccctccctccttccttcctttctttctttctttcttttttttttttttttacagagtcttgctctgttacccaggttggagtgcagaggcatgatcttggcttactacaacctccgcctcccggattcaagcaattatcctacctcagccttccaagtagctgggactacaagtgtgagccaccatgccctgctaatttttttatttttactaaagacgggatttcaccacattagccaggctggtctccaactcctgatttaaagtaatctgcctgccttggccttccgaagtgctgagattacaggtgcgagtcaccgtgcctggcctattcctgttttcttaacgctcctctctcccactgggccgtgactgcctctaaggcagagatgtgttcatttttattattattgtatgtccagggctgggcacaaagtgcaacacatagtagggacatgaaaggctgggcacagtggctcatggttgtaatcccagcactttgggaggcagaggcgggaggatggcttgaggccaggagttggagaccagcctaggcaacagagggaccccatctctatgaaaaaaaaaaaaaaaaattgacagttcaatgtcacctctgataagccttccctgaccacccctgttactctgtagccccatgtcctgctttatttttctccaaagcatttatcatcgctgggtttatatttatttctcttcgggcttttctcactggatcgtaaactccatgaggacagggctttgtcgatttcactcaataccgttattttacaacatccctattgctgggatctcagtatgcactccttaaatatttgcagaatttaagtgccacataagtgaccacgtgggcaacgccctcggggccttaagccgcgccatttttggggctaggattggttggaccctccgtcacgtgacatgcagtcgccggatcgcctttgagtctcgtgaggtacttttggtcccaggctccgcggacgaggtactgcgcaggcgtgggagggtctgcgcatgcgcagaagcactccgggcgtgctgccggcggcggtaggtggcgcgcgggtccggcgggcggttggcttgagcgggaccggagctgaggcaggaagagccggcgccatggtggagaaggaggaggctggcggcggcattagcgaggaggaggcggcacagtatgaccggcagatccgcctgtggggactggaggcccagaaacggtcagggccggcgcggcttgaggccgctagggtctggagggggcgtctattctgaggcgtttgcggcccggaaggagcgggaaggtgtgatttgaagggaggaggcgggaattctgtgctctgggatcgtctctctcttggggggactggaggagttgattggggatgtttctggaaggtctgggaagtggttgggagggccgttccgaaggatgggagctctgaagggggcgttggggagtcctgagagagcgggagaattcaaactcaggaaatccgaggcccgaaagcggtgattgtggggtttgatcgcggttaggggataagaggggctggggatacgtggaaagggtgaggtgagggacgcagttcattcattcgagggtatgggacctggttccgtgctgcacacaggggagactggactggccaaccggacagacgggagcttacactcttgtgggagctcacgggcgggccagtctgagagaatgcgggttttgaggagttttggagcaagttatctcaaatgggaatcttgagaggctcggagaggctggagggggacggccgtaggctcccgaaaaggttgcttgtgtttggtatggggctgtgtcttgataggacaggagacgtagtttgggcattgtggagtagcttagggaattctttttttttttttttttttttttgagatagtctctctctgtcgcccaggctggagggcagtggcgcgatctcggctcactgcaacctctgcctcccggattcaagcgattctcctaactcagcctcccgagtagctgggattataggggcccgccagcacgcccggctaatttttgtatttttagtagacacggggtttcgccatattgacgagactggtctcgatctccttacctcaagtgatccacccgcctcggcctcctgaagtgctgggattacaggagtgagccaccgcgccaggacgtcttttgttttgtgcagttgggtgacctcggttcactgcagcctctggcctcccgggttcaagacttcctctcacctcagtcttctgagtagctgggattacaggctcgcgccaccatgcctggctaatttttgtatttttagtagacatgggttttcaccatgttggccaggctggtctcaaactccggacctcaagtgatctgcccgccacagcctcccaaagtggttggattacagacgtgagccactgtgcccagcttgttttttttttttttctttctctgtggcccagtggagtgcagtggtgggatcacagctcactgtagcctcaacctccaaggctcaagggatattccctcttcagcctcccaagtagctgggactacaggcgtgccccaccacatcatccgactaatttttgtttttttttttttttgtaggatggggttttgccatgttgcccagactggtcttgaactcccaagctcaagcgatcctcggcctcaagagatctccccccatctcagactcctaaaatgctgggattacaggcatgagctaccatgcctggcctcattgatcaatatttttacttagcctggacgcagtgactcacacctgtaatcccagcactttgggaagctgagttggggggaggggacctcttgagcccaggagtttgagactagcctgggtaatgttgccaaacccagtctctacaaaaaaatacaaaaattagccaggcatggtgacataagtttatagtcccagcttgtcaggagactgaggtgggagcatcacctgagcccctgggaggtggaggttgcagtgagccatgatcacaccactacaccccagcctgggtgacagagtgaggccccgtctcaaaaaaaaaaaaaaaatccacaagcgtgtgtatatgtgtcagttattaaaggatggtgaagtgagagggttgttttgataggttggccagggaagggctctgaagaggtaacattgagcctcagacttatatgggaaagagccctgtggtcatctgggagaactttcctagctaagagaacagcaagtgcaaattcccagaggcccaggcatgattgtcaaattagagaaataaggtggcaggaaccaaatgatttgaggagtagcttttattctaagtgtgtgggaaaacctgttggagtgttttgagtgtgggagtaacatgatctgttttttgtttgttttttgagacggagtcttgctctgtggcccaggctggagtgcaatggcacgatctcggctcactgccattgcagtgaatccgcctcccaggttcaagcgattctcctgcctcaccttcctgagtagctgggactatcggcatgtgccacaacacccggctaatcttgagtatttttagtagagacggggtttcaccatgttagacaggatagtctcgatctcctgacctcgtgatccgcctgccttgggctcccaaagtgctgtgattacaggcgtgagccactgcggcctggcctggtttgtgttttaaaatgatcgctccagaataggttaaagtggtcagaaatggaagtaaagattctggctggactgttgcagtaatccagttgagataaaaatattggtggcttgaaactcaagagaaggggtcaaataaatatattctggatatattttgaaggtagaagagggaacagaatttggggcagaagtccaggatgacaccactgtttttggcttgagcacctacctggaacgatggaattgccattttgaaagatatggagagctgtaggtttggtggggtcggggaagagtcagttctcttttaggtttcagatttgttttttttgtttgttttttttttttttgagacggagtctcactctgtcgcccaggctggagtgcagtggcatggtctcggctcactgcaacctctgcctcccaggttcaagcaattctcctgcctcagcctcccgagtagctgggattacaggcgcccgccaccatgcccagctaatttttgtatttttagtagagacggagtttcaccgtgttggtcaggctggtgttgaacccctgacctcgtgatccacctgcctcggcctcccaaagtgctgggattacaggtgtgagccaccatgcccggcctcagatttgtttttttatacaactaagtagaaatatgtgaggggttgagttcagaggtaaaatttgggtgatggtgggtattgtgtgagtacagagtatagaattaatggaggggttggggaggcagacacgtcaggagaatttagtttgagggggtgggagctttcagaaggttttagagggtgcagtggtgggatgggaattacctcaggctcatttcagatctgtggggtcttctttgatggggtggggggatgtcatcatgaggcattaacattggtgggagggttgaaggcacctggaatagattgggaattaagtgatgagaatgtgcctctggacataggtggactgcattgattttagggactgctattttctggatggagtggaaagaggatttatgtgagttggaggaaactttgaggaagcttggtgtgttctgagatcctaaagggttggggaggggattctaaggtactggaagggttaatcgaaggggtttgcggcagcagatagctttgtttgaagtggggcaaagttggtgaggtttaaactggaatgtagttagggaactttcagagggatggggatgatttttctgagaagcagtgaagaatggatgggggcctctgagtgggagatgacctaagggacaagtcagggtcagggcatggaatttgtgggaggtaggaattattctgagggagtggagctgtaccaaatttggtggagaacatgaaaaggattggctgggggttgcaggagggagggaagaggttgtttgtaatttgtactctatttttagacagtcttagagagtttattaaagtgttttttgtccattttcagccgaggtttttagaaattaaaaatttttttgtgtgagtacatagtaggtgtatacattttgggggtatgtgagatactttgatacaggcatacaatgggtaataatcacatcagggtaaatggggtatccaccaccttaagcacttatcctttgtgttacaaacaatccaattatattcttttagttgctttgaaatgtacaacaaattattgttgactgtagtcaccctgttatgctatcaaatactgtatcttattcattgtatttaattatatttttgtatccattagtcatccctccttcccctccaccccccactacccttcctagcctctggtaaccctcagtctactatctgcatgagttcaattgttttaatttttttagttcccacaaataagtgacagcgtgcaaagttttctttctgtgcctgatttatttcacttaacataataacatccagtgccctccctgttgttgtaaatgacaggatctcattcccttttttttgtagacagggtctctctgtcgcgcagactagagtgcagtggtgtgatcacaactcacttcagccttgacttcttgggctcaggtgatcctcccacctcagcctcccggtagttgtgactatagcacgtgtcacaagcccagctaatattttagtacaggtggggtttcaccaggctagtctccaactcctgggctcaaataatcctcctgcctccctgcaaagtgctgggattagaggcgtgaacagcaatgcccagcctttgtaccacaatttctatttttttttttgaaacggagtctcgccgtgtcgcctaggctggagtaggctggagtgcagtggcgcagtcttggttcactgcaagctccgcctcccaggttcacgccattctcctgcctcagcctccctagtagctgggactacaggtgcccgccaccacgcccggctaatttctgtatttttagtagagacggggtttcaccttgttggccaggatggtctcaatctcctgacctcgtgtaccacaatttctttatccatttgtctgttgatagacatatgggttgctttcaaatcttggctattgtgaagagtgctgcaataaacatgggatttattgcagttttttttcttttgagaccgagcctcgctctgttgcccaggctagaggacagtggcacgatctcagcccagtacaatctccacctcccaggttcaagcgattctcctgcctaagcctcccaagtagctgagattacaggcacctgccaccacgcccggctaatctttgtattttttagtagagatggggttgctgtgttggccaggctggtctcaaactcctggcttcaggtgattggccctccttggccccccaaagtgttgcaattacaggcgtgagccaccacacccagcctgatttattttcatttgggtatatacctagcagtgggattgcatttttacccgagtcttttttttttttttttttgagacggagtttcgctcttgttacccagactggagtatggtggcgtgatctcagctcaccgcaacccttgcctcccaggttcaagcaattcttctggttcagcctcccaagtagctgggattacaggcgtgtgccaccatgcccggctaattttgtattttagtagagacgggattcctccatgttggtcaggctgtgaactcctgacctcaggtgatccgcccgccttggcctcccaaagtgctgggattacaggcatgagccacagcccccggccttcacctgagtcttatagcagctctctggagtcggaagggcagtgatttccttctctgttcagatgaggaaggaggctccacagagcaaattgacttgcctctaagagggctctaggtgggataggagggttctaggtgggataggagaactctggagactggagttcctttatgaaacagaagccctggaaatgggcaggctgataaaatgtacaaattgtggggcattttataagacagttatcctacttctcttccaaaagtcagtttcatgggaaaaataagtgaagggactgttgtggattaaaagagagtaaaggccgtcacagtgactcagcctgtaatcccaggactttgagaggccgaggtgggtggatcacctgaggtcaggagttcgagactagcctggccaacatggtgaccgtctctactaaaaatacaaaaaaaattagccaggtgtggtggtgggtgcttgtaatcccaactacttgggaggctgaggcaggagaattgtttgaatccaggaggcagaggttttagtgagccaaggtcacactatcgcactccagcctgggtgacaagagcgaaactctgtctcaaaaataaataaataaaataaaataaagtaaagaagcagcttcctagagcagatttggttgcttaaattgaggccaagtttctggagtttttattgatagttgacaattacaactaaaatttttttttctcgctctgttacccaggctggagtgcagtgacgcagtgacgtgatcttcagctcactgcaacctccacctcccgggttcaagggattctcccgcctcagcccccaagtagctgggaccacaggcgtatgccatatcactcagctaattttgtgtgtgcatggcgtatgccgtaacactcagctgattgtgtgtgtgtgtgtgtgtgtgtgttgttttttttttttttttgtgatggactctcactctgtcgcccaggctggagtgcagtggcacaatcttggctcactgcaacctccgcctcctgagttcaagcgattctcctgccttagcctctggagtagctcggattacaggcgcgtgccaccacacctggctgatttttatatttttagtagagacggggttttaccatgttggccaggctggtctcaaactcctcacttcaagtgatctgcccacctcggcctcccaaagtgctgggattacaggcgtgagccactacacccggcctatgtgtgtgtattttatttttttatttttttgagacggaatttctctcttgttgcccaggctggagtgcaatggcgtgatctagactcactgcaacctctgcctcccgggttcaggcaattctcctgcctcagcctcctaagtagctgggattacaggcgcctgctaccgcgcccagctaatgtttgtatttttagtagagaccaggtttcgccatgttggccagggtggtcttgaactcctgacctcaggtgatctacccgcctcagcctccttaagtgctgggattacaggcatgagccactgcgcctggccagaagttaccttctttgtgcctgttttctcagctgcaaaagaggggtaacaaagtgccagcccattagattgtcatgggaattaaatgacataatacatacaaagagcttagtagaacagtgcttggcacatagtaagtgttagataaatgttggccattattattttattatgtaccagatttctataattctgctgatggacacaggtttgttttggtgtgtctattaattcacagccatttgagtaacagtatgtcctaaatgccaaggaagttactggttctagtgatacagtggtttctggagtttacattctaatggaggagggggcagtaaacatataaacaagtagtgtagcttagcacagtggtgtgtggctgtgatcccagctactggggaggctgaggttggaggatcacttgagccaggcaattgagactagcttgggcaacttagtgaggccccatttcaatcaaaacagtgggcaacacagaccccatcttaatcaaaacaaaaacaagtagcataattcgagatagaagaggatgtggacctattttaaattaggtggccagtatggacttctctaaggaggtgacaattgagctgagacctaaagaatgtgtcccttaagaagttgagggaagaagcaatgggaagcactaatgccaaggtcctaaggtgggagcaaggatgggagcaaggatgatgttctctaggatcagcctcccgagtagctgggactacaggcacgtgccaccacgcctggctaatttttgtattttgagtagagatggagtttcaccatattggccaggctggtctcgaactcctgacctcaagtgatccgaccgcctcggctaattttgtgtatttttagtagagacggggtttcaccgtgttagccacgatggtctccatctcctgaactcatggtcctcccaccttggcctcccaaagtgctgggattacaggcgtgagtcgccgcgcctggcacacccagctaatttttttttgttttgtacagatggagtcttactttgttgcccaggctggtttcgaactcatgggctcaagtgatcctcatgccttgccctcctaaagtgctgggattacaggtgtgacccactgcgtccagcctgctgtagttttgtcggagagaaacgatggtggctcagactagagtggtgtttgtggaacttgagggaagtagatggacaatgctgctgtgaatgtgtatctttttttttttttttttttgagacagagtctcactcttgtcacccaggctggagtgcagtggcgcgatctcggctcactgcaagctacaccttccgggttcacaccattctcctgtctcagcctcccgagtagctgggactacaggcacccgccaccactcccggccaatttttttttttttttttttgtatttttagtagaaacggggttttaccatgttagccaggatgatctcaatctcctgacctcgtgatctgcccgccttggcctcccaaagtgttgggattataggcgtgaggcaccgtgccctgctgaatgtgtatcatttttgtgcccacttgggtatttctttttttttttttttttttgagacggagtctcgctctttcgtccaggctgaagtgcaatggtgcggtctcggctcactgcaacctccgcctcccgggttcaagcgattctcctgcctcagcttcccgagtagctgagattacaggcgcctgccaccactcccggctaattttttttttttttctttttgaaacagacccttgttctgttgcccaggatggaatgcagtggcgccatctcggctcactgcaaactccacctcccgggttcacgccattctcttgccttagcctcccgagtagctgggactacaggcgcccgccaccatgcccagctaattttttatatttttagtagagatagggtttcaccttgttagccaggatggtctcggtcttctgacctcgtgatctgcctgtctcggcctcccaaagtgctgggattacaggtgtgagccaccgtgcccagcccacgcccggctaatttttgtaattttagtagagatggggtttcaccatgttggccaggctggtctcgaactcctgacttcaggtgatctacccaccttggcctcccaaagtgatgggatttgtaaacccagcactttgagggaggcagaggcaggaagattgcttgagcccaggagctggagatgagcctgggcaacatagtgagaccctgtgtctacaaaaaaaaaaaaaaacccataaatcagccaggtgcagtggtgtgcacctatagtcccaggactcaataggccgaggtggcgggatcacttgaacctgggaggttgaggctgcagcgagccctgatcttgccactgcccttcaatctgggttcacagaatgagaccctgtttcaataaaacaaaacgtaaacatggtatttggtgttgatggcagttgagtatttaatttaatttaatttaattttttttgagacggagtctgtcacctgggatggagtgcagcggcacagtcttggctcattgaaacctctgcctctcaggttcaagcgattctcctgcctcagcctcccaaatagctaggattacaggtgcccgccaccaacatgcccagctaattttttttttttaaacagagtctcgctgtgtcacccagactggcatgatctccgcttactgcaacctccgcctcccaggtttgagtgattctcctgcctcactgtcccgagtaactgggactacaggcgcctgccaccacgcctggctaatttttgtattttctgtagagacacggttttgccatgttagccaggctggtctcgaacccctggactcaagtgatctgcccgccttggcctcccaaagtgctgggattacaggcgtgagcccccacgcctggccataattttttttgtatttttagtagagagggtgtttcaccatgttggacaggctggtctcgaactcctgacctcaggtgatccacccatctcagcctcccaaagtgctgggattacaggcatgagtcaccgggcccggctgaataatgaattttaaacaactgcagagcagtctgtagagctatgtaggaatgtaggtcgtggagagcagatttattgtcagggactttttatatgtagctgttgctggaagagttcggggagggggagtgcttgctggtattgactcagccatgataaaaaagcctttttttgaggaaatggcattggagttgggttttgaaggggaaaggcgtaggtaggcattgagaggaagaaatggtgcattttgcgagggtggaatgttgtgattaaattttatttaatttttaattaaattaatagcaaactcttaccagcagaacttaaattgtgtgaaaattattcttagttattactaaatccttttcagtatgaataatacatttgctgcagaattattaatgagtttggttacatgatgcagcccaagatcttgatgagttgtttcataatacatgatgtaaagtctgtatttcctttttgaaatctgaaaaaattgtgactctgaaatacttctggttcaagagatttcagataagatatagttgacctattctgcttcctactgacctcagagaagtcttgggatggcctgacctctgattgccttttttcagcctcatcttctgtcactttacagatttaaaaagctaaaaacaaggctgggcacggtggctcatgcctgtaatcccagcactttgggaggctgaggcaggtggatcacttgaggtcaggggttcgagaccagcctgaacaacatggtgaaactccgtctgtaccaaaaatacaaaaactagccaggcgtgacagtaggcgcctgtaatcccagctactcgggaggctgaggcaggagaattgcttggacctgggaggcggaggttgtagtgagctgagatcacgccactgcactccagcctgggcaacagagcgagactctgtctttaaaaaaaaaaaaaaaaaggtaaaagcaattcctgtgtacatgctcttttcatgccaccatgtgttttgcttgtgtgttatacttaactagtgcctcttctcagcacctcttctgctgtcatgctagtttgagccaccatcatcctccctcaccttaactgtgacatcttcctacccccatggctttccatcatgcctcgaagaaaatccagaatccttccattgcatgtaagagccttcatgatgtggccccttgttccaacttttcagcctctctgtcattcctgtccctagaacatgccaagcactcctgcttcagggcttttgcatttgctgttttctctatctggaatgttctgctgccaaatatctgtgtgtttgtcctttatttcattttgatttttgctcatatggcatctcctcagaaaggcttgtatgatttctgtctcaaatagcgttctccatcattcttgattcttgtcacacttgattttcatcactttttcacatattatgtatctatttgtttatctgtctcctactttttcatgagggcagggactatgtctgattcaccgccttatttccacaccatagaaggatgcctggcatagttggtactcaataaatatttgttgaatgaattgttttgtgcagtatggattagagcctgtctctttcctagattcgaggtgtgatgcctcaatgcagttagaaccaaaatgatttttttttttttgagacggagtctcactcttgttgcccaagttgaagtgcagtggcatgatctcggctcactgcaacctccgcctcatggtttcaagtgattctcctgcctcagcctcccaagtagctgagattacaggcgcctgccactacgcccagctagtttttgtattttagtagagacggggtttcaccgtgttggtcaggctggtctcgaactcctgacctcaagtgatccgcctatctcagcctcctaaagtgctgggattacaggcatgagccaccgtgcctggcaaaccaaaatgatttgtgtattttttgttcttctgtgattctgcaagctcactgttctgtatcatcaggttaacaatgtttgtcttacaggctgcgggcctctcgggtgcttcttgtcggcttgaaaggacttggggctgaaattgccaagaatctcatcttggcaggagtgaaaggactgaccatgctggatcacgaacaggtgcgctgttgtgagctcattcctcccctgctctggctcccctttccagcatgaagatctgcagattttgtgagttcctccttgtgccttaagggctgtgaaaggagggctaacattaataaaccattgcctctggagactgaaggtgctattgttgggtttgaattctagctccaccacatctagctggatgagcagtagagactcacaccccctcattgagcttgcctgcctgtaaaatggggttagtaatatctcccttggtggttgcttgtgaggaggtgtagagaagtgtttttccaatttgtgcctaaaaatgacctgagtgactaactgaaaatgcagagtggcctggaggcttcgtggtgccctagctttcacccctagtgattctcatttaggtctgaggcgagctcaggagtatgtgcatttaaaaggtgttttagggctggacgcagtggctcatgcctgtaatcccaacactttggaaggctgaggcaggcggatcatctgaggtcaggagtttgagactagcctggccaacatggcaaaactctgtctgtactcagtatacaaaaattagccaggcatgttggtgtgcacctgtaatcccagctactcgggaggctgaggcacaagaatcgcttgaatctgggaggtggagtttgcagtgagctgagatggcaccactgcactccagcctgggcaacagagtgagactttgccttaaaaagaaataaattaatgaaaggtgtttcaggagattatgatttagatggtccacagacatcactttaaaaaacactggatcaggccaggcacagtggctcatgcctgtaatcccagcactttgggaggctgaggcgggcagatcatgaggtcaggagatcgagaccatcctggctagcacggtgaaaccccatcactactaaagacacaaaaaattagcagggcttggtggcgggcgcctgtggtcccagctactcgggaggctgaggcaagagaatggcgtgaacctgggaggcggagcttgcaacgagccgagatcatgccactgcactccagccttggcaacagagtgagactccgtttcaacaacaacaacaacaaaaacaaacaaaaacaaacaacactggatcagagagaatgtgggcagactgctttgtatagtgcttgaacctaacaagtatccagtaattaggaataatgatctgacatgctgtttgtttgtttgtgtgtttttgcgagacgagtcttgctgtgatgcccagactggagtgcaatggcgcaatctccgcacactgcaacctccgcttcccgggctcaagtgattctcctgcctcagcctct

SEQ ID NO: 2465 - DNA, 61936 bp, Homo sapiens
aggcttcaggaggtgtcgcctgaaggcatccctgctttgacggatttcctgccatgctgctcttctctaagcgcttctcagcctgctcaatccttctccactttgctgaatgtttttctgaccccctcccccacctccttcagccacagaccaatactctgcttggctttctgtcccgtcctgcagctgtgtggtatcagagagcagaaccttgcaaaagataaaggcagtagagaagtggcaagtggaaggagacactcttgtgtgagccattttacctgctatttttcgtatgtgtcctcactggatcctcacacctgtgagttagggtggattatacccatttggatgataatgaaagaggccgtggatcagagagaaaaggtccttatcctagaccagccagcgagtaaggaggagattcaagatgcatcggagaaaagaggtcagagtggctcaaaaaccctgagataaaatgggaggggtacgaagagccaggagaagggggtgtgaccagtcaggaagcacacggggactgctgaggggcagggctggagaggacagcaagaacagagtccaggcaggagaggacagctgggaggaggggaggaaggcaagggaaacacctgcatggggcacgggggcaggtggtgggggccagagggagaggcgagggtcaggtgacaggtgagggtgaaggtgatgaggcagggatccgagtgacagtggaggggttgatgtgacagtggaagggtcagagtgacagggaagggaccagggtgatgggggagaggtcaggatgacagggaagggtcagggggacagtggagaggtcaatgtgacagagaaggggtcaggtgacagagtaggagtcagagtgatggggaagggtgagggtgacagggtgggggtcagggtgagagaagaggtaaaagagagacagtggaggagtcaaagggaaaacggaggggtcagggtgatggggaaaggtcagggtgatggggaggggtcagggtgatggggaggggtcaagatgatggggaggggtcagggtgtggggaggggtcaggatgatggggaggggtcagggtgtggggaggggtcagggtgatggggaggggtcagggtgtggggaggggtcagggtgtggggaggggtcaagatgatggggaggggtcagggtgatggggaggggtcagggtgtggggaggggtcagggtgtggggaggggtcagggtgatggggaggggtcagggtgatggggaggggtcagggtgatggggaggggtcaagatgatggggaggggtcagggtgatggggaggggtcagggtgtggggaggggtcagggtgatggggaggggtcagggttacaagcattacaggtaaggggtgagggtgatgggggggtgtcagtgtgacggggaggggtcagggttacaggcaaggggtcagggtgacgggagagggcttagagtggcagggaactggttagagtgagggggaggggtgtccccgacagaggagggtgcagagtgacagacgcctcgtcagatttgcaagctgacaaaagacacttcagcaccatgtggaagaagaagggacaaaaatgggttagcttgacataagaagggtcagggtgacaggagagatgtcagactgacggaggaaccataacaatctgatggggcatcgcactgactccccagggagcacctgaactccaccaaccaacgggagcattcgctcccgcgcagaagggacagccaatcagagtgcgcagccttgcatgacgtcactggctgccgggcagactccccttcagtccgccgcccaaaggcccagttctccgtcacctcgtggtctggcgcctcagtggcagcgcatgtcctgccgctgaccagtggctggggaactcctgctaaggaggcagccctgagaggggataggggagagaatggacggggagacaactgaagagacagagatggggggacagagatagacagagacagagagagggagacaaggagacacagagacagacgtagagagacagaaaaagagagacagagatagagagacagagacagacagacaaaggcaaagatggggagagagacagagatggagagacagagacagagacaaaggcagagatagggagacagagatagagagacagagagacaaaggcagagatggggagatagagatggagagacagagagacaatggcagagatgaggagacagagatagagagacaaggagagagctagggagacaaggagacacagagacagagatggagagacagagacaaagagacaaagacagatgggggagagagggaggtggggaaacagggagggatgggaagagaaagatagggagagtgagagaggcgaagagcgacagacagagatggggcctagaagggggagagacaaggactgagagatgagaggggaaatgagagggcgatgggaagcatgggaagcaggaagagcccagagaggaaggagggagggcagctctgactcagagagggcctgcgcagccccaggagggaaccccagaagtggggagtgcaactgagagggagcaatgacgtctcagactgagagatgagggggcacgagggagccctcgggcatcagtggcgggtgacaaagacagtaccagagaaagccaaagccataccgaggggcggatggacagcagagccctaggaggagacagcccaagaggtgccctgacctagggtggatctgctgggctccgcgcccctgctgtccctacctcctctaggttatatgcaaaagtgcatctttggagagggttgaaatctcccagtttccaagtccttagatagtggcatctttttttttttttccccgagacagaatcgcaccctgtcacccaggctggagtgcagtggcgcgatcttggctcactgcaacctctgcctcccaggttcaagcgattctcctgtcccatgctcccgagtagctggaataacaggcgtgcgccaccacacccagcaaatttttgtagttttagtagcgacggggtttcaccttgttggccaggctggtctcaaactcctgacctcaggtgatccacccgccttggcctcccaaagtgctgggattacaggcgtgagccaccacgcctggctgatagtggcgtcttatacaatgctttgctcttgttcacttttgtgcagacctgatccaagaagcctcggggggtactgcaccccccaccccactgcatctagaccagagggaagatgcagggtgaagaggggagaggagcctaaatgaatgggaaatcgagacaccgagaacaagaccagacgtcgagagaggccaccaagatgcagaaacctcatgaaggggcatctgtattgactcagagagcgggaaagataaagatggcaggtgggaaggagcagagaaggcggcagagagagcctccgacatgagagggggacctggagaaggcccagggacagatccaagaggtgagagaagaaaaggcgagggggatgtacagggcaaatgactatgggtcctctggacacagagggaaaggaggtctcccagaactcaggtgagtgcttgtgagtttcatttctaggaggcaggggcaggtgggcagctggttttattactggctggtgtctgggctcctctgggggtggaggtctttggagctcagagggtgagttccctgagggttaggctcttgactgtcctgtaactgggttcgtgcagggtagacctagaactgtggctgcctggcactttacaggagctctgcgcatttgttgaattaatgaaaacaggacttgctctaattagtttatcagagatttacactcagtctgatacgctattgtggggtctctggtgttgcggggtctctggaggcatacacagagatcactggtgagccatggtggactttctagtttattttatttcagtgaattaatttatgtatttattgagacaggtctcattctgttgcccaggctggagctcagtggcgcaagcatggctcactgcagctttgacctcccttgctcgagtgatcctcccacctcggcacacaccatgactggctaatttttaaatattttgtagagacagggtctcactatgttgcccaggctggtctcgaactcctggcctcaagtgatcctcctgccttggcctcccaaagtgttgggattacaggtgtgaaccactgtacctggcctattttcttttccttttttctattttttttttagacggagtctcgctctactgccaggctggagtgcagtggcatgatctcggctcactgtaacctccatctcctgggttcaagtgattctcttgcctcagcctcccaagtagctgggaccacaggtgcacaccaccacgcccagctaatttttgtatttttagtagagacggggtttcactatgtttgccaggatggtcttgatctgttgcccttgtgatctgcctgccttggcctcccaaagtgctgggattataggtgtgtgccactgcgcccggcccagcctggcctgttttctatcctgaggggtttaccttctgttgggagtttgctgtgttacagttaacctcatggaaccctcataagaactgggcaagtttcactttagccccattttaaagaacagaaaactgagatgcagagaaattaagtaacatggtccaaggtggcaaattaagttagaggaagtcaggatttgcatccccatttgtctgttaatatagagtttctgggggatcaggaacaaacagaaacacctggggtatggttagagacccagagagggaaattcagagggaggagagtgtaaaatacagactggggggaggcatgaagaaatgggattagtgggagtacattccagacttccaataaatactgaataatttagtgagtgaatatggatggtagcatcctgaatctaagtccacttaggataatcctggggctgaaaatctttttaatctttttcgtttgtttgttttttagagacagggtggtctctctctgttgcccaggtgggagtgcagtggcacaatcgtggcttactgcagcctcaacctcggaggctcaggtgatcctccctcttcagcccccagagtagctaggactacaggtgcatgccaccacatctgcccaactaattttttgtatttttagtagagatgggatttttgccatgttgcccactctggtctcgaactactaagctccagggatcagccagcctcagccttccaaagtgctgggattataggtgtgagcccctgcgcccggccctgaaaatcttttaaccttagaatgatacagggcagtggttctcaatgagaggtagttttgccccccagaggacgttgggcagtatttgctgctggcatccggatggtagaggccaggggtgctgctgaaatcctacaatgcacaggacaggcttccacaacaaagaattacgcagctccaaatacaggcaattgtggctatatgcagtagttgtgttatatggggttgccacacatttccctcaaccaatcaatacataaccttgttttatgcatgtttctgttgaaggatgccttatttaatatacattgttgattcattcacatccaactcctggccaccagtgctctaactcatgcctgaatgaagcttctctaacatacgtattttctccataaggcacatcacggccttctcgcacttaggaacgctagacagctcttcagcaccatgcttgggggaccttttaaacgctgatatcaccactaaaaggcccaaagatgcaaagcacgtggcactaaacagaccgagaaaagacactcgttcacagtataagagccgaaatgagaaggcaccctcgttcagcctcgtctgggaacccacacatagggctactcaagattttctctgctttgcgcctgtccaagaataaccacaaaagcccttcgcgtattgattctgggcttctaataaatttcagcgagtaggcaaattcgcagacacagaatctgggaatcatgagggccaactgtgtcaacagcgcagatgttagaaactatgacggacaggaagaggtcttggactttggttctgtcttgatgagagacacacttgatgaaaggtctcaggcaagtgaatgcaaatctctaagactgtttcatcttctgtaaaatgggaatgtgcatgctctgtctttctttctgtttctgtaccgccctttccttcttaaagctggttgtgaagaagtttgttgaggaattatgagaagtttgctgcagggcagttgaggatagaagaagatcacaggaggaggaaacagggtcaaaaaaggtaagagcccaggggaggtagatttggactccatataaggaagaaggtttttttttttttgagacagagtttcgcttttgtcgcccaggctggagtgcaatggtgcgatctcggcttactgcaacccccgcctcgcgggttcaagcgattctctcgcctcagcctcctgagtagctgggattacaggcacatgccaccacatccggccaatttttgtatttttagtagagatggggtttctccacgttggtcaggctggtctcgaactcctgacctcaggtgatcagcccacttcagcctcccaaagtgctaggattacaggcgtgagccaccaagcccagcctcctactcttgatttttataaaagtacgagcccctccagagcatgagggattgtggatagacttcaggggcctgtgcacttgtacaggaaaaaaaatcctatgtcttcattttcatcatcctccaacaaaaactcaacctttcctcaattaaatatgtaagcagcaaaccatgctagtttcagcaagacccatgcctgtatccccagtaggaatcacagatatctccatatcccatcacagtggtgcagatttcccaaaatagtgtttatgcgcctcgtgattttgaaattagagttgttaaaatccaccgccaatgtctaacatgttgacaaaaaaagatgatattatgatatcacaaattttgcttttgaaaaatattttgagaaactacattttagtgtaactggcctcttttgttatttcatgttatgcatttataagcattattctgagaaggaccacggcagcctgccaaagagatccatgaccccctaaaagccaaaggacccagttttagagtaaatggacccctgaccactacgtggtggatgcggccagaggatggggactgggcagagaagaaggaagcgggaagggaggagcaaggcagagcgtggcctctggaggagacagttggagggtaaggggtggcactggcaagcctagtgggggatgtgttggagggaaggcacacagcccagtggagtaggggcaacatccaggaagggagcagcaggcccctaccaggatagccagggctgtggcaggaccatgggttcagagggctgcctgcctgggttaaaatcccccctccttccttgagcctcagtttccccctctgtaaatgggctaacaacctcgtgtacctcccaggatgaatctaaggaatgaatgagataatccatataaaatttgatgtctggctggtggctcacgcctgtaatcccggcactttggagggctgaggcgggcagatcacttgaggccaggagtttgagaccagcctggccatgatggcaaaaccctgtctctattaaaaatacaaaaattagccaggcatggtggcacacacctgtaatcccagctactcaggaggctgaggcaggagaatcgcttgaacccggggggcagaggttgcagtgagccaagcttgccccactgcactccagcctgggcgacagagtgagactcagtctcaaaataaataaataaataaataaaaattgaaaaataaaataaaatgcagtgtcccccaaattatcaacaccccctacaggttggcctctggttgtggggagaggcagacagagtggcaacagacatgaccattcatattttaataagtactacgtgttgggtatctattattatgccggggaatctccatccatgacatcattttgccttccttgagacccttaagatgggacgcagagggacacaaagaggcggggcaagagctcaagtataatagcaggggtggaaagtggagagagaaaaggacagagatgggatttgagggaaaggggataaggaggaaaggaggtctccaaagttgggagaaaggaggaaaccctaggatgtgtgtcgcccctccaggaccagcctaaagcacagaggcgtcaggagggttttggaaagagaaaggctccaggttggtgtgtgaaccgcctcccccctggcagttcctccccacaccaggccgcctacctcagtggcaaagaaacctttgggtcggtgtttgcccagggacgcgaggccaccgggaccagggctttcgcttgcactgatggtctgttgagctgcggccaggatttcgtccagtttgtctaggggtagatgaatgaacagaggtgggaagacaatgaaatgaagtttgctttgacccgggccgcaaagaccagagctgccgcccgcagttcatccagcacctggatcaaccaggaaagggcagccctgcctgggtccgggtggacgggcagtcccgcttggagacacaatctcccagcccagtgggcagcacccagggtgggaaggggtgcgggcagggaacggggcagccgtcgggagagggcgggcggagggaggggaggtgggatcgcagcctctctggggcaggaaggtgaggggcgccgtggggttcatggtgggacagggatgcagcgggtgccggggctggggcccggcatcccgaggagcagggctgggccgtcttactgagagccatctgatacacggtccgctttttctccatgctgggcaccggcgccggctgctgctcgtactctgtgggcaaagaacacggatgacgcccagggagcccccgggggcggggcggagcgggctcggcctgtgggcgtggccagcaggtgcgggccagtgggcgtggcgggcgcgagaggggcagtgaggggccggggtcagggaggggcgagtccgccggcggggtcgggagacgggggccctcccgccagtcctgtgcccactcaccactcttcttcttccagggggagactagcccgggggagaggcagtagaggagccaagagttaggacgtcaggggaaggtgaggggccccctgtctggaagcccgcctccctcggggccccggggtgggggcggtcagctgtccgaccagccccctgtcaggggaaatgggacccccaggtccactcggccttgtctggagggaggggctcgctttcctctgttattgggggttggggggagctggtggagggagagatgttgaatggggctggggggtgaggtgggacaaaaggaaggagacagagagacccgcagagagggtacatacagaccctgagagagaccccaacggagaaacagatacaagagcacagaggaaagtcgtctctcagacaccccttcccagagacacacacacacaggccagagtccgacccatggactggggacaggatgaggacaaggacccctggtcactaacaacactaacgaactcaagggatggtccagccctccttcccctctccccccggccccctggcctcagcagccccgcaggctcacccatctcctccagctctgaggtcatagatttggaacgcagggagatggttgggggcggcagccgcttggcctgctggggtgctgaaaaggtgatgaggggaggcatcagtatcatgggggagatgcccccaccaccctctaccaccacagggctcccagggctcagagaatagccattgccagcgtgcggagccctccctgcctcagtttctccccacaagggtcacggagaagcagtgctagggaagggaaggccttgggcagcagcaaccagccctggggctcccgcagggctgagcctggtggcagtggggtggctgcgagagtggccgcaggagcacctttcttgtgcactgcctcatccatgtccgggtgcctggtgaccatcaccaccttcaccatcagcgtgttgcccccttggcggatcatgttcaccacctgtcggtggccgaccttcaccacattctgcccgttcacctgtggcacagacacccccagatcacacagagtagacgaggggaggggtgcttgcagcttcagagaccccaaggaggatgcctcctgcgctgccctgtccatggccctctgggctatgttcctctccctccgacccttcataccaccgcctccctgggcaagccccctttcccaccctccctggccccagggttgggggagaggctcagcctaccctattcacttccccctccctccttgtccccagtatttatttatttatttacttttatttttaaaagacagggtctctctctgtcacccaggttggggtgcagtggcccaatcatggctcactgcaccctcgacttcctgggctcaagcaattctcccacctcagcctccagaatagctgggacctcaggcacacagcaccggctaattttttttttaagagacaggatcttgctatgttgcccaggctggtctcaaactcttgagttcaagcaatccacctgcttcagcctcccaaagcactgggatcacaggcgtgagccgctgtgcctggccatcccccggtattgtgtatgtgttggggacagctctgtgtcactcttttgagatgcctcagaggcctttagatggaatcgctggggaaagcagaggctggctggggggtgggcagggggctgggaatcctggtgccaaaggagaataaaactgggcagccagatcctggtgtgaatcatgagggggtctgggaacttgtcacagggtcccagggaagagagggggcctggactgacctcgatgaggaagtctcccattcgcagtccagctcgccatgccacgccaccctcgtccaccgactccaggtactgcagcgccgggaaggccggggtgggggtgaactcctcgatgggggtctgcgctgcagacagggaggagccggcggggtcggaggggagggggtggagaggccgagcaggggatggggctcagacccaagtcacggaggcctcaccgcagctgagggaccagcaccccggggtggggtggtgggcgggctggggtcccttcccctttccagcccccattttcagccctgcttctggggtcacagagcccttctcccatcccctccccggctggcactcacccttggccccccggagcacgaacccaaacccctcactgtccttcttctgcagcaagactgtcttctccttaatgatgtaatcgctggcagggaggcaggagaaatgggggggtggtggggggagtggagaagacatcatgagacacagaggctgtcccccacccggcaacccagacccaaacctctgctccagggccattaattgcatctcctaggatctctgtcacccactctgtgtgtgtatgctagccctgatgggcttccccctcagagccggcatgctctctctctcactccctctctcctcattcatccatccatgcatccatccacccatccattcagcaccaggcacggtggggaggatggggagaagagcttccagattaccagacagccaggcttgggtccctgctagtcacttcctgcctatgaccttgagcccacaactttaaccttttgtgcctcagttccctcatctataatggggggctatcacagatcctacctgatggggttgcagtgggaatccagtgggggtaatacacatttagtatttcgcacagtgcctggcacatagtaggtgctcaatatgatctgctcgatgtccttaggtcagagtgttaagtcaagaggactcatgtactttgatgatacccctcaaaattcctttatacatatgtcacctcccaggaaccccacacagggtaaaattgctaattctgcactgcccaatatggtggccactaggtgcacgtggctgtttttatgaaagctaatcaaaatcaaatggaaaaattcaattcctcagtcacagtggccatatttccaagtgtgcagaagctgcacatggctggtggccaccacattggacagtacagatatagaacatttccattgctgcaaagctccccgtggacagcactgtcttctgtattccctggtgcatctcaaatggagctactgcatgcagtcagcatattctattatagtaaaatgcaaagcacccatgaatatgggtggtagtttccagtaaagccatcaaatgccaccagcacatttaggtaaggctcacgtacccaggaaatgtcaatgaaactcagatacagttcatggatctcaaggctcactcaaacagccccaaactcctgacatgaccactgtacacctcaggaatatacatccattccattcccagaggatccgacaccccagtctacatcaggaatactcagacaccctggctgcaaccccactgccttcagaatacccaagaacacccaggagtcactggaacgcgtgctctgctgtgctgagcttccttcagcactgtctaaagcctgtcccagggcacacttgtagcacctcccaccctcacaatcccagtgtattccaataatacccagatcccagtaacatccatgtggccctaatacactccaatcatagccaagcatgctccccaattacctgcccccacaaattcagcaaaacagccgtcctcgaatactccagtatgtttcggcaacccccacacatcccagtatgttccaataataactccccctcactcggatctcagtgtattcccataacacgccctctgaacacatacatcccagcaaatgccaataatacttactgtgctccactgtatttaggtaccacccccacaagcacccctgtatgctcccaggacccccatggctccccttgtaaaaatccatacatttgcaccatggcgacagggttctggatgtgcacgtgtcctcccttcctgctgccaccctccttgtggcacctcagtgcacctaacaccacgcatgttcacatgtacatactccagcaacagtcctcgctcaaagttcgtaacagtccagtaaactcatccacaccatacccgccatgtcttcctcccctggatagagaggtgttggcagagaaggagggaaggggctgaaaggggtgaatgagggtaggaaaagggagaggggaagggaggaaaggggccgagaaggccagaacagcaagtggacggggaaactggacacagaaattggctcagaggtcagagctgcctgtttctaaccatgcattctgtaatgtccccattcccaccttcttactcctcctcctgtatctcttccaggtctccaaggccccccagcagccagcagcacccttcctcactggaggcaacctcactttctttcactcatgccacaaacccctcccttcctccatctttctccctcccctctggaatctctcttgccccctcatcagcctcataccccatacataagccttccccaaatgtcagccaatatagtcaataaaactcccatatcaatatgccaagaaggagcacttgccattggctgggcagtatctgaagcccttcacagatagatcattaaattgtcttctcataaccagcctctggggcagggataagtaccagttctactttatctatgtatttattcatattttttgagacagaatctcactctcttgcccaggctggagtgcagtggcacaattatagctcactgcagcctcaaactcctgagctcaaaggatcttccaacttcagcttcccaagtacctaggactacaggtgcttgccaccatggccaactaattaaaaaaatctttttttttggtagagatgggggtctcactatctttcccacgctggtcttgaactcctagacttaagcaggcctcccacctcagcctcccaaagtgttgggattacaggcatgagttgccacacccagccctagtttcactttataggtgaggaaacagaggcacagaaaggttaagtaacttgtccaaggtcacacagtgagtatcattcttcaacaatacccaagagaatactcgggtaactgcagtggtaataccctccactccacagcaccgaaataccttgagcacatatatccatctgctcggaatccaccctgagctcggccctgcagcacctggagtttatcccagggtgtggcagtaacaccatgacaatgaggaacacttatcgaattattactgaatgccagccatgattccaagcactttgcatttatatatttccatttatgtattcagttagtcctcacaacaacccagggaagggttgactgttattcttcccattttataaatggggaaaccgaggcacagagaaataacttgctcaagatgacaccagctagaaaaatgtcaaagccaagatttgaattcaccagatatatatatatatatacacacacacaccagtggtgatctgaggcagggaggggggtccaaccacatccagacccaccctgttcctgcttctgcttctcaaccaccccctatcctacacatgctccattcccctctctgctccatgactccctcacccaatccccagctaggacatacgtggtgttgccctcatcccaccacagtctccttgaacttcccaactgctctcttgctcccacagctccatgtacctctaaactccctctccccaactcctgtgtacccctcctctctgcacctcactccctactcctccatgccatgttgaggttccacatcgccctaacccacccccctcatccctgactcccacaagccctcctcacaccctatggagccatccccccatttcccgtgtcccctgacacaccctacccccctttccccctaaacatcctcctcagacctctgtgacctcctcacccttgtcctgcgacctctccctcatcctttggcctcacccttcccacaccctcctgcacctccgtaagtaatctcactggctcccctaaagtacctctggtccctttcatacttcctgggtaccctcttttgcatccgtggaaacctccacctatttctgccccctcgactcacttcaccacatgccctcccgcctgcatttactggcagctgcgtttcatttacattccctgtgtcctcttggtattctccccctactgcccaaatccccacccccaaatacccccccacattccctgaattccctccccaccccatttctctgctccgaaccctcggtgctccagccgccacccctcccccacttcagtgtccccactctcccctgttccattctcaaccctgcacctcctacccagacccctctagtccctcccccttgccccccatcttggctgcccctgcagcaccccattcaggctccctctggctgactacctgccctgcaggagcccacacaatgcttttccccaggccatccctaagcgaccctgagcggcctccagagctcagcagccagctcttgttcactggatcccacacacaggggcactgcagcggcctgcactcccctccccaccccaacgtccctctcacacacccagggtccgccagcccagagcctgctgctgtgcacgggcgcacccccaaccccgcactcagccccttcccacgtacccgtgtccatggcctgcccagaggccaccacagagggacgccagcccccctccccatgctgagaagtggcacacacaagcggatgcggctccccatgcagctcagccggggctcagcacacgtgccccacatgggcagagggcagagccagtgactcaagtactcctgacatgcacagacccccgggggcaagggggcaggggagaggagcacatggggacagagacacaggatggacccttgaagtaggggcctgtgggggaggggtaggccaggcccaggagggtgggtgttgggaagcacagccgcagtccctgggacagacccactccagcacacaccacacacacacacacacacacacacacacacacacacacacacagtcccagacagcctcgctgtcgctccaagtcatacagagacagacgctgtcacacagggacacacagatggacacagttggggggtgggctgggagcccaccatctctccatttctctctctcacacacacacgcacacacacgcacgcggctgcaggcagtcacacacacgcacatcgacacagccacactgacacacgcaccgtcgcacagtgacacgcagcggaaaaagaggaggggaggggaagccgggggcgggatgcgtgtgtgatggaggggggatgactgtgaatgggagagaggggtatgaatggggggacttgccaacaccgtgaagaggtgtggggatgtggggatcagagggacaggggcctgggatgtaggcggatgcgggtaagccacggtggctccccacagggagggctccggggaatgggggcgctaagggcggcagaaaggcgagtgggctccaaatcctggaggggggtcggtttagggggcctgctgggaggaaggtcttgggggaagagcagaggggggcctggaagggcctgtgagggggtggaggaaaagattcccagggctgacgagtgcgtattaggggggagggtcggggagaggattccagggaggaagatggagaggagaagggttgagaccaggggcccgaaagggatttcgggctgagagaaggttagggaagaggagcggaggggaaggggcgggttgggggaaggggaaaggccctggggctggggtttagcggcgggggagggtcgccaccgcgggccggggcctgccggccggcccgcaaagcaggaggcggcgcgctccgttacctgtagatgtaccagacgctgcgccgccggggccccagggctggccagctggaggacagcgcggggggcggctgcggcagggagctcccaccggggccgcccccgagacccccgccgccgaccgcagacaaagccatcgccgccgcggccccagccccggcccgggtcccggtgccggccgcccccgccgccgccgccgccgccgcgtccccgtacccgctcggccgaacccccgtgtccgggcccccaggccccgcctcatgctgacccgcgccgggaggggggagggggagggggcgcgcaccccctcccgcgggagggagggcagggccgggggctcacatgccggggggcgcgggggcgcggggcgcggggtcgggccgcggcggtagcgcgaggaccgcggacggcgccggcttcagcaccgcggacagctccggaggcgggcggcgggcgcgaggcttaaccccttggcgtcctgcgccgggcggcggagggggccgggcaggggggagggggccgggaggggaacgcgggggcccccttggcgggagaagggggaggggcgaggcttggaggggggaggagaaggggaggcacttccggtctgggcccccccttaatccccctcccccctccagagccctcccgcgcaggtgcagagctagagagcgcggggagagggaggcacaacatcacacaagatgcctcgcagccgcgtgcacggacgcgcggacggagccccgcttccccggcagggacaccgcgggtgagagaggccccaggcggggacacgcagcccaccaccacagaccaacacgcaacgcacctcgacacagtcggcaagaaaggccaggacattcagactgggccccaaggccatgagcaacacccctcccccaccagagaagcccaggcggaggggcgaacacaccaccacagctccccgagagagcgtggaccccgagccagcgcggggagggggcggcacacgccaggaggggagacacacggaaggaccgcccagctccggcagggaggctggggttgggccctggctgccgggcgcacggcacagcacaggccaggccagcgcagacagggtccgggaagagcggggaggcaggaggaggggaagctgagacgcaccacacacacagcagcacgtgggagccagcgagaggcacggaggagtaggggaggaagcccattgacaagacagagtagaaggaggaagctgagggtgacggggaccacccgcattcagctggtaggacaagtgacccccacagacggaggccaaggagagacccagagagacactggtagacaagaagcagaggccgacatagaagctcggggtgtgggggggtgtaccccaatactcacccggtgcccagagcaggagacgcgccaggcaaacacgcacaacggtcaagcgcctcagacactcggggcgcagggtggcaccccagccccaccctctctccccatgttgccatttctctgtcccccccatccccgacccatccccactggccagaacacagacacgtaggtttggacacatttaatggaaggatgctacgcacaaggggactcttccctggattggggggagcagtggaggagagtgtcatattttagacaccaaattatgaccctccctcccccacagccctgtccttctggaggcccaagccctggaatcctcccctcctctgcccttccctcccccaacatcccaggtcctgaatctcagatcaatcagacagacgcacatgcatgcacacacgttaatgtgcgagtacacacgcacagtgacatgcacagagagggacggatgtgtgcagagacccacctgtccatgtgtgtgagcagactcactgacatgccctgtggtgcttgcccacggattcagagaagcacagatgtgcagagccagccccacagtcatcatagccacaaaggcaccagtatatacagagcagggcagaccctccagccccgggcataggtacaggtacatccaggccacacatgcacacagatgcgtgtcatgcacacctacagagacacacgttcacacaccaagaaacctcagctctggtcgtgcacacacgttcacacgccccccaggcaccccgtccttcccctcctgaccccatcccctccctgcccctcgcctctcacctccctgggccaatcccatccattaagcttccgaagcaagtcagccagcagccagggaggggaaaggtgtcagtgcacccatctcctcaccccaatcccacccagccctgactgcaccctccccacaccggtgcatgggacacacacattcccactgcacatgactgcacagagatggggcacatgaaggagacaagggcctccagccagccagacataagagcgccccggcccccccaggcatccccaccctgccctgaccaccccgttgtctctggctaccccagagctgggcagtcttagtggctgccgaagatggtttggggttgggctgtactgtctgaagctaattctggcttatcccacccctggatcaaacttgagaaggaacagattagaaagggggcttagaggtgatggaaatatttaaaggtgtacattgtgaagggaacttggggtgaggggggttgcccgagggtgtaaggacatttaccttggggcatcaaagctgtcgtaggagcccacggtataatgccggaagagtctctttgccttgtcactgcggctttctgcagggtgacaacagacaaccttggactcttgttttggaaaccacaatcccagccctagagctcctggcccaagtcttcccatctacctcccagtaccccacccccattaggaagggaaaggagtggacgtgggaatcctagggtccattgaacactgctgggggttccgcattaccttgcttgctctcctgagagcgattcgccacttcttccaggcagtcagaggggaaccagccaacacgacctttgacctggccttcccagaagcctccttccccgatgctaagtactggatggggaacggggacatagagacatttctgtgtttctgtgctgcccctcaactgccaacacactcaacttagagcattcccacagttaccagctcctggcccaaggccatccttaataaacatctgaggaaggggcgaggagcttgggggagacccatatcatatcactcttgcattctagtttctggatccaataaggatgacaggcattggggaagacgactgttccataacatggtcttcctaggttagaggcaggtccacaattggtccttgtctcccctggtaactggtcacagctcagttgtgtaattccccttcaccctcctaggctctgtggacttagatcacggatggggcgacaagttctacctcaccctcccatcactgtccctgccacctcccaaagtctccttgccacttaatctttagtcctttgtccccagacccctgtctctgtctctctcggcctctcctggctctagaagggaaaagagattagcatcacctctttccttctctccctctcccctaatggaagcggcttccccctgcccaccctcccaggccccaccgcttccccatttagcaaacatcacagactgcctgttacatgcctgctgctgaaaaacagagatatatgacaagaacagctaatgcgtatccaactctcacctgggccagaaccctaagaggggccactttcattatcccccttttactgataggaacactgaggcttggagagccaagatcatttgctgaaggttacaaggctagtaactgacagatctggatttgaacacagctcagtctgcttccagagggcatactttcagtcactcatgtgcgctacctctccatgcaacggcttcagtgcatgacaagggcaccagtggcaaacacatggtcttccatttctccggcatttttcatgactctgcccccattcagcccttcacatagtttccttcctcgttcaacccttgtgcctacccaggtaggtaacaactgtttttccattttatagacaaagaagctgaagcgaatgtggagaaaacccttgcctggagatggctccagctatgctaggggttgagttggggccatcagatgtattcccctccacaaactgcctcccttgagagcatctggggagaccaaatgaggggaagctgaaagtcatggaagagagcaggagatgggttgtcaaggggactgggttcttggctggtactgccatgcctggcttggtggtcttgtaatcaatcatttgttcactgtaaaaatatttagttagtgccagtcatgagtcaggtaccagggtagacactgttgaatataatcaatgttgttccttcctttgaggagcttccagagcagtggccaatagaggcataactatacaagtgactgtatgattggaagttggggtcagagctcaagggaaaataagagggtgtttggagagaagccagatgggagtatataacttataatggcaaaggggtccagggaggtgtccctgaggtgtgacacataggttgagacctgaaggatcctaggagctggggaggcaaagagagcatggaagagttccaggcagaaggaccagcatgtttgaagagtttggtgtacaagaaagcttgggacattggaggaatggaggggttggtatatcggaggactggagaattggagggctcagggcattgggggattggaaggcttggggcattggaggaatggaggggttggtagcactggggaactggaaggcttgggcactgggaggattggatggcttgggccattgggggaatggagggcttggggctttgggagattggagggattggggcattagaggattagagggtttggggcattggaggattggagggctcggggcattggaggattggagggctcggggcattggaggattggagggctcggggcattggaggattggagggctcggggcattggaggattggagggctcggggcattggaggattggagggatcggggcattggagggttggaaggctcggggcattggaggattggagggctcggggcattggagggttggaaggctcagggcattggaggattggagggatcggggcattgggggattggagggctcggggcattggagggttggaaggctcgggttggaaggctcgggcactggaagattggagggcttggggcattgggagattggaggactcggggcattggaggattagagggtttggggcattggagaattggagggctcggggcattgggagagtggaggactcggggcattggaggattggagggctcggggcattggaggattgaagggctcggggcattggaggattggagggctcggggcataggaggattggagagctcagggcattgggagattggaggacttggggcattggagaattggagggcttggggcattggaggactggagagtaggatgaggtccctggaaccttgtgggtgaaaggaagagtcgcatgagatgaggttgacaaggtgggcagagaggcagcttggaggccaggtgaagactctgggctgtgattctgagagtagcaggagtcagctccctcatcaggctgtgtgaagctcagtgacatcgtggatgtgggtgtgctttgaggcaattaagtccctcttaatggaagacgaggatataaaaacagaaggcagtgtgttctctccctgcgtagaagcattgagcttgtagctcagcaagatactgcccatggtcctctgcctgcccggaaggtcctttacctctggcctcagctcacctttcttttctcccatctcccccaaccccacgtgcctacatcccaggcagctggccctgaaggagctgcacctggcccccacagtagctcctgaatttgatcattcattcactcaacatatgtgcattaaagcctcctgtgtgctgggtcattaaactgagccctagagacccagagaccagtgacttatgacctcacctacaggaactcaggctatgggaagagagactaggaaacacatgcagttacacagcccacctgatgttctgacccccgaatacccttcaaggcctcactcaagttgaccttctatggtaggatcctccctgcttattcaggggcccaggtctctctcctctaagtgcctgaagtaggggccacttaggaaaatgatggctttttttttttttttttttgagatggagtttcactcttgtcagccaggtgtgatcttggctcactgcaacctccgcctcccgggttcaagcaattttcctgcctcggcctctcaagtagctgggattacaagtgcgtgccaccacacctggctaattttttttttttttttgtatttttagtagagatggggattcaccatgttggccaggctggtctcaaactcctgatctcaggtgatccaccctcctcggcctccgaaagtgctgggattacaggtgtgagccaccttgtccggccaaatgatggctcttatatggcacttgttatgtaggaaacattggtctaagtactttacatgatctgactcctccaatcctcatcaaagtcccattttacagatgaagaaactgaggcccagagaaatcacttggctgaggtcaccctgctaggaagtggtggggtctggatttgaacccaggctgccaggctctcaacctctataccgctcagctcctgggcagcctagagtctggcaaagaattgttccaatgcctcgtattaacggccacacctgcggcacgtggtggtctctaaagcatccttctatccaagaacacgtcagcagccctgcaaagcctataagcaggggagactggctccactttccagatgaaggtggaaaaaccaaagggaggtgaaccctgataacagcaccaccattttgggaaccctcgccacggccaaacatcttatatctgccagctcgtcggggccctagaagtaggtccctgcctgtctctcagttgaggacccctggacagatgcaggaggcaaagttaaggctgctcggcctcacgctctgcaccaggtggcaggaaggactgtgggcttggactgaggaccttgggcaagtggcttcacctgtgtgaggttctgttccttcaaccatgcaatggggcccatgacctccctccccagaaagggccatcaggagtctaatgagacgatttggtgagaagttccagccatgccctgcacacggcatcagtgtcccgcagtgggacacggctcacttcactgcctcctgacagggtcatctgagctacactctatggtcctccaagcctcaaggggtgtcctggggctctctgaggtctccagagtgcatgagatactccaggtgcccgagaatggtctgctctctgctccacattttccctgatcgcccccacagcccagcccagcccaggccctgcttccaccctgggtacctttgatcttctcgcccttgctcagggagatctccccctcggcttgggcctggtaggacttcacagccatgaaggagcgtccgggtaccgctgagtagagcttcctccgcctcccgcggctgcccagggagcccccggggccccctgagccccccgtgcccccggctggcccttcccggggtgtcccgctggagctgcgtacacagagggcatgagaggaggggagggtggagggaggggacacctctgggaggacaggggtccttgggtgggggaagaggacggtgcatcaggggggagggggggtttcccagcactggcgtcctccaaggaagagggcatttgggggctccctctgcctgcccgcagctgccccaaccagccccctctcctgcctcctggcttccggctctgccccctcccacggtcctgcgcgcaccgcctgattcagcttcctgaggctgagctgggactgtgtcatccctccgctcacgagccttccgcgactcccagcttcctcctgggtcaggtccaactcctctgcccgccgttgccagcctctcccccacttcctcgggacacgcctggctggccttcgcctccttctcaccctcctctagccaggtgggcttcctgaccccggaatgtcccccgccccttcctcatcctccctccagagtgacctctctgtccccctcaagtccctgccaccccccccatcctcttcctgttcagcttccctccacctcaccctgtcattctgtctgtccccaggggctggggcccatgtttctttggggtaccctctgcctggggcccctgtcctggagcagacatccagctaacatgtggtgcaccgggggtggagtcgggacagtagctcccaaggccttgctttaccccaaggtgacactagggacttggatgagggcctacagaggaaggcagctgggctggcctcgggggaagccgccgatctggagaggggatttgacggggctggggactgtggagccagggctgcctcccctacctgggccggcctcggggctgcctcttggcgtcctcagggtgcctccctcgggatggagagcgggccctggcaccccgggggctgctggcacttcggagggtcccgctgctgagcttggtggtgggggccgagggctgcgactggccctgggaccctgaggtagggccaggggccccagaggacgcggcccccggggcggagaacaccatccagtcgggcagcgccatgctggtgtcactgttggcccgcagcagcgccgggggcaccgtcagccctgtgcctgggggcccccgtcgccgggccgcgtacttgggggactcctggaagggcactgagagggcacagtggcggcggggggcagatgttaggggagaaaaggcaagcagggggccatgcgggggcaagagatggtgggagagaggcatgagggagaaagacagagatgagaaagggaggggggcctggaattgctcccccaccaccatccagacatttttggtcctctagggttttctccatcctatcctggcccccaagtcaggtcccccaactcccccatcccaccatgaaacctcaaccgccccaggttctctgtgcagtccgagctccctgtcactcacccacatcctgttctcggtggtttcggatcagctcccccagctcaaaattcccagcaatcactgccacctggagggagggggtagaggcaggtcggccaggggggcccaggcagcagagagagggcagggaacgtggcgaggtccctggcccgacccaaaccttccactccgacaatgccgccctctgtcttcttccagctccccctccacggcctgtctccttgctttcctcattgtccccttccttatccactgggtgtcactgtcaccctttccttagccctggaaactccagcacatcccctgcagccccagacctggaagggggtctgtccgttgttgttcttcacatccttgtcggcacctcgatacaggaggatcctggcacaggtctcctgcgggtaatggccagtggcacaggacaaagagagagagaaaaaattaagatcaccatgagtggatgcaggttctgtgctaagagcctcaggaataaatactccaccctaaacccgcaccactgaggacagcagccacctgccaggtacggaccaggagcactttagtttaaacgtggccggcccaaacggagatgcaccatgcatgcgaactacacactggatttcaaggatatgccatatgaaaacaagaaagaatttaaatgtctatagccaggcgtggtggctcaagcctgtaatcctaagactgtgggaggccaaggcaggagttccagaccagcctgggtgacatagtgagacgccccccgtctctacaaaaaaataaacagaaattagccaggcaggtggtgggtgcctggagtcccgaatacttgggaggctgaggtgggaggatcgcttgagctcaggagttggaggctgcagtgagctgagatcaagcctgagtgacagagcagggacctgtctcccccccagaaaaaaaaaatgtcaggtgtggtgacacacacctgtaatcccagcactttggaaggctgaggtgagtggatcacttgaggccaggtatttgagcccagcctggccaacatggtgaaaccccgtctctatcagaaaatacaaaaattagccaggcgtggtggtgggcgtgtgtaatcccagctactcaggaggctgaggtgggagaatcacttgaacccaggaggtggaggttgcagtgagccgagatcctgccactgcactccagcctgggtgacagagtgagactctgtctcaaaaaaaaataataatttctgtattgattctatgttgaaatgataatgttttagatacactgttataagtaaaatatgttgttaaaataaatgtcacctaattattttccccttctctttaacatggccactaggatatttgagggcatttagggtatgtgctcatgctatgttccactggatgttggggccggataatcctttggtgattcattggtttgtggagggtgttctgagccctgtgggatgttgagtagcatccccggtctctaccactagatgccagtagcactcccctccccagtcatgacaaccaaaaatgtctctagacattgccaagtgtcccctgggagacagaagctcccaggttgagaaccacaggtctagaccttacggaggcttaccatgttacgtgccaggcgcttggcactttagaggcagaagctcattgaattgcccaacaattccaggacatggaaattgtctctattttacagaggaggaaactaaggctttcaaaagagcccaaggtgggccaggggtggtggctcactcctgtaatcccagcactttgggaagccgaggagggaggatcgcttgagcccaggagtttgagaccagcctgggcaacatggcgaaaccccgtctgtacagaaaattttaaaaaattagcctggcttggtggcacacgcctgtagtcccaactacttgtggggctgaggtgagaggatcacttgagcccaagaggtcgaggctgcaaagatccttgttcatgccactgcactccagtctgggtgacaaagtgagaccctgtctcaaaaaaaagggggggttgggggggctcaaggtcacacagctggtgattatcagccttggattcgaacccagatctctctgactccaaagtcttctatcttaatcacactttctgccaggcccagaaggaaggggacacacattgtggaggaaagggtgggggcaggactgggccagtggggacagggatgccttctacattcagatcaatttctcaccggtgtcaatcacatggcacccatcatcactttttgggctaagcacaaagtccatgccacggcctaggagggttagggttagctgagctaacctgagctgcctgccctgccactccccaccctgaccctcaccaacttcatcttctaccacctgcccttgctcccaggctgcagccacactggccacctccttcctctgacagcacactaatgccccaggacctttgcacggctgctccctctgcttggaatcctttcccgctagatctcagcatagcttgcttcctcacttcgttcaggcttttgcacaaatgccgcctcttcagagaggtcttctctggccatcctgtctaaaaaaaaaacccttgtcctcttccttgctttatttttatttatttatttatttttaaaatttttttgagatggagtttcgctcttgtcacccaggctggagtgcagtgacacgatctcggctcactgcaacctctgcctcccaggttcaagcgattctcctgcctcagcctcccaagtagctgagattacaggcacccaccaccatgtctggctaatttttgtatttttagtagagacagggtttccccatgttgtccaggctggtctcgaactcccaacctcaggtgatccgcctgccttggcttcccaaagtgctgggataacaggcatgagccaccgtgctcaaccctttgctttattttttagtaccacactgatgtatgtgccaggcactctaagccaatgttaactcattttcttcgtaaccccgtctcactgaaattccatttcctgttatttgtctcagtagtgtctcttctcctctacaccataagttgtacaggggcatgattttgcctgtggcacccaccacctggattaatgctggacccacagggactattcggtagaaggagtgtcctctcccttttatcttggcctggccaaacccaacttggcctccagctcaactctaccccagcgccctctgatgctaatttaaccaccatttcccaagcacctccttgatcttaccccttccacatgacaaatccaccaaggggtttgtatgggcctatgttacaggacaggttcagagagggcagatgctacgcccagggccacacaaccagttagtggagcagttaggattccaacaacctggccttcttcttcctttttttttttttttgagacagagtctcgctctgttgccaggctggagtgcagtggcgtgatctcggctcactgcagcctccaccttttgggctcaagcaatcctcctgtgcacctggccttctgatcctatggttcacctatctcctatgaatggacgactctgactgccaaagtcacacatcgggcagcagagttagcccagtgtgtgttctgggtgtgtttgggagtgtgtgtgtgcatgtgagtctgtgtatgcccgtgctgctggccaactagactgttaactcctgccatgtgtacttttgcgtgtttttcttttcttttcttttcttttcttttcttttcttttcttttcttttcttttcttttcttttcttttcttttcttttcttttcttttgagatggagtctcactctgttacccaggctggagtgcaatggcgcgatctcagctcactacaacctctgcttcctgagttcaggcaattctctgcctcagcctcccaagtagctgggattacaggtgcccgccaccatgcctggctaatttttgtctttttagtagagacagggtttcaccatcttggccagacttgtcttgaactcctgacctcgtgatccgcctgcttcagcctcccaaagtgctgggattacaggtgtgaggcaccgcgcctggctttttgcatgttttcacagccccaacacccacactgggggcacagggccagagcacagcccctaaggtcacctgctcctcatcctactcttacaaagctgagaaggtgtgcaagtcagagttgatggctccctcccctgggcaccaagagaaactcgcatttaacggcatcctagcacttatctcatgtcgtagccatgatttgcttacacgtctgcctcctcaccagactgtgaactcccaccccccccaaccccgccctcgccctccccaggccagatgctgtgtctgattcatctcacatccccaaggcctggtgctgtgcacatagtaggtgctcaaggaacgtgcatggaaaggatgaggatggaggatgtggggttgagtcagtcaaaattcatttgttcgagtcattcattcattggttgagtcattcagtctgttgaaacaagcaaacacctgttgaatgctctgagccaggcactgtgcacagtcttggtggaaatccaagagggctgaccccatcattcattcactcattttcattcattcattcactcactcaacaaagatggaactaggcctgctgtttgctggggtcctggaacagagcaagtaatcagactcaacccccacccttgaggtgctcacagcctagacacggatctgacattcaccaccaaatgctagacgggcatatcaggaggccaaggcggcagaggctgaggaaaaactgtcagactcagccctggctcttggaaagcttaaagcctgggaggaagacaaggggggaaatggaggaatcaagttcgtatgtgttatgcatcggtttgttaagcccatggcaaaggcaagcaaacctattaacccacttgatccttttgcatggtagatatttatttatttatttttttgagacggagtctcgctctatcacccaggctggagtgcagtggcatgatcttggctcactgcaaactccgcctcccgggttcacgccattctcctgtctcagcctcccgagtagctgggactacaggcgcccgccaccacgcctggctaacttttttttgcatttttagtagagacgggatttcagcgtgttagccaggatggtctcaatctcctgacctagtgatccgcccgcctcggcctcccaaagtgctggaattacaggcgtgagccactgcgcccggcctgcatggtagatattaattattgacccatttcacagctgagaaaggagatcaaggaggggaaaatgacttgtgcaactgtcccactaagaaaactctgcctgctgtctaattctaatttttttttttaaggcagggtctcactctgtcacccaggctggagtgcagtggcatgatcatagctcactgcagcctccacctcccaggctcaagcaatccttctgcctcagctgcccgagcagctgggacttcaggtgcatgccactgtgcccagctaatttttgtattttttcatagagaccaggttttcccacgttgcccaggctggtctcgaactcctgggctcaagccatcctcctgccttagcctcccaaagtgttgggattacaggcatgagccaccgtgcctggtctaattctctataccaaaatttctctgtttatctgaacggtacagtttctgtctctcgactggaccctgactgacactggtgatggtaacaatgacaattattattctgatggctgccttccagggatgagcacttagtatacacgatggctcaccctcgtcaataagagctggcgttattcccatttcaggaagaaggatggagcctcaaagagggggagggacttgtttgctccccacccccatctgcctgtggggccagggcttcttccccatcagctgcacgagggcctgggagtcagaggattggttgtgaggcctgtgtcgcagagcaggagacaggagcacgtggggagagaagtgccggcaccatgttggttcggtttgacaaacactgagtcttccctgggctccaggcatactgctggctgccacaaggcggcacgtggccacccgccaaatccccagcactgcaagttctgccgaggcagagggggctgagggctgttttggaagacttcctggaggaagggggctgacagaccagctctgtcatgctagcgcctgtctctctaagtacccccaccagctgcccttcaagggcaggaagcatcaagaaacaggtggggagattgaggctttccatggggctgacctgcccaggatcatctgcagctcaggtggctaaagtaccagaggtcatgacattgaaagacccggctcttgccaaccagctgccacgagcccccctgcctgctccgtacctctcctctcctaggaactccagaagtgggggtgttcttcccatctcccttcagcactcccttcctgctcagggacccaggttgtcaggacccccaaggtcctgaattgctaaaactcccatcccactgtcattcccttcaggggccacgggggctgcacgttggcctttcccctgtgccctgccgtgccgccacgtggcacctgcacacaccactggctgaatgcagacacaggggaactgaggacccacagccccctttcctctggctttctgcacaggctgtgcccccaccctggagcacccctttctcctcttttctactcctgctcatcttaacactgggggcacctcctccaggaagccaccttcacccccagccactccatcccaagcccagtcccagatgtgggctcccgcagggatctggattccctgtgactttgctctgagcactctggactgtagcagcaaactatgttgtctgccctctgctaggccatgagctcaacactttgtccccagcacccagctccaggcctgatacagaggagctcagtaaatatctgttggatggatggatggatggatggatggatggatggaggaatgaatggaggaatgactggatgaaagggtggaaatagtgaagaagtggagggtgcagagatgcagtcaagaggagtgtctgagcttggccctgggggaggcggctatcggggatgtgaggggcctggggtggccgctgctaggcagaccttgttgtagagggcgcagatgtgcagagccgtgttccccgaggcgttctgggctccaggctcagccccgtagaaaagcagatgctccaggtgctgagagtgaccccgctggcaggcctgggcaggacagggagcgaggggcatggatcagacccaggctgttctccctctgggccaagagtctgtctatgacctgtgcactggccttctcatcctatcgttcaccgcatccacctccccatcaccttttagccccgcttcctgctctgggacccaggctgtcagcctcaaaacccaaatgttcagtcattccaaggcccaggcgtctggtctgcctccttaagggggtcaagaggacagcccatccctctcaggggtcaaggcatcaggttccccagcctatgcccccttagggtctttctgccttcacccccaccatttcctctttggggaccatgttattctcacccccatgctctgtgaggaccctggcatctggttcccagccccagccccttggatgcctcagggactgggtcccccaccccagcccttcatggcctgaatcaggagcacctggtggatttcctgccagccgttctcatcagctatgcccagctgggccctgttgaacaggagcagctcgcagcatcgggggtcaccacccaccatggccgtgtggaacagaggggtcagcccccgacggtccttgtagttgggggaacccccaaggtccaggagcgcctaggaacggagagagaacccagtagaaaaacacagatgacagtcacacattaaccagctcattctgaagggccagggggactggaccgtcctgggtgacctacagtggccaatgacagtctcagttctgccgtgatgcccttgtgcaaccttgagcctggccctttccctccctgggccactctgattccgtgtgaacaatgtgggacttgggtagatgcctccagaggacacttgcactctgacatcccacccagccttccccctgggggcgatcttggatgagccattgaaagacattaggggccacagtacccacccattccacttcctacaggtgggttgttggggacaagtgagaggacagagtctggatgctggagggtctctgaccaagtgggaggtgttattaggtccaggatctcaaagaaggggcacagcaggaagccaggggacaggtaagcttgggtaagggcaaggatcgggccggcctcactggggctggaggccacttcctgcccccacttgaaggacagctctgggtgtggaaggctggcaataatgaacattaataggagaaagtcttggcagcaacctcgtgtgaggacagcctgtagcagtgccacccaacagaacgtttcccccatcatggggatggtctgcaactgcaccaccctatatggcaggcacgtgtgggcccctgagcacttgaacgtggctagtgagcctgaggaactgaaattttaattttacttcattctatttaatttaaatttaaacagccccaggtggccagtggctactggcttggatagcgcaggtctggaggctgggaggggcgtgtgtgagcaggatgtgggtttgggggtgagtgtgcatgggagatacatgaagaggatctgttaactccaggggtatactgcagatctttgtggctggcatctgactgcattaggggctcttcaggaaagcatctgagggagagaagggaggggccgtttagctggagcagctgtgcgtcggggtgcttctcaatggctgtctttgggggcagcccatcctgaccctcatgtgaagagcaatcaggtgtcctggcgggggcagggggagaagagtattttaaaattagactgtgcagctgccgctgtgtatgtattttgtgggtgtatgggtttgtctatttgggaaagtgcatttgaggctgtgtacgtggggaaggggctgtatttgcatgtgagagaggagggaggggagctggtgcagtgctggtttggaagggtagctggggggctgttttcagggtgtgtgtggaggggctctatctgggggcatagcagggagctcacttcgtattttaaggaatgagaagggtttacaccttggggagacagaggcagatttggtattaagctgggccacaggggatggagacgttctgggtgtttaggggaggaggccgtgcccgggtctgtgtgatgtcagctatagcccaggtgggtgcatctggggggcctgacaagggtgacaataggggctgtgtctcagtctatggaaaggggctttgaactggggacatgagagggcctatttttaactgaaaccaaagaactgaggtttgagaaagaacaaagggaaaaggagagagggccccatggcggggatggggggtccccgaagcctcaccgtgagtgccaggcagtgtcgggcgcatgcggccttatgcagtgcggtcatgccatcccgggcccggaagtcaatgtgggccccgcccaggcacagggttcgaatcacctctacagagccttcggtctgggccgccagtgtcaagggggtctctgaagggcgggaaaagctggtcacatgaagccccttctcctcccctccatcccttcccattttccaggctctgcagctctccaccccacagcctctggccccgtggcctcccccttggacagcaatgtgtttgggagacaccagtcaggaatggatgtgaatgcagatggcacccctgctccccagctctgtcctggccctgaggtcctcctgatgcgcacccctccctacctcccgaatccgagtcatggtaattggggtccagccccttgtccagcagccgcgccaccttgtcagatgtcccgagctgcacatactccaggaacttcttcaaccccgtctgagccatgggcaaagagagagaagacaggacagtcaggagcaaggcagagaagcagggtcctcaagcagcgacgtccagtgaaaatatacgtggagtcacatacgccattgaaaagcttctagcagcctcctttacagagaaaatacccagccctttgggaggccgaggcgggaggatcacttgggcccaggggttcgagaccagcctgagcaacaaagtgagacccttatctctacaaaaaatgcaaaaaactagccaggttgtggtggcacacgcctgtagtcccagctactcgggaggctgagctggaaggatcctttgaaccctgaaaggttgaggctgcagtgagccatgattgcaccactgcagcccgggtgacagagcaagaccccgtctcaaaaaaaaaaaaaaaaaaaatcagggtggttgggggtgaagtgttagttgtgttgaaattcgtgttaatgatatatgttatttaactgatatagctacaatgttactgtttcaacaggtaattgagatgaaaattattaatgaggttatttaacttttttttggtactaagtctttgaaacccagtgtgtatttcacactcacagcgagtcttagttgggaccaaacacactgcaagcactcaggagccacacttggccagtggttcccaaagtggaccgtgaaagtctggagggatggaacatttaggggaggaaagagttcaatgcatgctgtggtggggagagggtagacaaggagggactgggagtttttccttctcaaggatcaagagttcttcatttctgaccaaagcagttcccgatttcctcccagctctcaccatcgagacacaggacagacaggggctgaggactggcgggcaaggtaccaggaggacagatatggctggaaaggggggtgtaatggttggattttgcagagattcaggctatgaggttgggagaaatgtagcctgtctttgaaatagactctaggcagaaggaccttcagtgtcagggtcctaggccaaggtggggaagtaaagaggccttggatggatatggggggaggcaggggaagagaagggagactcaaaggaggccaggtgggaatgatgtgggcccaggcagagggatgaagggcaaaagaggaaagtaagaaggggttgtgatggggataatggggggtatttgtggttgtctcaaatgtggtacagcatcccaagttaagcgggggcagtggccagagggatcgctggcttggggaatgtggaggtctattgggaagaggtggggagagaaagtggttgggtagggggctccagtggtagggggctataggggatagatgccagcagggttttctcaccttcgtgtgcaacttggccagctgcttctcatccaggttggtctgtttgtaaactcgggtcttgtatcggaactgaggtcaagggtagggtagtgagagagacacagagacttggaatcaggggcctggggagaaggcttggggtaggggaaggtctgatccccttctaattccccggggtagctcagggtgggagtgaaaacagccctggaaccttggtctaggcggtagatgggtggcagtggcttttccgacagtgctgggtattatggtatatgtgcactgcaacccctgccttgaaggaggaggagtctggaccccacagggaatgttctagagtgcctactgtaattgggaatcctcccccaatttgatgggtgaggagaagcttggggcaggaaagtgacttggccaaggccacttagctggtcagaagcagaacagatggtaatttgaactcaggactctctgacttccctgtgatgcttagaaggtctggactcgcacactgggtgccccctcgttaaggtttcgagtgtgttaaaaagtgggtggggggcagatgtgttttagggcatgccttctcttatcagtgaaggagttggggaagcttcacctccaggtaggggacccccttctcaaaggactgggggtactcccgcagcagcctctcctcctccaggaagttggcatcgcggccggaggtggccggttggaacaggccatagttgagcacatcctgcaggctctcgctcagggcacagagcacctgctgcttggccgtccagatggtggcatcggggttgaagcgaaggcatttctggttggggaagagataggggctagggtgggccaggggccagaggagagcctgaggtgggttgggaagtgagccaggagctgagtgtgggggtgattcctgggaggatacccagcaccagtggactccccatgtcggttggggcactgtccctctcctgccgctggccagtgggcaggtactcactgtctggtgcaggtccgggatgccaatcctgaagaccatcatgctgaagtgggcgtcgtctgggacggacattgagcggccctggaggcctctaacagaggccaggctaccaggtgccccactgccctggccccgggtcccccgggggcctcgacctggcccgtctggggagctgtcggactctgagcccccctcgggacactcgctggcactgtggcgttcctcgtcctcgcttgtcgcggggctgtgggtcattgtggggccacggggcgacgggggacggcagcatcacaggcggctgcaggggccaagggcggccatcagactaggagcccgggacccctcagaggccgcaggcgctattcggtggtcaagcggtcaagggcagcctacccccactgcccaagataggcaggaaggaggctggacacaccctcggcctgcacggcctcccctgccgcctcctcccacgctggcacgcacacacccctgtccctgacatgcttctggcatgtgtctccttccctgcccttggccccgcttgcagcccgccccctgcgccccactttgctggtgacccagcgtggccgtgtcccagaaaccgcagaatcaccgcgggagctactggcccactttgccaggccacagaaaatgcagctaaaattagctaaggacagacaggtggacaaactgacaggcatcctgccctcctggccccagcctggcccctcatcccagggccggggggtggggttggggagaagctgaggctgacactgagatgtagtaagggggagagggaggtgtggtgagcctggagcgggtggagctggtgacttcactcaagtgtggctgacaacgcgtggcatgccgaatagtgctggggaatctgccgtcccaggggagcaaggggcactgagatgggggtgtcatgggcagagcatttggcctagggtgtccccaagggaaccacaagaggtggcttttggagactggggcatcttgagagggtgtgcgggtaggtggggaggtcggcctggggagtgctgtccaggtgacagtggtgtggtggcccgggtagatgtgggtggctgcagatgacctgtagctcttttctaggactgcagggtgggtgggctggcttgctgggtactaggggctccactctgaggactgggggtgttaggagggaggctaagaagtgagaggagggtctggggaactgagtgggggatcatctctagatccttgctgttctcccttgaggtggccttatgagggtggagccccttccaaatggggtccgcctcccttctgttctcccccaactcccaccccagcaccggaaaccagaatgtctggtctggtccctccccccaacaccaggcccggttcctgcaccgttgccatggagatgggaagcagtggagggtactgctgactttgggggagtggggatgggctggggggttgggaaagggaagactaaatgtgtgtggtgggaggagagttccaggaggtgtgggcgagcgagcctctaacccagggccggcggacccctcccccacgcgcggcagcgctgcgaagccccctccccctccaggtacccagccacgccgccccacctcgtccctgcggagaccccggctgcctcctccctgccccgccgcacagcccacctcgcgatctggggcccgcagacactccccctcggctgaccctggctgacccccagcctcaaccccgctcggagggggtggccggtgggatgaaagaaaagctggctagggccccccgcgcgtacggctgccccagcccccccgggccggctccggcccctccccctcagggctcgcgggagggagcgggcacgctccgccggggcggcatgaatcaaacgctccgcggctaagaatagctggcacgcagctggtaccgagacgggctgaggaatcggcgaggggggtggtggaggacgcgagagagggggtgccctgggaggctgtggggggacagggggcggctggcgtggccgagagcggggccggggagaatgaatggaggcggagggaggcggggaggggcggggagagagagccggagccgaggctgggaaactggtgggggagaacccggccggggagaggggcggggggcaccggggagcaggagtcgggggcgggagccgagggggcgcgccggccggcggtgtagggactggagacctggtggggacgcagggagcttggacaggggtggaaagggactggaggagcctggaaggagaagcgggagctggaggggtcgaaaggggcggaggaggcccgggcctagaccctcgctggaggggagtggggaccagggtgacctggcggaggggcccaggtacgccagggagggcgaggcgggggagtggccgggctgggcggggaggcgggtaccaggaccgagcccttggccccggagagccgggaggcgggttcgggataggggctctgctggccgggggtggggggcgcgccctcccatcaaggatgcgatctgggacggggcaccggggacccgggcgtaacccaatttggtgtcgcccagggcaacgctccccacctcacccgtacccccagccgcacacccaggccaggagcccggcgccgggccaaggacatccggggcgccctcgccccctcccgcggccccggccccgcagctgccccaaacccccaggttctcgacccccttacctgcctggcggggctgctgagtcccggtcggcggcgcccgcggcccctcccccctccccccaccccccacccccccggagacggggaccctcaggccatgccccaccgccccggagggcgagcgggcccggggagggggcgggcggggaccgggggggagggcgggagggccgaggacctcaccccccccgcgggccgggcctggccatccgcagagcgcccccccttccgccgcggccgccgcgcccctcctcgcccgcccccggctcggtccggccggctccgggcgccgcgtctccgcctgctcttcctcctcctcttcctcgggccgccgccgccgccgcccgctccgcgcctcctctgccacccttctcgctctctcgctctcgctgtctctccctcaccctgtctctctccctccctctctccctccctcccctccctccgccctctcccctccctccgggagccggcggaggagacatcgcccctccccgcgcccccaaacctcgcccatcccccaccaccgccggctccgccccctacccttgccctcccccaccactcctccccacctccgagtccccaaatcctgactccgcccctgcttgctcccataccccgaggaaggggtcctgcccccataaggtgcccccccacacacacctcaggaccaccccctcccagagagctccccgccgccctacacagagtggggcacaataaatatttgttgccagactctacacccccaaatttaagtgtgaaggctatagattcccaccctgtccccccaaacacacacacaccctttccatttaagcactgggtcagggcacacgtggacatacctgggccaggccacatttccccaaggcacaggtgcatagtcaccagctgtaacggcacctgcagagtccccacatacacacactctccagcgcatgcatgcccagacacaatgcacctggggtacacagctacaaacacacccagctacatgcagttgtcacacccctgtgcccgggcacacacgcagcacatgcacacatttgcccaccacacacgcacgtgcgcgcgcacacacgcacacaggcgttcaccccggtatgcatgcccagatctctcaacaccaaaacggagttacagcactgtagagacgtgtgcacgccttcccatcacacccacccaccgtgctgtccattgcactggctcgcactcacccgtttacatgcccaacaccgtgccatccttcccctccaggatagttactgctgacattcctggagcactttctgtgtgccaggctcagggactttcgccatccccattttccagagggggaaaccaaggaacagagaggctaagtaacttgcccaaggtcatccagctgtaaggaggtggtaacaaggatcaggaacaggtaggctggctccaaagtcctcacttgacaactatggtgcactactgggcatatcccctcatagttgcatatccttattcatcacacacagacacacccaaccgtctcctcagagtttgcacatgtctgtgtaggcacgcatatgcagccagctgcaggcagacagctcattcatgcctgggacgcacccacagggacagagcagatcccacagggcagcagtgagtggtgagtgtccccttagcccaggcttcctcattctcccagctccaacagcacctccagggcctgcagggggcagttctaggcagcttctgggttcccctccagctgcaggctctccggggtacccgagtatgagctggaggaggtgcctgctcagcctggggaggcctctatcttgatgcgtacccactagcccaggtggtgagcagctgggcccggggaaagcacagctgcccatgttggctccagcagccagagaggctgtgcacccctgcacactttacaaggcctttccccacatacgcattatttcttgaggtctgtagctcctggtgaggggccccaggttcccgatgggcacctgagaggcccaggctctgaggcagggagcagtctgcccaaggtcacagtgccctcgatgtaccaggatttcttggaaaacggaaggctggaggcactgatttccaaggcccctcctggggctcccggcagccgagggcagatgccctgctcttggagccagaaaccttggctagctgccgccacactggtgacctccagcaggctatgctgtttcagagcctcggtctcctcctttgaagagcaggcccagtgatccttggctggtgtgccccatgcttgttggcaccaccagccaggcctgggcgggaaaagccctgcatgactcatgggcctgacatagaggggcatggcatggcattgttcttccttgcctccaagcctctctcccactgccctcaccacctctacctaccctgccaccaccaccctgggaacttgggtgccagcaaaccaaagaggtgaagcttccaggcctttgaccccaccaggaacggctaccctctcgcccactcaacaggttgattgaacacctactatgtgctaggtaggccttgtgctaggagatgcatcagtgcataaaaatccctgctttcattggcagggaacagacataaacaaacaagatcatgccagtcttgattataccaaaaagatgaaatggggcattttaataaagtaacttgcggaatagataaggtggttggggaagacctcctggagctgagacctcgatgatgagaaggagctggggaaagaggcttctagaaggaggaaagggctagtgcaaatgctctgaggttgtaatcagcttagtatttggggatgagccaagaggccagggaaggtggaggctgggggtgggtgaagggaatgggggtgatgaggctgcagaggtgcaaagggttcttccttcccagcccccagcatggtaggctgcgctgaggactgaggcccgggcttggcttccctcctgcttatgatgggaaggtgggggagcaggggagtggggagtgatgtgatctgatttatggtttggaaggattgctttggctgcggcaagcagccgggattggaggggctcaggaggaaggagggggagggcgagactgcagtggtccaggctgaaatgaggtggcttgctgaatgctcagagctccttgagcacacaacctagcgtctgtcgatttcacctcctggagaaaccttccctgactgctccgccagactcctcaccctctcccatctccagccccctcatccccggagctatctggctgctggtctgcaagcagctggagtccccagcatcacccagcccacagcctggcctgcaggaggcttctagtaaagtggccaattaatccccgagccccgtcttccagggtcatgcacacagtcacacgcgtgctcttcacatgtgtcaccctgcccccacacacactcacttggatctccagacaagggcttggagggtaggatgggcaatctagggggcaggaggggccctggagtctcctccattgagtgtgcaggcgatggtggccacagggtaataacaacctcagcgagaccctgaggtctgcccctccttaggaatggccaggcagggaagaagggagcagtgctcggtcccagcatcccaccactgccgagatggttctgagcgggttcctgggctgaggccggggcctgtgttttccaagattccttggagagccagctccatcctcttcctgattatctgatctttgggctacagcagaaggaaagagcagggcggaagcgagctctggaaagtggaaagaggagggtgtgcgaggagacccaaggcgggatctaggctttggaacgttggaggtttccggccacagaggcagggcctccggggagccaagaggggcggggagagacacacacagagaagcagaggagaccaacggaccggacagagacgaggagaggaacaggaagagagaagctgggagaatcgggaacctgggggctagtgacctgcacacagggcaggggcactcggcagttcccagaggccacccctcccaccccagacatccagacatctggaactttgggtgccaagagtccagcttaatgcaggcagcctggcttttgggggctttggtggtcccccagctcttgggctttggccatggggctcggggagcagagagggagtgggagggaggctggggaggtgcccaggaggaggagcgggagagggaggccctgatgctgaaggtgagctctggagtgtcagggagctatgggtggtgaactgtgggtctgggagggggtattgcaaggttagggaaatggacaatgaggagcgattgggatagtctcagaggagtgggagggtgatgggctcagagacaggactcaggcagcagagaatgagttatgagttggaaaggggtgaatggggcatcttggtggcaggctggggctcaccacccctcccctgccccagcatctgcaggaagccctaggactgcctgctgggaggggggatgagaatcctgccggaactgttgagggaaaagaggactgggagatggaggaggaccagggggaggaagaggaggaggaagcaacgccaaccccatcctccggccccagcccctctcccacccctgaggacatcgtcacttacatccgtgagtaaccagaagccctcacccccaaactcctaggccgccgcggtcactttcgcaaaaatgaagggtcggttcactgccaagtggcctttcagttgtccattgcccagcccagagcccccacacccctaggagccccaggtccacggccatgcctcctaaaggcctgggccactcgaccctaccttccaggagtccggggtgccccccccaccgccaccccgccctcaggagccctagatcccagttctccaggtcctcaggccccccgctgcatctccaggctccccctccagcatgatccctgtctgtccgcagtgggccgcctggccggcctggacgcaggcctgcaccagctgcacgtccgtctgcacgcgttggacacccgcgtggtcgagctgacccaggggctgcggcagctgcggaacgcggcaggcgacacccgcgatgccgtgcaagccctgcaggaggcgcagggtcgcgccgagcgcgagcacggccgcttggagggtgagtccgcggcgcgcggggtggaaaaaaatgagactatctgggccaggaatgggactggttgagaaggtgaccctaggtgtccggggcgggagagttcgggagagctgctgtgtgctagcggacggggttagagagctgggaggctgaatgcagggagcgggtgggcactccagacccgcgcggacccgactggggcagcaccacgccccctacagtccagctcccaccgcctggccccgcccctggcggaccagactctccacctcctggctcccgcggttctgaccacgcctcctcccagccctccccatgagttcctggccccgcctccctccacccccggatgttttgtcctcgcccccttccagactctgaatgcatgaccccgcctccttctctacccggccccgcccacaggctgcctgaaggggctgcgcctgggccacaagtgcttcctgctctcgcgcgacttcgaagctcaggcggcggcgcaggcgcggtgcacggcgcggggcgggagcctggcgcagccggcagaccgccagcagatggaggcgctcactcggtacctgcgcgcggcgctcgctccctacaactggcccgtgtggctgggcgtgcacgatcggcgcgccgagggcctctacctcttcgaaaacggccagcgcgtgtccttcttcgcctggcatcgctcaccccgccccgagctcggcgcccagcccagcgcctcgccgcatccgctcagcccggaccagcccaacggtggcacgctcgagaactgcgtggcgcaggcctctgacgacggctcctggtgggaccacgactgccagcggcgtctctactacgtctgcgagttccccttctagcggggccggtaccccgcctccctgcccatcccaccacccggcctttccctgcgccgtgcccaccctcctccggaatctcccttcccttcctggccacgaatggcagcgtcctccccgacccccagtctgggcgcttctgggagggctcttgcggtgccggcactcctccttgttagtgtctttccttgaaggggcgggcaccaggctaggtccggtgccaataaatccttgtggaatctgacttgaggggcagtgaaggcagtcttggactttatctcctgcaggggaagccgggaagggccagaccctggtctttgggcgcgtgtcctggcctttggatgcctgttctgctttttacagatgtcatttgagccccagatggagtgatggagaaacacaggtgcatatgtacacacggtcatctgttctgtgcacagatggccggagtacacgcgtacaaacgctgtagacaccttcacctccatcgtgccctctctctcggcctttgggacccagggcctgccagttgtcccaggccttggtcttggtcctggtcaaagagatttgggaaacgtgaaggggctaaaggctctgacaagtccggcaggaaagagcccgtttaatttgtttaagtggcgtgtccaatttgtttccccagatgatatggtttcatggacttgttgggatgatatattgagacatggacttaaggactcacccaaccctgaagcttagacttcctcccaattttccctcctctgcttcctgccagtgaggccaggagccagtcccttcccctctgtgagcctcgggtttttcatctgaacgtgggcacaatccctcctactttgtgcggctcttgggatgttcaggtgagaccaggacagtgtgcatttggtggtggctgaacttgagccacacactaccttccgtcctcacctttttttttccttttttgagacacggtcttgctctttcgcccaggctggagtgcagtggtacaatcatggcttactgcagcctcaatcttctgggttcaagcagtcctcccaccttagccccccaagtagctgggactacaggcacgccccaccacacctggctaatttttgtatttttttatagaggttggttttcgccacgttgctcaggctggtcttgaactcctgagctcaagcaatctgccctcctgggcctcccaaagggctgggaatacaggcatgagccacagtgcctggctctccctcaccatttttcatacctttactccctgggggcagtgaagacacccaggagtccgccagccggggcctcagcatagtggccagctctgtctagaggagaggctctttggaaatcaccctagtacctcccccaaggttggcatcatgggcgtgaccctgacatcagggagcctaggaatggggatgtgaccctgtctgtccttaccactctgccccttcccttccttcagccattgcaccactgcctaaagggtgaccattggatccacacatgggaggagcaagccatcactgtcagcttggatagaggggagatcacccacccttctcccttcaggagacatttctcagccccacatccccagaggaatacagaataggagagtgggggtgtggcctggagtcagccttccatcagaaattcttctcatgctgagcttcagtttccccggggagggataggcagccctagatcttatagccaaccagaggtcagattaggcagacaatgatgagtatctattatttcccagaggggtctctgccctggcagagcttccattctggaaagtatttgggcatggtacaccatggctacccgcccagattctagagccagatggcccaggttccaatcctacctcagccacttatctcctgggagaacctgagtgagacataaccttgctacttctcagtgtctccatctgtactgtggggataataacagtattgatctagaatagtaccagacacagaggggtctttgcagttcccagatctgagcttcaccagggcaattcaacctcaccttcatctctctgtactctctcctgacactgtgcttttgtatatgcaaagatctccatcctccctcctctctagggtaaacacccacttccaagaattggataacacatcaccccaacaaccagcccttcccccagccccttgcggggttagggatcccctttggtatccacaaaccccttgttcctctcttgacccagccctgatcagacaggctgagggacactccaggtgcgtgggggagggcaggacaaggtatgactatctctgtccccagcatcgcctggcatatgggagccctttgaatgaagatgcttgtgtggcatcatgcaggggaccctgagatgagtcggatctcggctgcttttcctccctggcctccccaaggctgggtgaggcaccttctctagtttcccgtagggtccagggctttccacatcactttaggtgccactgtctggtctgacagacaatgtctgtctccctggcagggcctggagctatcataccaagcacagggccagctgtgggcatgcagagagagaggtctgaagtggggagtggcgtgcctgcaaggacggtttatgcatcagaacagcacgcctatatgtggcattcggcgctgattcctgactctggtctgcgtgggaaacctactctctcctccaggaagcccccccagacttcctgcgggccagagtttgccaatgtcctctccctggctctctgcggagcgctggtagtgtgcaaggccagagccatggaccaggggaggcctcggcagctgattggaatagatgcattaagggatcccagggaagtagtagaacaagggcaggaggcctgggatgattcgacggaggaggaagaaccagcggccgcacgggcttgcagggcgataaagcccaggaggccgagcagcaggcgcatcaccgccttaccagcaccacgtttttccgcagtaaccggatgactcctacgggtcacctcgcaagccccgccccctcctcccatgtgaggttcgcctgcctttccccgcaagcctgagggccacgccttggcggtgaggtcggagctccgcagtctccaatcagagctcagacccctcctctccacccaggcctcgccccgaggtactctggaaaatgtagtcctgtcacgcgcccacgggtaggaaaaccccaagtcgcgaagccttaacattcaactcacgtttggatctctcagacgagagtttttcaaaacaggtgcatttccttgggtagatcataaccactttttaaaaagtgaaaaaagttcgtatgaaatattagtatcatagaaaatggtaagacgcttttcaaaatttaaacgtcgatatgctgaattaacaatataaaattcaatataaaatttctttgtggctaaccactggtccaaaccaacttagtttctttcttttctatttattttcaggttctgtttttttttttttttttttgagacagagtctcactctgtcgcccaggctggagagcagtagtggcacaatcatagctcactgcagcctcgacctcctgagctaaagcaatcctcccgcctcagtttcctgagtagctgggactacaggcgtgcaccttaaaaataaacaaaaacaaaaaacaaaaaaaccagacaattttaatttggaaataattttaaacttatagataacctacacaaatataaacactggagtacaaacaaatcctctactctgatttgtttgttaacagtttacctcattgctttggcttcatcattccatctatccatccatccacccacccacccacccatcctagcccaatcatcagggacaagcaagacaaagtcaggtttgttgacccactgaaatgagagcgatcagcccccagaggagaagctgcaatcaagttataggatttggaagaagagagaaatttggatgaaatttaagtgaaacaatgtttagctaggtttagaacaaggtaggaatgtgtataagggagtcagcatcaggcctgggccgcatacagtagctcatgtctgtatcccagtgctttgggaggccaagacaagaggatcgcttgaacccaggagttcaagacccgcttgggtgacatctctatggaaggaagggagggaggggagggaggggagaaaaggggaggggagtgagggggggagggaaggggaggagaaaattatctgggtgtggtggcacacgcctgtagtcccagccacttgggaggctgaggtgggaggattgcttgggcccaggagtttgaggttgcagtgagctatgattgtatcactgtattccagtctgggtgacagaacgagatcctgtctcaaaaaaaaaaaaaaaaaaaaggaaatatcagatttggactgcaaagtggacctaaggtcttgtttccctggaaactacaatgttaatataaatgtggcatgctgtgcccagaaactttttatttaaaactctgcaccagggctggaaatggaggcttcttatctttgtcaaagtgacagatcttccaggaaagaaagatgagtctgtttcattcttacggatagactttcataccgcagagtttcccacagtctatgattttagagaacaaagtttctcagtgagtaagatagcagtagtcgctcataaagggggctgttagaacacttttactgctgcagctcgcccctgggtgaaatgtgtcctgttaaccttgcggttggctttatctcagtctatagatgaagggcaggccagatttttatagtattagctggctttagctcatatatatatatatataatttttcttttcttttgctgcctttctttttctttctttctctctcccatctttctttcctttttcttttgtctttttttttttttttttttttgagatggagttttgctctgtcattcaggctgaagaaccatggtgcaatctcggctcactgcaatctccacttcctcagttcaaacaattctcctgccgcagcctcctgagtagctgggactacaggtgcctgccaccacacctggctaatttttgtatttttagtagagacaaggtttcgccatgttggccaggctggtcttgaactcctgacctcaggtgatccacccgcctcggccccccaaagtgctgggattacagttgtgagccaccgcgcccagccagttgtcatgtctctttagcctccttgaatctggaacatttccatatttataatattgacattttggtggccgggcgtggtggctcacgcctgtaattgcagcaggttgggaggccgaggcgggtggatcacgaggtcaggagatcgagaccgtcctggctaacatggtgaaaccccatctttactaaaaatacaaaaaattagccgggtgtggttgcaggcgcctgtagtcccagctactcgggagcctgagacaggaaaatggcgtgaacccaggaggcagagcttgcagtgagccgagatcacgccactgcactccagcctgggcaacagagcaagactccgtctaaaaaaaaattttatatatatatatgcacacacattttggaagaacagctccttgcccttttaaaaatagaagttccacatttttagtcggtctgatgtttccccatgatgattagattcaagttatacattctccaccagaataatgaggtgaggtgtgtacttctttgaaggtatcccatctggacatagtcagtgtcctactgtgcctcattagtgaagtgagttttcatcacccagcgagctgatgtcccattccccagctctataatactcctttgcagctaataagcagtccaggggcagatactttaagacaggcagtatctgcctttcatcaaaatttcccccttgatttcgcacccattgatgattcagctgatgtgggcttattatgaataacaaaagatgctcctggcctggtagggtggctcacgcctgtaatcccagtactttgggaagctgaggcgggaagatcacttgaattcaggagtttgagaccagcctgggcaacatagtgggatcttgtctctaaagaaaatataaaaattagcctggcatggtggcaagagcctgaagtcccagctacttgggaggatgaggtgggaggattgcttgagcccaggaggtcgaggctgcagtgagctgtgatcatgccactgcactccaacctggacaacagagggagaccctgtctgaaaaaaaaaaagacaagaaaaagaataggacgttactgttaaacgccttctcccatccccctcgccagtacctaccatcctgacttgtgtttcgccgttgcttgattttcattattattttagcatgtgtgtatgtttcccaaaaaacatcttatttagttttgcttgttttttgggctttggagtaataatacacgtattcgttgtctcgaactgcccttataaagtaccacaggctaggggactgaaacagcagaattgatcatctcccagttctggaggctggaagtctggagatcaagatgttggcacggttggtttcttctgaggcctccttctttggcttgcagacggccgccttcttgctgtgccctcatgtggtcctctctgtgtgcacatccctggtgactctctgtatggccatatatcctcttcccataaggatgaagtccaattggattagggcccaccctaatggccccatttaaccttcaccacctctttagagatcctatctccaaatacagtcatgttctgatgtactgggggttagggctccaaaatatgaattttgggggctgcatttcagctcacaaccatatcttactgtatgcaacttgctatttttttttttttttttgaaacagagtctcgctctgttgccctggctggagtgaagtggtacgatctcagctcactgaaacctccgcctcctgggttcaagccattcgccttgcttcagcttcccaagtagttgggactacaggcacacaccaccacacctggctaatttttgtatttgtacagatgaggtttcaccacgttgaccaggctggtctcgaacttctgacctcaagtgatccacccgcctcggccttccaatgtgttgggattacaagtgtgatccattgcaccctatcaatgcaacttgctttttaaagacaaactcctatcactaagatgcgttcgtgatggtgcctgtagcttttgtttgcacatttttcaggggtatggtatgaaaatgcttaaaaataatgtggggagaaatcgatgaaatggatgggggaagaaaagaagattaacaaaactaaaagctattctaatttttgaaaaagcaactaagacagacttacttttggcaaaccgattaagaacaaagagacaggctgcaaataaaatacaaattgtaaagtggtgaataattacagccaggacagagatataaaaagtaattatattatggctatgtgctaacattaaaaacctgaatgaactggttaaattactagcaaaatatacaatgcgaaaatgacacaaaattacagactgaataagccagtgactattgaagaatttgaaattatattcagagatctcccctctccccaaaaaacccccaggcacagatggttttctaagcaagtgataccaaacattcaaagaatgtttaattcctatcttgtatgaattattccagaaaatcgctggaaaattatgtaataactgcctgattcatttttagagactaatgcaatgttgaatccaaaatcggataaggaccagatgcaagaaaattatagattcatttcgcttgtgaatgaagatgtaaaaatcccaaatcaaataattgccacttcaatccagcatatcataattcttcatgatcaaataagatttctcctcctaatgcgaagatggttcaaaaattaaaaaaaaattctttcaatataattcaccatatcagtagaccaaggaagaaaatataatgatttcaactgatgtgggaaaataatttcataaggctgtacatctatttacgattaaaagttaaaacactccactttgggaggctaaggcaggaggatcgcttgagcccaggagtttgagaccagcttgggcagcacagtgaaaccatgacatggtggtgtgtgctggtggtcccagctacttgggaggcagaggtgggaggatcacttgagcctgggaggctgcgtggttttgaattgcatttctgtgatgattaatggtgttaatattttcctggacatttagcccatttatatatcttctctgggaaatgtctgttcagatcatttgccccttttttgtttggtcgttttattttattttttgagacggagtctcactctgttgcccaggctggagtgcagtggtggaatcccggctcagtgcagcctccacctcccgggttccagcgattctcctgcctcagcctctcaagtagctgagattacaggcacccaccatcgtgcccagatagtttttgtattttttagtagatatggggtttcgctatgttggccaggctgctctcaaactgctgaccttaagtgatcttcccgccttggcctcctaaagtgttgggactacagctgtgagccaccacgcctggcctcacccattttaaaattgggttacttgagttctttgcacattttattttttgtttttgctttttggagggttactgtatacatcttaatttatcagaatcagtttcagatttatactagctttattacagtgagatatagaatggttattcctagatagttctattccatttccccttgttgtggtatcattataaacttttttttttttttttgagacggagtcttgctctgttgcccaggctggagtgtggtggtgcagtctcagcttactgcaacctctgcctcctgggttcaagctattctcctgcctcagcctcctgagtagctgggattacaggcacctgccaccacgcccaggtaatttttgtatttttagtacagatggggtttcgccatgttggccaggctggtctccaactcctgacctcaggtgatctgcctgccttggcctcccaaagtgctgggattacaggcatgagccactgcaccagacagtaatgcattaagctttgaatacctaagctcaagagttgacatcaacctttccccacagataattctggtgcttgtgaactagtggtctccgtagatgtttgccaccaagaaggtcctggggactcgcaaaaacagtctgtgggagatggatatgtgagtctgcttctaagaggctctttggccgcctctggcacacggggccatctctctcctgcttgccctctgccctcttctctccctccattttccataatttcaacaaaatcagttaatatttacaaagcactgagaacagcacttgggactcagtaggtgctaaaaaaaatcatcagctgcttcttttttttttttttttttttttagacagaatcttaccctgttgcccaggctggagtgcagcagtatgatctcagctcactgcaacctctgcctcctgggttccagcaattttcctgccttggcctcccaagtagctgggattacagatgcctgccaccacacgagctaagttttgtatttgtagtagaaacagcatttcaccatgttggccaggctggtctcgatctcctgacctcaggtaatccacatgcctcggcctcccaaagtgctggaattacaggcatgagccaccatgtctggcccatcagttgctattattagcattattccttctggggaatgttttagatactgcatttcatggactctaagaaactccacttttatggttgttacaaagaaagaaaagtgtatactgtctataagatgcaacaatgcttccttaccacttggaatttttatttcttatttactgaaagagcttttatgggtgtatttattgcgaacaataaaggaaaatacaagtaaaataaaggattcctaaaattgttccacaattgagatcctttttttttgtttattatggaaaagttatacaaaaattagctggacatggtggtgtgtacctgtggtcccagctactcgggaggctgaggtgagagaatcacttgagcccgggaggtcgaagctgcagtgagtcgtgatggcgccattgcacgccagcctggatgacagagtggcgggagggagaccctgtctcgaaaaaaaaagaaaaaaaaaggttgcgtgtaagaactaaaaatcattactgctgggctcttgatccagctttgcaattagaggagacagtttattgctgacttctgttttcagagcaaacaccaaacacaacttattccccaccaattccccctgacccacccaggcccaccaagttggttcccgggggctgagagtgccccactcttgtctgctggattttcttctgggctgtggacaccccttctgcaggttttcatgcctttcaaacagcagtcgtatggtgccagacgttgaaagatgccttccggtttcagaggcgtcaagatatgggaaaagtggcttcttagaattgatcagttacgatgtgtttttcaaaggtggcgtctcctttactgcaggcagttccttctctaagggagagcttgtgggatgatggttgttctccccaggctctactctgcctggatttgggcactgcttattgccaagctgatatcctaactaatattttcaagtgggcagcctggtttcggatacttaatttctagcagcatttcccctgctgccacgccatcttcagtcttttaaaattgtagtaccctgggaagagtttatggcattcttacccaattccttcttggcgcaaatttaaggtttttttgtttgtttgtttttttccttccctaagtgttttgctattgcaatgtcaaactaaataagaaacacagagaggcttccaaaagaaaatatgttatctgggaatagatcactgcagtgggaaatgcatgtcatagtaaactatgtgcgtatgcagggaggtaaaggaagaagaaggtttttaaagggaaagaagaggaggattacatattgtttcgaaataattatccttggctgcaaagatcgataataaaggtgacaccagtctgagggtgaacaggcaattgtgggggagatgtccttgagtatttttggtggcaggttgtgatggcttttgtgccaggttgtggtttttatagagtcttgtaataggtgttgttggtttttgtttttgtttttgttttattttgtttttgagatggggtctcactctgtcacccagactggagtgcagtggtgtgatctcagctcaatgcagtgcagcctccaactcctgggctcaagcgatcctcccacctcagcctccggagtagctgggactacaggcacataccactatgcccagctaatatttggtattttttgttgagatggagattcgccatgttgcccaggctggtctccaactcctgggttcaaattgagcctccctcctcggcttcccaaagtgctgggattacaggcatgagccctcataccacgcatgtgatagtttttgttatcaagcatacaagcatgataaccctctcttcgtggctctagttgtcaatgtttaaaaatattagtacctagggatgggtgcggtggctcacacctgtaatcccagcactttgggaggccgaggcgggcggatcacgaggttaggagattgagaccatcctggataacacggtgaaactccgtctctactaaaaatacaaaaaactagccaggtatagtggcgggcgcctgtagccccagctactcgggaggctgaggcaggagaatgtcgtgaacccaggaggcggaacttgcagtgagccgagattgcgccactgcacttcagcctgggcgacagagcgagactccatctcaaaaaagaaaataaataaataaatactagtaccgagggatgggcgcggtggctcacgcctgtaatcccagcactttgggaggccgaggcaggcggatcacgaggtcagaagtttgagaccagcctggacaacatggcaaaaccccgtctgtctgtactgaaaacacaaaaattagctgaacgtggtgttgctcccaagtaattccagctacttgggaggctgaggcaggagaatcgcttgaacccgggaggtggaggttgcagtgagctgagatcacgccactgcactccagcctgtgccacaagagtgagactccgtctcaaaataaattaaatacataaataaaataaagacaaaaatgttagtacctctattttgattttggtgatttttacaataaatagtgctgcaaatgacacctttggggatgaagcttttgtccgtgtttaggattttttctttggtctcgattcccacaagtggaccccaagaaagaaaagatcttgtttctgtcactcagaaggtcctgacaaccctacaaccgagcaggagagaggctgccctggcctgccgcaccgccccgggaattcctgtgagattgttccctggttgttgatggacggggttggattttgatttcttgtgtgcgggagcgtcttcctgccatgatggttggccactccctctctttccgatttgcagatgtgtctccttgtcttttgcccacttgcctactggaatccaactttgttgcttttctgtgtggtttacatgataagattattgacgctatttctgtcacaggggatataagtttttttccaagtctatttcttgacttataattttagtgtgagttttgttttatacacagagattttaatttaaaggctgtcaaatctgtctccttaatatgagaaaaaaggaaaaaaattagcattttttaaataaaggcataatttgcatacagcacaattcaccctttttaggtgcagttctgaggttttggcaaatgcacgcatcacgtgaccaccccgcaaccaaaacacagaacagttccatcaccgcaaattccctcacaccccgttacggctcaagtgttcaaaacataagaaagctaaaagaatagacgtgaataggcaattcttttctccgggttgctctatgttttaaaagattgacccccaatttttttgtctttttttcttgaataaaaccgaaaatgccaaatttcagggggaggaattgcagctcaaactaaaattggtagttaaagagtcccctgccatccttgttcttccctcagataatgagaattgttaacaagttccttcctttccctccttccttccctccttccttccttccttccttccttccttccttccttccttccttccttctttccttccttccttccttcctccctttcctccttcctttctttaaatagagatgggttctcaccatgttgcccaggctggtctcaaacccatcctgggctcaagtgatcctcctgccttggcctcccaaagtgctgggattacaggcatgagccaccgtgcccacctaagtctttcttttgagggctttctctctgccttttatttctcttcacgtattcattcacgcaccaggcacaggtggagccccgccatgcacgcccgcatctgtgcgtgttccacagtgtgcaccattcctgggctccctcatgcatttcacctaacagcatcattgtcacgttctcctccaccatagcacagagcgtctaagggtgccaccctctcccataactagagacacatgagtgacagcagcaatgagctgtcccatctgctagtcgtcgacacagaagagccagactgagagagctgggtgccaatcacaccacgcagggacaggctgtctgcccagaggaggccggtggtgtccacacctgcctcgctggggccgtttcaacacaaatcttccagcagttcttaactgaacgtctgacctaccgactccactttcgggagtttatcctttggtgatattttctcaaagggccaataatcacagtggctcacagaaaagagttctccgtgtttgccggatatcctgctgagaatttgacactttgatctcatttaaaccctgcaacaaccttgaggtgggtgctgttgttacttccatattagagcggaagaaaaggaactcagagagat

SEQ ID NO: 2466 - DNA, 7236 bp, Homo sapiens
attagtttcttgacataaaaaacctcccaatctcccaattaactgaatacactaggaataaatagatgaatacaatggaatattatatcactattaaaatgaatgaggaggttctataagcctagatatgggaggatctttggatatcatgtaaaaaaaaaaaaaaaaaccaaggtgcagaataatgtgatcctatcaggggacagaaaagaggagggtggtatatatgtgcatagatgtataaaattcctctggaaagatacataagaaattagtgaatatatgctgtccccagagaggagaactgggtggctggaggatagggagggagggagatgcactgttgaaagcccagcaccatgcatcctgaacgttttccctggctcttaatgtccactaagttctcagatgcccacagcatctctctcctctaccctcttcttcctcctagttccccattgaaagcaactcctgccccatccgttcctgggccagactcagggagttgtagttttcctacctgtttcccgcccacaggttcctgttctctgcccccagtgcccagcagtctccagccatctccagctcctcacattcctgccccaccccttcctctctccccaggtcctagcccgcaaactgcagggagggggcctcctccccagcctccacccgtctctccccctccactccacacagcctcagcggggtctgacattcagctataaccgtgtccccgccccttgctcacaaccttccagggctccctgtcaccctcagaaggctaagttcccagcctggcctgaaactccctaagaatctgaccccgcccgctcgccccaccagcctcatctcctgtgctccttggctcctggcttcggaggctctagtcagacttaagggctttgttgtcctcccagcacctccttggtttcctgccttgggccttcgcttcagctgtgccctctgcctggaagggccttagtggaggtcatgccacaaccacgccttctctggaggtcctctctgccgtctccagctgccaggattcctcccgccctgggctctcacagcctctggcctctccctgtgtcatacccagatcacccgggattgggactgtctgcggctggctctgtctcttccatcagactgtgagctccatctgcaagggcagattcgggtctgattcacctttgagcccccagtgggtgggggtggggggtggagatactaaagctggtgggggcgaagctgggagagcaggaagggggagagagagacgggcagaccctgactggttcggggagagaggggaggagaaagcgagagagaggaagaacagagacacagagacaggaagggagggagagaaacagagaaaagggaagaataaatgggagacacagataatgccccacaggcagagaaagaggatggagatagggagagggcgaaaggaaggacagatgtgcagagacagaagggaggacagacggaaagagacacagagaggcagcaaaagcaaccaagaatgacaggagcagagaggaggagggaaagagggagagagagagagagagaacgagagagaagggagggagggagagagggagagagagagcgagagagcacgcacagagcgaggaggaggcgcaggagagaagagggagggaggccagcgagggacaggacggggcggagaggcggaggggagctagggaaagccggggaggagcgagactggccgaggaggagggcgggcgagcgggagcgccggccccgccgcctcccggcctcttttgtcccttccctcctctgcgtcaggcttctctggcccggcctccccctcccgctccctcctcctccccggggctggatggaattttttcccctggacctgggccagctccggggcaggggggaagccaggccggactgggctgggcggtggggaggggccggggcggggggccccctggggagggggctggtccgacggccgcgcagccggcggggtccagggagggggagccccggaccgcagagccggggaggaggtgacggccggagggagtcggggagaagggaaggaggatggcggggacggcgggaggaaggggagaggccgccgtgcggcgaaggcggggagaggatggagagcgctcggcggcggtggggcccggcctgcgggcccggggcggcggagaagaccccttccctgcgacgcgggagccgcgggagccgtgagtctgcggaaagggagggtggggggctggggcccgcactcctgggtccctgagggaggagcacccgggggcctggatttcagggttcttggaggaggagttgggggtggggagggtggggtggctgggagcccagactcctgaatccttgaaggagggggctgggacctggatcccggggtccagaatctggagaaggctggggacacttcctggattcaagagggaggacagagatgggggctggggctggtaggatcgtggctggaagagactaggggcgagctgcccgagccctcgggggaggtggaggaagactggctttggagtgcctgcggcagcggaagggttaacgtctggctggaggggagggggaggcgcagggatggggctgcggggctttgaggggtcaagggtgagccgtgccagtgggagggggccgaggaggagggggaggttgtctgggctgccagacaggccagggtcagcggcgggggcaggagatgtctggaggaggagaggcccagcatccatgctccctcggggacccgggattccaggtcccagacccctcctccctcagatctgggagtacaccacccagtcccccacccattccagaatccgagcccccagcccccttttttccaggatccaggagtctgagcccccagtctgttctctcagaccagggaatccacactccagcccctaactccttcaaaaccccagagttcagaacctcagcccctcttcccaaggagcgcggcccccaaccctctgttcctctagaacccaagcgttcaggctccggcatctttctccctttgaagcctgcagttctggggatccccaggcccctcctcctccggaacccaggagtccccacctcctctttagccccagctggagtccagccctccaggggttaagggggcgggaccagctagttgccatggtgccagactgtttgggtctgctctctgacccttgggggctccccagggtccgcagagagggggagggggacctaggcctgggggaagtccagagcctaccccttccccaaagcggggctatgggcccagggagttcgcgtttccaccaacgccttgtccagtgaccttgaacaagtcctgacccttctctctccgcctcagtttccccaaggagacactggttggcgggtgggggagatgcttaggtccggggaatctctgagattctcggcttcccctctcccctcaccctcctcctcaggccccaggcagccccggggcatgctgggaacccaggcctgggctccgggccaggttggtgtgggggggtgggggcgggggcagcctcctcccttccccttcctccccaccttggcctgactctcgcccccgcctgagggtctgggaggttgggaaggagggaagggggaagagagctggccgtagacccgtctccggcccccgcctccccctttcctcctccgcccctttcccgcctctcctccccctcctcaggtcgctaccccagccctgggccccttctcaaaccacccccaccccacccccagctccagacctggctcgagctgcgagggggagggagagagggaaggagaaaagagagagagagaagggagggagacccaaagagagaagggggaggggaggaaagagagagacctaagagggagggaaggagagagagagggagagagacagagactgagagagagcaggagacggaggtgagggatggagagagggaaggggcggagggagaggaagtgaggaaagacatccgaaaaaagggggtggagaagggtgagaaagaggagagagactgagagagggccagagagagaatgagagagacaaagagggggaagggggagaaggggaggatgaaagacagaaggtagaggaaaagcaggagaaagagggggagagaaggaagaaaacagaagcggggagaggagagaggcgatgggcagagagagaagccagcgcagagccagggagggatgtcctgatgcaggaggaggctgggaaccagggaaggtggaaagaaagagggagagagaaaaaggcagggccagagagacctggactgcgagaaaggaaccggaaggtgcgcctggagcaggggcagcgagaaccagacagtccaggaggaggggctgggcacgggagagaccccagctggaggggctcagagcccaggggtggggagggtgggtgctgggtcccggggtccagaagctggagaaggctggggacacctcctggattcaagagggaggacagagatggggctgggcagactttgggagcctcttcccctctctgaggctcagccccctcacctgccaaatggggatgctgagggcacctcgctctctggagtgggaggtgtcagggagaggactggtgctcagggcctggtatggggtcagcgctgggagattgtggctgtcatagttgtaaatgacccaaagaagggaggagagaggaaagaaagcacctagggaggctctgatggttggctagcccctggcctccttagccctgggcctggagtctctgcagactgacaggagggtaggtaggaagcaggtgtgcccaaagggccaaattacgagacaaatgaggttccctcccagccggcacccaggaagccaggttttctatcaggccatgccttccccaggaggcctgcctggccggagggaggaggggctgggggcagggactcctgggtctctggggagaaggaggctttggatctggactcatgagtctgagggaggaaggggctgagtccttggattccaggaacatttggggagaaaagggccagaggcctggattcctgggtctgtggtgaggaagggcctagacttctgggttctttagggaggagggggatgagagccttgactccagggtccctgatgaggaaggggctgagggcctggactcctgggttccttggggaggaggggccgggggcccggactcctgggtcctggcacccacccgtagaaccgaccttgcggggccttcgccgcacacaagctcgtgtctgtgggtccgtgtcgggggctcaccatcgcggctggggcctccccggccctccccctcatccctggtcctcctggtccctgtctgtctgtctgtcgggtctgtccacctgccgcgccccccgggctgaggtaggaggttgtatagttgaggaggacacccaaggagatcactatacggcctcctagctttccccaggctgcgccctgcacgggacggggcccggcggggacccccagccccactcagggacccttagccccactgggctgccccagggaccctgggaggaagagccgggctcttttctgtccttgtccctgcatcccctccttcccctgaaatctgttttccttccctgtctgtctccatctctgctgtgtctctgtggcttctgtgtctctttcacagtggatcctctgactccctcttattctggctttctaggtctctgcccctcccgatatctctctgtgtctctatttctgtcgtttttggtctttctgtctctggctctcagaatgtctctgtgcctatctccatctctgacccccaccccagggtctaccgggccaccgcacaccatgttgccagtctctaggtccctgagaccctttaacctgtgaggacatccagggtcacaggtgaggttcttgggagcctggcgtctggcccaaccacacacctggggaattgctggcctgacttctgacccctgactcctcatacccttcctccagagcatgacatttgaccaccaactgaaacctgacctctgaccccagaccactggcccttcccccgccctgtggtgacttcataaaggttactagcttctcccctggccttgagacccacacgatggccctgctggctctggccagtgccgtcccgtctgccctgctggccctggctgtcttcagggtgcccgcctgggcctgtctcctctgcttcacaacctactctgagcgcctccgcatctgccagatgtttgttgggatgcggagccccaagcttgaagagtgtgaggaggccttcacggccgccttccagggcctctctgacaccgaaatcagtgaggagaccatccacacttcatcagtgtcctggggaaggtgcagagggagggcaggagaggcccagagggtcaggctgagggacagacagagagaaacagtcagaggagaaaggctcaaagaccatgagaacaacagagacttagggacagagagacacagacaggggaagacagcagggcaaagactcagagaggggaggatggagagtcagagaggggaagatggagactcagagagggggaggatggagactcagagagagaggaagatggagactcggaaagatggagactcaggagtatggagagtcagagaggggaggatggacactcgggaggatggagagtcaggaggatggagactcatagaaaggggaggatggagagtcaggagaggttggagactggagagggaatagagacccagagaggggaggatggagactcagagggtggaagatggagactcaaagaggatggaaacccagagagaggaggacagagatgaggcagagactaggggaagcaggatagcgactggtcgggggcagagactcagggaggatagagacttgggagggactcaggaagcatagcgactgtggggcaaagagtcagagaggggaggatacagacttgggagggcagagactcagaaacagaatgttcgcattagggacatggtgttgcggggagctgcctcccccagcccctgctccctccctcaccgccagactatgatgagagaagccacctgcatgacaccttcacccagatgacccatgccctgcaggagctggctgctgcccagggtgagtgtgtggggatg

SEQ ID NO: 2467 - DNA, 7379 bp, Homo sapiens
gtagttggaaacttatgaatgtagtatggaaacttatgataactacctggcttttgaacaatagtttgcagtagaggtcaatggcctacagaccaaatttggcccatagatatgaattatcaggaacctacagtattttttttaatcaaatctaatttcgttttccaggtctccccagtgcccaccattcttcactgcctggctcactcatttatatcactcgtttcaagttcatggaccttgctttagaattttcaagatattctcacatctatcagctcattcagtctttgaaatgttcctacaagcgaggcaacacagaaatcaaaatctccttttacaggtggagaaactaaagttccgggcagttgaactcctcatgtgggctcaaatgccaagaagtggcttggctggaagtagaacctcctgtgtggggtgtaatctcacagcatagatcaccttccccacagaaccctgaagaacacaggttgcctaacagcagtgattagcaggggagtgcatgctcctctaggagaacatagaccagggcttgacagcaggtggttgagaacaggggctccaggaagcctcacctgtagccctgcccccattcccaatcagacccagcaagccatggtgggaagggaagtaggaaacccctgacatgatatctgcgagtggactgtttgccaggcttttctgtggtgtggcatcattccctggggaagtgggttatcctgctgggagaatcctaattcatcccaagcctcagatgctctcaccatcctcaggtggctccctaccttacaactttaccaaaagacagggcatcccagggccacagattcccatttggagctactctctgggcctgaagagcttcagaattggtcctttctgaggaccctgtactctgggagatgatggacactacaagcaacatttcttaggccccaaggcattccctagtctcccttccagacccaaagtcatgagactctgagctagtgaccttgaggggttcctttctagaagaggaggtgcactcgagcaagggttctcaaatgtagctgcacattgggatggcccaggagagcattttcaagacatggattcctgagccatacccaggatgtactgaatcataaactctgcaagcaggtcctggaatctgcattttcactagctctgcaaatgagttgtatgcctaaagggacaggctgggatggagtcttcttcccagccacaaccacaaagggaatgacacacaccaggagctgtggggtgggcaccgaagctggcccaccttccttcaactccaggttgtttcaatgccggtacccagcctgtcctcaacagcatcggctcgcagccaagcaccagttccctgggactccagcttagggtccataagatttaaaacattttaatccaaagctgctgagcaggtgagacgcttccaaatgcccaacagccagctcctaccactctgagtgaaaagggccagacccgaaggccatgaaaccatttgccctgagcccagaaggggatgtgcagagtcagggataaccccatcacctgcaaggaccaccaggtatatgtttttcccacaccaggattggtggtataggggtaggaagcccatagtggcctttttgcttactttctgttaggaactgaagatttggggccctgctggctctgtggcttttgaataggggacacagaaatgcctaaatgtgcaccagccacttctccccatgaggagcctgatcaggtagttcagcaaaaggaagacagggctctacttctttattagcagacagtcctaatggtggtggggttgcaagactcagccaagaagcctaaggctggaaagacctctccctggaagctaaagtgctgaatggatagattcttgggagcaaaaataagacagtgctggagataaccaggccctgggactgcctccccacccccactcctgcctcccctgcctcccctgcctccccgcagcagcaatttcagcatcctcctatggagttctgccatcacgcctctgggctgagctgcccatcagaaccacgtctcacttctctcccctgcccacatgatgtgccaggagctctatgtgacccccttgctctgtgttgctgtcattgccctcttcattgtaggccaggtcaactccctatcccaaaccccagagaagtgccccacgtccttgagatcaggaactgaacttgacttccctaccactcatcaggattcaagccagtgccctgtgcctgaccggctcattcccacaggtgcccgtcactggccaaatgccccctccaaccttcagttccacctctgttcctttccccttgtcctgtccagccagctttcccttgtgaatgagaagggagagagcatgttgccttcagaaacctccctttcttgccttgcaagtccctcgaggtcccgtaacgtatatttcatctagcgattctctacagcctaacaccttgacccacttgcatgctttctttgcagtcctcatctgctctactacagatgtggcctctgtctgtcttttttggtgtcatctgtcttggactctccttctcaggggtgggctctgtgtcttcagctcattctatggtatcccatgcaagctcacacttactaaatgcccaaagcaggaatgatttttgctcaagactacccagaaagaagacccgaggctcctcagccatctccaaagtccagtccagtgttcagggctcctgaacgctcccagccagagctgagctggctcagctgttcagctccctggtcaccaggggacactagctacctcagaggagaagcaagtggccactgtgcctgctgggccgggacatggaaccatcctggaagctcaactgctggccctcaggtcatggagaatcccaagactcatcatgtgtgtggcaggggtgagggtggaggtcagaggttgggggagatgtcagactgggagatagaagcagccacagggaaaagcaggaagggccaaggtaggcagctcttctcagagcagcaggccagcagcctggctggaaggaggggacccaaccacaaacttgtggcctatgaaatccattcccccttcactggggattctgctcagcccttcctcactgattcccttctgactgcacattaaactttactacaacgcacagcttgtaaatggcattaaaacaatttacagcagcctttatgtgccttggtttaaataataaacatttttatttcactcttctgtgaaatgaaattcttggggggcaaagtatggaaaagtatgggaccaggaggtaggggtgggagggccaaatgaacagaaaataaatacaatgggcagcgatggggacgtgtgggttcccagattctctgaccacaaagagcttgtataccatgtcctggccactcggggctttggtggccagagtcctgcgccaagaaaaagcagaagtgaaccacatttgggatgttctagctgtgggccagcatgactactccttaagtggaaatcattcaagctcccaggcctctcgctaaacctgaagcatcagcaacagccagcttgttactttccttaactaatgcctttctgtttcctgcagagtaaacaacttgatcccattagttgttgtaaaatatttaccaagcggccgaggcggctcccttcttcccagcacgtaagaaggtagagagccctgggttaggcctctgaacacagatggacaggcatgaccagcagcttccggtcagtgtcacgtagatgggggaggagtggagggaggactaaaaaggggcggagtgagaaggagcaagtgcagacagacaaagcctgcctcgaaagggaaggagcactaaatgcaacgtgggggcctggatcagctcctgggacagaaaggggcatcaggaggaaaactagtaaaatctgaataaagtctggagttcagttaacagtgaagcatctgtgctggtgttttacttgtgaccatgtgctgcagtaacctaagatgacaacgtcagggggaactgggtgaggggtatatggaaactccctagtctctttataacgtctctataactctaaaattattataaagcaaaaagttttttgtttttttttttttttcaaatagcaaatgtgctatttggaggtgagggattctccatgacagctgttggcatttggggatagcaaaatacccacaggggacttctctgtgtgggacctcactggagagacagcctgtgagtcacggccaaattataactaaagtggaaagggcaggaaacagagaggggcgttcttcccacagagatgaagtcaaggaatcaggccaagagatgctgcgccacctcggagaaaccaccttcagggcaagaaagttcgctggatggaggcaatgaaatgaacagggtggaaaacctgacttgctgcatcgcccccagatttctgactctgggcacatgtggttacacccttccttggccctctcctcatgcaggcaacagtcagggactaacaggcccagcggatcaagatggtgcagagggaaggcatgacggtgaatgttatgcatccaccgggctaggctgcagtgcgcagttgcttggtgaagcaccagtctagatgttgctgtgaaggcattcttagttgtgattaacatttgcaattagtagactttgagccaagcagattaccctccataatatgggtgggcctcacccaatcagttaaagacttaagagcaaagtcaggtttcccaaagaaggaaaattgcctcaaggctgcaacacagaacccctgtctgagattccagcttgccaggcctgccctacagatctcaagctcaagactacaccaactcttacctgcccttccagcctgctagccggacctttggatttcagagttgccagtccccacaattgcatgagctaatgccttaaaatcagtccagctctctctctcatactggctctgtttctttgaagaaccttgactaataccaggcaagccgagggcctggagatcatgggcagggatcagaggccccttctctgctgccctgctgtgactgcctctgtgggttcagggactgggacaccatttactggggcttccaccgcttccttgctcaatcaccaaaataaagccttcacattgactgtcttagaggatgtctttccttgtactcaaaagtgacagcaaatgacaaagatttcggaaatagcttggtggacatttccccctcccctccgcccacccaactctcattttcaacttaaaaacatgttgctcaacttcctgcccagttgtgtgagccctgggctgacagcatttcctcagtggtgaccaaaatgtgccacctgccaaggagataccccactgagtgctgagctacccgatggcgctccacgggaccatcctgctggaagaggctgataatcctgaggcatcccttcacctgaatgtccttggcagcaaagtcagaagtagcacccaggacactgccccctaccccctcccgtggactctaagctgacctaggggtccagagatctaagctgcagcctcagcactccacatggcaccaagtccttgtctccctgtacttctgtgagccttggtgtccccgctctacaaagcacagaaccttcacctggcagaaacatatgtgacccttacagctgggtggatgacagcagagaggtcacatcctaggggtcactagggcataccctagaggtcaaacaacagagtgagaagctgggcattttccagggctgataccacccgcactcaggacactttttcaaagagcagcggcctgctccccacggaagcctggcctcctgcgggacaccagagcatccttcctctgctcagccaagacaccccttcccactgcagcagcctggcactctagctcctgccctcagctcaccactgacccaggagggacatatcctcagggaggtgggagagcaactccagcctcaatcagcctccactgcacaggacagcaccggcggcaggcgctttagaaatccagggcctctttgggagcttcttttgccttcaagtgaggactgccagatttaacaaacaaaaatacaggacacccaattaatttgaatttcagatcaactacaaaacatctcatgcattatttgagatgtgtaataaaaattatttgttttttctctgaaaccgaaatagaactgggtgtccaatatctcatctggtgtccctcctccttcaaaaggaggagagccgtgagggctacagcatcagtccttgcttgtcaccagcctctgagtgcctagtcccagttcctcacagctggagccactcactcagcccggcctaaccctaagctgcggcagaaggggtttaaccagttctggccccacacgaaagcagagccccaggctcccaaacagctcacttgcccccaagccctagtcttgggtggcattttttggacctatatgcctgtgctggtgttccactgggcacttcttcaaggcccgggacctgcctgataatgccaggttctttgcctgtcctcatatccactgtctgtaccccaacataataggtagagaaccctgactccggggggcagtcagtcacttcatctggtagatctgagactaaagacagttataacgcctgaaccctgcacttacaggtgccaactcacccgctagcacctgcagctgggtgaacacctcacccaagtaagtgggactcttctcaaaccccagtttttccccacccgccctgtcatgccctcccgtcctacacagctccaaccccgatagccatggttcagatcttagctaagtctggtttttgatcaagaccactcttcaaaataaggccgacaaaaatgcaaccagggaccatgccacgccagaaatcccaccacttcccctgaggcatctgctccattttttagcctgaatcccaggatggtcctgccgccactaaaaagcagttgcctgcttccattactagattctcctattgctgcttcccaggagctcaaagcccacaaatacttagcttctgattagacaggtttcttcaccacctcggcatccatgctttctaacgagagacatagcagggcatccatattttactgaggactaaatcttttcttctcatgctggtttttagatcatagcatttaagtctgatcaaggctggtaagacccttctgggcttctcttaccagatcttacacacccttgagcccctgccatcgtttggtaagaatcccacaatagtgtagttaggcaaaacccaaggaaagcaaaaa

SEQ ID NO: 2468 - DNA, 6925 bp, Homo sapiens
gaacatgttgcttacacccaaagcaacagggaaatgaggctttattgcctctcttctttaggcttcaatactatcaatgttgagaaaacccttgctctccatttccatttgattatcctgagaatatgccttgtactcaagaatttctaacaaaaaatcaaatattttatttttaggaacagaaagacctatatacattaaagattgtctaatcactacaccttaattatggggattatgtggtcagttgagttaagtgatttattcagagttgcaaggttaattaaattatagaccagatttttatcctgggatctacgaataagtttcaagggaaggatgaaccttcaaaattttatgcaaattgtgtgtgcacagctgtgcatttttttcatctgtgcatttttatggaaagtggatccacaattttatcagaccctcaaaatgtccctcaacatagctgggacagttactgttgcaatttataagatatttttatatttataaaatatagtaaaatattaaaggtcatgtaatccaagcttacagccaataaatggattccttaaataataactctgatggatagcatgcaaactctaccttgtatcttaagataattgataaccaaccacctctcatgttatcatggttcaaagcttgaattaaaaaggtattcatatagctgaatcatattatttctttcctataccttctcacattggtctaagtactaccctttgcagccatgagaaacaaaatcactgttgcttactccaatgtctttcatacatttgaagtaaattcctgttacatttcttcttcggtcataagagccaagatccctcagtattctagtcaccactctagactcaaacttagagctggaagaaacacatttcagtttgtcagtattctctaaaatccatataacaaaaaacttaaaaacaatgttctacttgtgatctgacttgttgatgactatctccttctggtggatgtgttctctctttttgctggggaaatcatggtattttacggtctaactgggaagatcagagcctaatgatttttatataggttttccacctgaaatgcaacaaagtaaataatatgcagctggccattcagacccaactctagataatcacatttcaaactttaatagtcatgaggttcacctaaataaacactggcaatttccaaaagagaaacattaagcacttttatttagatgaataatccagtactttgcccagaggttgagtcagaaacaaagaacaaaaaacctcagatttataaaatgagtacagcaaagatgacttagagtataaagtttttctatttcaaatgtcagaaaaatgctcaccagatttacttgattacaaagttccaaaaaaccttttattttgcaatactcactcatatcgcaaactttagtgatgtagcaacaattatgcaaataatttaaacaaagtaaatggactacatgaaaaattcaatcctcatttctatattgattatttataccagcactccccaaagactgttagaagcaacattgatcctaccaaatgctcagaaaagataaaaggccaacaactgaatacacttcaaaaacacaccttaccatacctgcttcttgggactcccactgcaaatgacatattttagtctccaagaacccctctttttaatgacatccattagcactccacaacaccattgttccttataaaagacattgagcattgctataccatgttgatctaattaaccaattttctgcaaatctctactttactctgtgttttaacatctcaacaagtatgagtgtagactcttgggtaatatgatctcattctcctctatgagagcctcctctgcctggttccctgtgagccaaaccacaccccaaggaggagttaatataattacttagattagggcattgactgttttacctaaagaccaggatgtccatatcagatttattttattttattttttattattattattattattattattattattattattttgcctcagattgaggtagaagactctgagactgtgagatcaggataaaaattgttgttgatattcctcttccactcccggcagctggatctctaattgaactcttctgctccctagctcccatactctcacttgcaggaagatataagaacaagagtgacaaaaattcaaatttgcaaagaaatctctcttaaatttcaaggtcatattgggtgatttaattcaatttttatagagagccctgaatttggaaagaaagaaagagagagagaaagaaagagagagagagaaagaaaagaaagaaagaaagaaagaaagaaagaaagaaagaaagaaagaaagaaagaaaagaaagaaggaaagaaagaaagaaagaaagagaaagaaagacagacagactagtcacatattctgtattgttttctgagaatcctggggagtaggggttactgaggatggtattaaaatcatttgcaggtcttggctttaatatcatcaaattagccccaaagttatttgtgattattatttgcttttgagttcttgtattttaaacgttatcattaaaatatttgcaggtagataaggaaaagctccagatttgcttcaaaatgatgcagttggaaggtagagattgaaagggttagggttacacataaaatggtagttagaattgcacgatggaggctgggtgtgggctcacacttgtaatctcagcattttgggaggccgaggtggggaggatcacttcatctcaggactagcctgggcaatatagcaagacctcgtctctatttcaaaaagaagaaaaaaaaatagccggctgtagtgggggcacacctgtagtcccagctactccggaggctgaggcaggatgattgcttgagtccagaagttcaaggctgtagtgagcatgctattgtgctccagcatggaggacagagtgagactctgtctcaagaaaataaataaataaataaataaataaataaataaataaataaataaaattgggtgatgatttcatttggcttccttttacttgcctgttctcttacttgtgtgtgactgataaaatctgagattataattaaataataaagcaccaaaatctcacacagaactatcaaccatcataaataaactcatagacataagtggaagagttggaaagtttttgccaagtggtcaagatgttcactgctgtaactaagagcttccactgaagttactattatcaaccacagcactcataaacacatagcactcctgggcacattttctatttatttaagtgacttaccttatttgatcaaaaagaaaatattaaaatcaccataaaactatgtaattagtgattgcatggtgatctttatgtgatgaaatttttaacagttaatatctaatatagaattaagaatcctacacaatattttaaagttatattttcaaatccatattttgtggatttcaaataattccagtttgaatgcttgcaactgcaacaggtttctgtaaaagcttttgagtttcacagccttccttttgacagatttcttaagttatggaatgcagccatcagcagtctgtagaaaaatgaaatgctgcaagtctatttttatgcagctgggatcaagttactaaatggatcaaaagaaataatttctttgaagaggtggctgttgacaccagtgccctaaaaataagtgcaattttgtgggcataaaaatttgtttatatcttagtgaaagtaactatagatatattttctatatatacacttgcattcatgatatattggatgccattctaaacatcttttaatataccttagtttaacattgcttttaagaggaaagttgcatgctttctcttgaataattgatgtagctaaagacaattattcataccaggcttagcttactgggtttataataaaaacaatgatagtaatttacctaactcttactttgtgccaaataccagccaaatacttcccaacattatttcatttgattttagaattacattttattttaataactagctattattttcacaattgtatagatgaagaagctgattcttagagagtgtaacttgccaaagattacacggctagcatgcctctgagttaaaatttgaaagctagtctgtttaattctgaagctcttaatcactaaattttatactacctctttaggttggatggcatatcaactgatttgaaactatagaaaaaaattaggaaacagaataatcttttaaaatatctttgtatgtgaaagtaagcttgcttatagaaaatgtagtaaattgaaagactattactattgcaatagcaatagtcaaactgaagcctatagaactcaaatgcatgtaagtgtcaaaatagccaagtaataatgcgatatgatataattttttatcataataaaaagtcagaaaacaaaattcataaagagggctctatgatacaagaggaaaggttgatctaagggtacaaactaaaacattttaaataaagtttttggaaaaaacaattttaggctccgaaataagaaataaatacaaccccttcacagataataataaagaaataagccaataagcccttaaaatagaacgatatagtcttagctctggaggacaaaatattctctacttggaccctgactcatttagaactcctgcacataaatacatatatatatacacacacacacacacacacacatattgactatattgctgaaggggagagtaaaggaaatggtgaaaggatcatcatttttattatttcattaattcctgaagaaaacacatacacaaattgcaattgaagcttctaaaaaacctagaaaacagtataaaggacttagacacagtacaagtatttcctaccatgtaagtctgaaagagagaaaatcaatttttatgaaaacataaaacagtgatttgggttgtgaacaaaattatttgtctccatttgtgttctattggcttactgctctgccaaattttgaagcaaaatgaaaaaaaaaaaaaagagagggaaattatagcaaacctcccaaaacatatcccttaaactccgcaatgtatttaaactacccaggttctgttcatggatatactcaaacattgagaaattgtgggtgtactgggttttgatgctgtactttttgtaacaacttgatattggagtcaaaacatgtttttctatcttgtgttgctcagaaaggtatgagcaaatatatttttcccacaaatttcaattaattaagaatgattaaaatgtggatacttgcaagggaaacattaataaaaacatgaagtgtagacatagagataattttctctgtggcggatgactgatcatgtcattaggcagagctttgttcccttaggctctgtagagtcagagctaggataaagaatcacagatttagagttgaagaaactcttaacaataacttaacaaccattccaatccccttgatttatagataaggcaggttagtcttagaaagaggaaccggttctttgtgtgagactcaacaagtcacatcaccgctctgcgcttctgttcccaaattctttttctttctttctttttcttttcttttctttttttttttaaatgagtaagggatttcctttattattagtgagattgaacatcttttcacgtcattattgaccatttttatttttctctacaaactgattatccaaatctttctcccatttttttcttttaaaaaattaatttaagatccaagatacatgtgaaggatgtgcaggtttgttatgaaggcaaacatgtgcgatggtggtttgctgcacctatcaacccatcacctaggtattaagcctcccacacattagctatttatcgtgatgctctccctccttccaatccccctaacaggccccagtgtgtgttattctcctccctgtggccatgtgttctcattgtttagctcccacttataagtgagaacatgcagtgtttggttttctgttcctgtgttactgtgctgaggataatggcttccagctccatccatgtctctgcaaagggcatgatctcatcattcctttttatggctgcatagtattccatgatgtatatgtgccacatgttctttatttaatctatcattgatgggcattttgattgattccatgtcttttttattatgttctcacattcttaaaattaaagttgggactagttgatctccaaagtgcccacatactaaacgctgaatggtttcaaaagaaaagtgagttaatggcagacaataacctcagatctcagttcctaccttgttctcaccagtccagtttgtgttctgccatttgctcatatatttcactgtcactacgtacttatgaaatttgtaagtcaataaatggtgaagaaaagaaaaacaagaaaagtcatccacattttagaagggcaaaattgtgagtaaggagctgagtggttgaatccgaatattttcattaattccaaacaaaggcaatggaaagtgggaaggaggggaattgcagttctataagctatagttgctccataggagaaagggaagagccagcagtaatcaggactttttaaaagaactgtccaagttcaatgacaatatcatctagctctctgactctaggcatctgccaagaatcatggaatcttcatctcagtaaactaaaaccaggctagacaaagcaggcacaaagaagaagagaatcacattcaataggttagtcagtatatggtaagctagatcagccatggaaatatgcattagtcaataagtttgatacctaaatcaatggagacatggtctaataactgacctttcattttttg

SEQ ID NO: 2469 - DNA, 13027 bp, Homo sapiens
aaaacagatatgtattgcttatgaataatgaacagatattcattcctattagtattcaggaaatggtaaaaatcaaactacattcagataccatttcatagccatgaaattgacataaaacgaaaagaaaagagaataattccacattttgccaaggctaccgaaagtcattcttatatactgctgatgctgataagataaaaattgaccaactgtaataagtttcttttggcattatgcaatcccatgggaatttcacatattacaaagaacttgggtctcagtccttagaaaatagttaaccaggatcagttaactaaacatttgccaattccttcaactcatttgtcattgcttattgttctgctcatttgatgataggtagtcaagtgggttctggttcatgtatgtgtgtgtgtgtgtgtgtgtgtgtgtgtgtgtgtgtgcgcatactaataattatatatgaaaacaatttatattgtctggcattgcaggtaagttagcaaaagatacagaggtcactaaaggttgctgggactattggttatctataagagaaaaatgaaattggatctttacatccttttgtttcccagaatcaattctacatgatgaaggatttaatttagagaggcaatctatgaaagcttttgtcagacacagacacacacacacacacacacacgagagatccacttatctgaatatggtatttgcaaaattttacattcccactgaataagtagatctctgagtcagcaggagccttaaagacaatcctgcagcccaacccattaatttacattattaagaaagcgaggctcatggagtttatatgaccctcaaattcataaaatgtgacagtaacagaagtgggactaggattcagactactaatccagatactgtctaacatgccacaacacctgtgtgtcagacagaagtgatatatagcattgtgaaagaaagaaaaaaagagaaaaaaaactgtttgtgaagatatgtcttagtaagaaaataataactgtgttttagtctacttagtttaaaagagcaggtaatatattaagaaagattccacttagataactaaattataaagttttggagcttgaagagttttggtccagtaagaaggctgtagaattttatccaagatatcttgtatcattccaaatctgcataactcagaataaatctcaacaaaggttttgtttgccagataatgtggcatacccaaggggttaaataataaacagtttgcaattcactatgtaataaactttgaagttatatgggtgttgatgtatttttaacactatgatattccccttacttaaaaatgaaaatatatcatttcttttgtattgtttaattccaaatttaagtaattcaaatttacattaaaggcaaccacatagttttggaaaaaattcagtctgtggaatatgcaattaccttaaaatgccataaatgggacataaatctaagcagggaaaatatttcttcctatgttctttttcatgaaagaacatatatactacatgaaaatacaaaaatcactttttcacaatatataagaatattatgtttcatctaatcatttgctaccttacaatctttgtaagtaagctttgtgctattctataaacaaatactaagcagcagagtgtttacatatgtgtttctgctgaacacttaaagaataagtctacgtccatttttaaatacaagtcccaaataacttttgcatttctactatgtgctaaaacaacgaaaatgaaaaagaaattagacccaaagccacgtaaatgtcaataaatacttatatctaggatacaaagagacctcttacaaatcaataacaacaacaacaaaaaacaaaaacgcaacacaagccaatgggaaaaaaatgataaagtagttgaacagacattaaagtataaaaggctatcttcaaagaaatgcaaagtaaaccataatgaaataacagcacactccacagaatgaataaaatgaaaaatacaaaaaaatccagtgtcagtgaggatgtggggcaactagaactctcatacattattggtaggaactattttgtgaaattgtttggcattctcttttaaagctgaacttgggcctaccctatgatccaccaattccactcataagcatatatccaacaaaaaatacacatatcatcagaatagcatactagaatgtttacagtgttaccctgcataaattatctaaaacttaacactactgaaataacaaccaataatagaatggataaatttcagtatagtcacacaatagaatattaaataacaatgtgaatctatgagctgcaactgcaacagaaatacagataaatctcacaataataatgtttagctaaaaaaaatgcctgacacaaaagagaacatagttctgattccatttatataaaaaatttaaaaacatgcataactagcctctgttgttgtaaatcaagacagtggctatgcttggtagagatggagaggggatagtagtgaggagaactcttggggtacaattaatgttgttcttgatttaagggttgcctatgggtgtgctaagcgtgtgaaaaattaatttacctggacatttatgctacatttatcagcataaatactatatttcaataaaatgtttgaataatctggatgattaagcataaaatgaatttgtctgatgaagtattttcttcctgattaataagatgatatgagaagacactattcctattaatgctactattaatagtaaaagctaaaataaagccaatagtaataatttcaattgtcactttttaaaacttttcaatgaatattaatatcctttaattaccatttgctcttaagagtaatctctcaagatttaaaaaatatatatatacgctgcttggtagtaattgtttgaagatccatatcttaaatgtgttgattaatggattgattcaagatgaaaagagcctctatttctagccacagcaatgttatgataaaattgggaaaaagtaatatttaaaaatttgaagcatctttccaatagtctacaacaattgattttatgttgccacacagttggaggaaaatatttaagagtctgccatgggatttcagtcccattccatatccgacacactataacttagaagaaaattcacagttcttgctcatctaattttctgagagtaagctcaactttaagatttttttgatataaaaacaaacttcttatagaaaaaaaagttaaccattactgaaccacttcattggatgttgtagaaggtgttcaatccttagatggtagattgaacaaatggattggtttcaacaccaagaatcactgatttctactttacgggaaaaaaaatgttaaacaaagataggttaaatgacttcctaagttcacacaaaaattgattctcaggacaatgctcctttgcattaccagtgcatagaatataatctcattaatttgacccaatgcctctgtatcttctaacttcactgaacttcttcaccaaataaataatctgcaaggaaattaccgtacatcttaaagacaaggatgcctgcgggcagaacgaagtcccactgtccccagttacatgaagaatgtcaagtcatttttgtatgccaaaaaactagccaatattattattcttgattatattgcttttcatacatataatcccaaatcacacaggttggaaggttttactatagttatatgattcaaagattatgttcaacataaaccagaaactaaaatcaatatatgaaaaaacaaatgaatgaaaaaagatatttgggtgagagccctgcttcatttatttttctattctagaagtcaaatacacaaaaatattgtgccaaaaacatccttgaccaagcagatgtacacattagaagtctgcattattaaaacaaataagccaggctgtctctgctataagataaaacaactttagaaaagcagaaaaggaatgtctgcttattgaaattcatatcaaattaaatcctcagtccttaagaaatttactattatcttatttgccacgaactgtgtaactgagaaattaaaacaataaattgattattacaagtaaaaatcacattactttcaagggagagtagttcactcattagattttctacgtaatatatgttgtaaaatattctaaaattaccaactatttttcaacatatgtaaattctgagtctaacttctcttgttctgcagcgagtaatcaagatttataaaatattcactcttcaagacttatctcacttaggtaaacctcgagaccaatccagaaataaattgccaagcttctatcaaataattcaaaaggagacccaggactcttgatgatacacttgaagtcactaaatatgaaaggtaagttagacttagacattatttagtccagtgccttcatttattagatgaacagtgtcagggcccaacagacaaaactatggtcacataactaactgaggaaaagtcagaatataatccttgccctcttgataacagtctcaggttcttcctaatttctagatattgccataaaatgagcttctaattcattaccaaaaactaaatgcagcttaaatttgaggatatttctgcaaaagaaaataggacatgttccaaaactctagtacgataattttccaatcttattgtgcaattgatttgcatttgttaaaataaccaaaggtgctgagaaccaaacaggccattctgtgtctggctggactgactagtcagttctacatataaaatgagacacacagggaaaggaatgaacaaatgatcctggaattcattaggtgtgcaacatttcaatttctgggactgactcagattcaagtacctacaatgtaatctataagaactagatgctgtatcttttaacctgaagaaaatcattaacacaatcaaaattaaaagtagcttcatgaatatggactttataaagattctctgcaagaaatttgaaaatttctgggtgccaattaatgattacttaataaataagtaaattataataatgttattatattcaaggagatgtataggtattttgtatttataaacagtcctcatttatgaaatggatatgaagtaaataaatttaactatgaaatcatcttattaccgacttggtcaaggcaatatattctgagcaatttatctatttaaccaaaccccaaagaatagccaattgcttctttctccctagaatcagactggggtggtctgtaactctaaaaatctataatttaatttatgcaaatattgtggccatcttgtaagctgttctaaattatagaatgtatttttttaatatacacagatgatagcatcttggaaggcaagagcagaggaaaggagaattttcacagggaagaagaaagagttggtgaaagtgaaattgctttaacaaaataatgatctctatacctccttctcgaactgtggtttgaaggacagtatcatcagcattacttggagcttgtgagaaatttagaatttcaaggccccctcgaccccaacttactggtgcaaactctgtattgtaacccgatccccaaggtgattctagtgtacattaaagtgtgagagtcttgttatgaatggattcttatagtgctgcaatttagaacatcttttaagaattataaagacaattttgtgtctcttgtatctgaaataagtattaaaggcaaaatatatattgatatcatggcactgttcttaaggaattaacatccagatgaattattttgcatcttttcattggaaataaaaagcccggggctgggtggcgggcgaaagaatcagagagctctgatcagtgtgtagatgtatcaatatctatttaatatgtactccagcagagagtccaggctttaaatcattggaagcaatctctcaatttttattctcaacatgtttcacctttaggcaatattacaataaaattctctgtgggtttgtaaacttagtgccactcttctggataaatgtaaagggtgtataactcctggtatattctaacaagtcatcattattggtgaatatacttaacaagtttcatgcaactgcatttacggttctccctagaaatgtctttgttcatacactgctgcaactgaaaactatcatgcattctggatgtaaactgattcaatgaaaacaaatgggcctgggctgtcacatttccacttactatagtcaagtgaacttggaacattttaaagttagtaacacttagaaatgcaagaaatatatactgctaactcaaagtatcctatgttttaaaaaagaatgacagttttttaaaagaaagaaaaaaaactaaaattatcttgatatccccagcacattaagtagaggagagggtaataaatatgtgataagtgtaatgagaaatcatgctggatgggaagaaatgtacttttgtaactccatccattcgtgtgcttcatagaaggcttgaccaaggctttttggtttattttgttttgttttttttttcagatggaatgctactttgttattaaaataatgcaaagaagtaggtcagtatacactaaaatcagtataaaataagaacacttgaattgttgcataccattcttcacagtaggagcacaagagaaggaacactgaaaacctatggcatatctttgatttcaacacagaaagagcatagaatccaaaggtttaacacatgcaaatcccctattctagatattagaaatacaacagtaaataaggctctcagggtctccactctcatcaaaccagtgatggagagataaccataagtgagtcaagtataagtgagttatatgtgaaactgagcaagcaaaagagtgcaatgagggtgtgcaataactgagcagggaagttgttttagatgattggggaagctttatgagacaatgatgattaaattgagatcttaatgctgaggaaccacttgtgggaagatctggacaaagaatagaaagaataggaaaaaatccagtgagcattgagcacagtgacactggggcaatgtgggaatacaatgaaatcagagctgtgggatggggctatgtcatgtaagtccttctaaattttgggcaaactctttgattttattcgatgcacaatgggaagctactagagttttatagttaggggaatgacatggtttgatttacatctcaaaaatataactctgtctattgtgtggaaaataaactctgcgtaggcatggaagtgacagcagtgagtccaacatttatgaagttatagaacataggagtacgggctatgaaattatacatatctgggttcaaatcccactcacatgagcagttgggtaaataatcaccttaaagtcttagttttcttgtcagtaaatgaagacaataatactaggatctattttatagggtagttgtaaggattaaacaatatatgcataataagctttttaaagactgtcaatccatgggatatatttgtggaatataaacagaatatttatgtatatatgttatatttcttcatctactgcttttaaccattaagttacttcttttccccatctcttaatatcttgggcagaatcactgaatttgtggtcacttttggtttttaaaagtttgggctaatttataagttaatcatgtcatcatttttagttgaagtggaggaggaagatgtagtatgcctctaggtgtcttaccatcaccgccccctcaagacctggcccttccagtttattgggaaggagctgatgaggggaagagaaaagagcagtggttattcatatagtcctctttctgtgggctgtacctgcttctctggttcacccttactgacctctgctgcccttcatgcagtagactcatgagtgctccatgtgacttcccaacagcagtcaacaacatgagagaaattcatctgtctcatcccccagctcatctcccagctctaaccttcacacaacaccccatagcatctggctgctctaatcccctggcccagctagtggccttcttgtgagtaataccggctaggtggctcaagccaaagactcaaagggatatctcctttactgatgcctgtgggcattctggctgcaccgaatgttgctggtacagattaaattcttcttttttttttttgatagagtctcgctctgtcacccaggctggagtgcagtggcgcgatctcagctcactgcaacctccacctcccgggttcacgccattctcctgcctcagcctcccaagtagctgggattacaggtgcccgccaccatgcctagctttttttttttttttctgtatttttagtagagacggggtttcaccatgttagccaggatggtctcgatctcctgagctcccgaccttgtgatctgcccgcctcggcctcccaatgtgctgggattacaggcgtgagccactgcgccgagccagattaaattcttcttgtcccctctttctaccctgccagtcctcttcttccctcctcagaaaggcatagggcaggccagcaagtctgatgcatacaaagtcatgcattgggaatgcagaacaccagctttcatttctttcccagcatacacaggctctacatgtgattctatagtttcttccctcaattacttttggtaaaaaaagctaacctcttcattaacaatatgttttacagagcctatgccttaaagactctgtgctgacctatccgtcactgcttaggtagataagggaggtgggaagtggggagttagaagtagttgaagggtcagtctttcggtcctgtagtaaatgctgaggaaggttaactggccagtttagggaggttccatttacaatgaaggctacttaaattcttttctttcagaaggttctaatcaacaattctatgagaaaaatttccattcaacatatggtggacaatcaattaatgttagatattatgatcattattattaaagtaaccactacatttaaaatcactactcagcaattttaaaaaatcagctttttaccaaatgttttattgcccagaatatcacgatgcccaacaccctcattctaggagcacttggttaattaaggctcattacataagaacgagattgaagtattgtaaatagaaaaaaaatacatgtttctattgatggtttattcttttaaacaagtttgtgcctgagtaacttacaaaataattttataaaatatttgctatttatttatttttttatttgctcagggaaacgcatcaggctaagaattacgagagtgaaacactggtttcttcttggacacttttcagctctgccctttaccaccctacttagcctcactgggcctcattttccctcctggcaaagtgacacagtcagactaagtgatctccaatgtttctttccattctaaaactctatggttctataacattctcgatttattgagccactgtttcactgattcattcaataaacatttattgaagcccaattctgtgccaaactcaattgctctcctgctgtcaaaatcaggcaacatgctagagttaaaatgtctttaaagatttctgatggctgctgcttttaaaaggaacttcccatagcaacccctacctctttgtgcttctagagctagctctcctattattctgtgaggacttacaaattcagaaagacaaaggaatatggaaaggcctggtattcacaacctactagatgtaaatttcctattcctaatcacctttcttccacaacccagaaaacaataccttcaatggatttgctagtgttacagattgtgtttgattatttgtccccaaatttaaagtacttcttcatataattgcaaatatacgcatagaaaataaaatattttaaaagaaagctaatattatatactataagtcttaatttgagattatacatatttatccaataaaagtatagaaggatcaatcaatactgactagtgtttccctatgggctccatggatagagcccataatttgaaattaggagccctaggttcaattcctcactttatggttggtgctatatgtccaagagcagtaaatgtagctgagtctgactttatttcaatataatgaacatagatattctgttatgctgcattttcagatttttaaaaaattaagatctttaatataaattatgaaactgttcttattaattatatactgggtcttccataacttcccgttaccccatctatcatacctgtattgaaaacatcattaatcaacattctctagctcagtatttttcatcccagattccctatctggtttgagtactgttttctcaagtatctgaagggtagtataaaaccagcatcattccagatgcataggagataagttatttcattaaataagacagactccttagggttttattcccgtcccaagttcaacagagttacagattaagtgcaaacacacagaatttatgagaaagacttgaggtaactcacagaatagaaggaattgctaaaccacgaattcttggagaggaagatactctgggtaaacccaaactcttgaactcacagttcctggtctcctctaggtttgcaccactcatataattgagctccagtgaacttgaggtaattcttttcaggttctgaattccccaaatcagaaaacttggatagctctacttgtgttagaagccaattcccagatcagtctttgtggctggaatagggatgaggggacaagattataaagcagggacatgccagagaatggctgtgaggggacagcctaatcattcattaacacctggtatggtccacaagttagtatttagatctagtatttaaaaaaaaaaattttcctaggatgatgaaattattaccatctcttttttagttttacctttgacataaatttagatcttaggatccaaggtaaataatgaatttcagctgaattgtgacaagctttatttcaattgtgcatctttatcagagatctaagctaaacacagaattataaactttatagttggaagagggagatccataacatttacgagactttctctggtgcacaggcgaagttgggatgaaaaactgggtctctagatcagttgactcaaaacagagatgatcatcagaatcacctggaaaactttctacaagagtatatttccaggaaccctacccacttccactttaacaatattggggtggatctcttgctaacatattattatttttttagtttctagttagttccaatgaccagtttattttaaaactcaatgttttgcagtttttgcttttaatttttgttaaagaaatgggccttctctcaccttattctccatgaaaataattcacatcccaacaaatagcacaaaatacacaataaaatagacacattataagagaagcaatcaaaaagcagagcacattgtcactacttagtttggaagcaatttcattggttagagaacattctggccaaactgaataacactacctcttgaatatgtagttataattcacaatacttccattcacttctcagagtgagcgttctctggtctcatggataggacgcattccacattcacaggctccaattgctttttttgttgttgttttcttttctacttgtgggtaaaccaaataccatattaaaacaaattatttctccttttaaagatcattttccttgacagtatatggcaaaaatatttgatatattttatagcccatgcttgaaataagttgtctcctccaccattaaccatatgatatgccttccctaccaacaattcacaaaactatacaagttaaagagatcttccattcaagggctttgaaaaatttcttcccagttacccaggacacatatacaatacctcagctttctaccctcaatacactcttctacttgtgataggaatagaaattcttctaaattgatttcataatccaccaatggttcaccatccaaactttggaaaacacaaacgttattcaacctttccattttatacattaaaaaaatgaaggtccagggaagttaatagacttggcaaagaccactcagcttatgaatgcattggactagaatttggctttatgaccctatatcctgtgttctttctatcacacttttatgcatttatcatttttttctttctttctttctttcttttttttttttttttgagacagattcttgctctgtcacccaggctggagtgcagtggcatgatctcagctcattgcaatctccgcctcctgggttcaagcgattctcctgcctcaggctcccaagtagctaggattacagactcccaccactaggcccagctagtttttgtattttcagtagagacagggtcttaccatgttggccaggctggtctcgaatgcctgacctcaagtgatctgcctgtctcagcctcccaaagtgctaagattataggtgtaagccaccatgcccggacacttttctgcatttttaatgccattttggatagatttaaatggacatctttacagtttcaggatggaaatattcattctgtaaaatacatgacagtctattttttcatcatgacattccatcctaatttgatccctatcctagatacctaattttataactccttgagaaaatatataaaattataccttcataactttcatataatcaaacaatattatcatttttctgttacaatatcaaagtgaagtaatcatcccaactacctcaccatatttgcactaattatgttagcctctcaacatcaaattttgttttttgcagtttcttttcatatgtattattataaaattctttgactcaaatgttcgaatattcctacttaaaaacagataatggattttattttgatagaattcccacaataggaatagactctatatcattttgtaataaa

SEQ ID NO: 2470 - DNA, 8739 bp, Homo sapiens
agaagcccttcagcctttcctacttcaggtcagagttctttttatatttggcatacaaccgagagacatcagaattctatacaaaatggaaagttttattcttcccagcaattccactgcattctgtggcctcttggtgctgtgggcagccttagcagatttgaggcatctcttagggcaaagcggttttgaggtattcttggcgactgggaagaataatttaacttctcttggaataatatcacattcagcagaaaagatctgctgtgctcaaggtcataaatcttggctctgtgaatattcagttattcagcagaacagccactccaagccttcagagcacttttggatgctgctgcaggtgtttcctgtagagaactccctgacatccactgagttcttgcatctgcctttacccttcttgatgctgtccattctgctctctgaacaaacatattctcttacacttatgcacatgtatgaaatcctagagatttccctgaatcaacatatgcatatagatatatgatggacagaataaagtatcaagggataaaatatatttttaattttgtatttcacttgaaaattgtaaggaccattttataatgtattgcttgcaaaataagtcatggaagccctgaaaaattaatcaattcactaatcaaagaaacatatattaaagacctactatgcatgaggcaccatgctaattgctttgaagaagacaaagttgaattagacagggatccagtttacaagatatttacaatgcaaagggggatacaagacatataaaaggctatggaacttaaaaagaagaaaaaacaattctaaagtattgagatacatttcattacaaggcaaatcttagataacatcttgaaagaggacacatttaaaatttaggagatttgaggaaaagatcctccagagtatgatataaaaatgagtgaaggttttgaggtgagaaataaaattaatgaaatttgactcgatctaaggtgacatcatgaagaataatggcaaatgaagttaataagtttgtttcaggccagcttgtaaaaagtccttgaaaaaagaaaaaggaattccttatatttttattagaatatccatcttaaagtgaatggtgaattattgattggcatggatttagggacaattgcatgtcatctttttctgttattagtattactgttttgaagaatgcaatctaccaaaattgaaggtaatagtttcaatgtaaaaatatgcagagttaagcgtttggaaagcactattcaggtttagtatataggaggaaatagggatgggaatggtctattactagacatttttattcttcctacttatcaaatagaccaatatgtgtggaggaaaagccttcttctaaaaagggtttgttttacactacctgtcaaagaggatattggttcactcaaggaaactaagttatattctatttaactgtgagatatattccaataaattgcagtaaacataatcttaaaatattataaagaggcctcagattgtttaaaaatactatattgaatatatgagaaataaaagctcaagatattctttaaagtatatcctatgtaaatgccaatttttctttacagaataaatctaactacaaatgcatacagggcctaaatatatttttatcttgattttgttccttttcttgtgtttaagagccctgactccagaatcacaagagacaaactgccacttcatcacttattagcgctgtttgtgtgggcaggctatttaaacattccaatcctttattttctcctcaataaattgtaaaaaaaagtaatgtttactcagaggttaatgagttgacacttataaaattattagcatggagcctggcctcagatatcattctcttctgtatacaatttttatgtgtttgttctttaaacttataaatcagttccatcagactttttacttcatggcaagctgcttttatttctaattaagaaaacattcctgactccaaaatttataaagactttttctctcttttcttcaagtatttctataacattgtaatgcatttagtgtttatccatatgaacggtatgatattggaatctaattttacttttccacatgtataatcagttcttccgatactgttaagtattgtatcctttatgtaattattaaatatcatatataacagataaaaaactctgtatgtacttacatcgatttctagactccattttctctaaacatcccttgtctgtttctgtgccagaactagactgttttaattatagttgtttcatagtaccttttggtatcatgctggtaacttccctaaactgttacttttctcaaaaaatttaggcttttataaacatttagcttgcatatcaattttacagtttgtcaagtccctaacctcctccccaaattgagactgtgaattgaattgccctcagtctataatttaaagtttgaatcatcctattcagaggcacaaagttgttggttttttttgtttgtttgttttttacttattttggttgtgctttgtacccttccctaaagtgttattattttctttatgtaaatcttacataaaaccagtattttttaacgttcaggtaagatttttatattcctaggatcttcatgtggaaaaaaaaaacttaatgatttaaacagctatattaacttgatatatgtaattatttgagagaaaatctagtcaataacttttgccttcccactccagacttctaccctgattatgttaggtaactgaattggaaagaaaaatatttattctttatattattttttctgatctgaaaaagatagcttgtttccaccagatacattcatattaatagccatcaagctatactactttcaaattatatttatgacaataaatgattcctacaaattttagagaagactatcaaaagcaaaagaaataaatacaaaaattaactgggaacaaataagcaacccctggaggattcatctctatgaccctacagtccgaaactaaagaataatacatcctgatggacggctatggaatgaaataaaattctctattaccagttcactagaagaatttttttcccccaggtttgatctctttatttagtttatcctccaggttaaaagaaaattattcactattactcaccaataactcagtaaataaaaattttgcaaattcagccatttcaacatgccagggaatatctaaaggtgtatatatacaaatatttatatataaattttgcatatgtatataaaagaaatatatatataatatatatgaatataaacattcaggtaggatatttatatttatatataaggatatataaataaaaaatgtatttatatttctttttcaaatgcacagctcttatatacatatttctttttcaaaagcatggctacataaatttcttcattttgatgttctgcttctcttcagtttgatcttgcatatcacagtgcatttataaaatctggaaagccatctaaagaatttcaaactttctgaatacaaaatgtctttttccaccagacaagagtcaccccagtcactaaacaaattgaccaatttcagagtatttcctgcttctacttgttactgatgcagcatctggctggaacagagtgcgactggatgcagaaaagttcatgattgcttgattgactgattttgatgttgaaaatcatgtaaaattcatatatattcaaaatgtgattcaaaatagatatccaaagacacatcccagaaaatcagtgtttttctataagctacattaaaagtttttctaaatcttcatttctaagaaaaaataaataatacaagaatgtatataaataagaatgctacctctggaattaatagcacctgcatctgtctacctctttagcaggctttagttttctttctataaatactcgtcatcacataaactataacgtatttatttatttctacatctcccatgaaaacgtgagctccatgaaggcagggacttttgttgttatggtagtcgtcatggtgattgtttaccactgcatcccagggactgggagagtgcctgtcatgtactaagcattcaacagatatctgttgaattaattattcataattacttaattcacaattttaacatgagcataagaactaagatcagaccaaataagccttttcaaaatattaatgaaattttatattattattatctactacccttttaaactttactgtgcttaaaagaaaaaatccagcttgattacagagctcaaagaatgctattgcctgaatgtaagatcgagaatagcttttctttacatgattcccagtctaaggagagaaagcagatagtaaatcacacattaaacaaatcattcaattacattcgtttaaagtgctgctacctaggaaggaaactgaaatgtgccttgagaacagatactcaactggcatgctggaagggcttccctagaaagggatggtttggtttctaggacttgaagaataaggtctaaatcaggtagaaaaggcagggaacattccaggcatccacaaagatatatagagaggctgagtccaggaagatcttgacaaactctagaaactgtgagactggtaatatactattaggttggtgcaaaagtaattgcagtttttgccatttcttttgcaccaacctaatagaaaagaatcagtacaaaacaaaaggccgctattctggtgtcagattttcttctcacactgaagccagctggagtccttagaactttcctgaacttttctgcatccagcagcactctgttccaggcagatgctgcatcagtaacaagtggaagcaggaaatactctgaaattggtcaatttgtttagtgactggggtgactcttgcctggtggaaaaagacattttgtattcagaaagtttaaaattctttagatagctttccaaattttacaaatgcactgtgatatgcaagatgaaactgaggagaaccagctctttggctgcagatctgagatctttctatgggaggacaaaaaggagctaaatcacattaatctattttccacactagtgacatgaactaggttcaattattcaactacggaaaagtcccctttttatgattcctcaaacggtgtaatttttcctgcctctgtactttcatgttgtctttttttttttttttttttttctctctgagctgttccactaggcacatatttctagaatcagctgaagttccaccatgattctctgtttggactatccttcctctgaactcctccaatattttatgcccattactatacaactcttgattgcatctgagtcccttgaggagacagggaggaacaggacaggagacagggaggaagaaggacagactatgcctgtgaatacagagtattttcctacagagaatatttctaatgaagatgtaaaagatccactcaaaactcaagcattatattgtttgagagggcaattttttttttttcaatttaggtggtctgttttatggtttcttctatggaatatctgtgcaacaggagatcctcttgaataattacccgctgaacaaactgtatctctcaaacacatctcaattttagacttgttgtttaggtcattccctggagagtgtcttgaagaagaaaaaaagcggaaacttacagatagtaggcccagggaaaatataaattattttatatccacttttgagggcctcatattttcttggcttaggtactcaggagacagatataaggcataaaatctttaacattattaaaaccaattcagaaaaatcccttaaccttccaacactaaagcagatagagaacatgaaaactatctatggaactgaaaatcagtgatcaatacatctatgaaaaatgttactattttataagacatccaaagaaatacacaggaaaacaaaatagaaatagcttacaacattcgacactgcttgtgtataatcacacaagcacgtggtatcctaactagtggaaatgcaaagtagcgcatactatggggaatataaattggcaactcatataaagacccaaagaaaagctttactcttgtcctcataattccacttccaagtaatacagcttaggaagaaagtcagggacaagaacaaaaatttgtataccaggatgttcattacagccttaaaattcaggaaagtttgtaaataattaaaatattacactattcaaaaacaagcaatttatgacacaacattaggatggaaaatttgtagtcagtaaaaatcatcttttcacattctaatgacagaagaagaaaaatactccttacattaagctaagcaaaataaatgtagggcatacaaattatactataaattgtactgtacatgtgtgtatatacatatatacacacatacaaataaaggaaacagaccaaaatgatatcatgtatttatttcctttaaacctttgtgtactttcccaattctctacaatgaatatttttatgaccaagaaaaagttaataatattaaataattaatttagactcatttcattatatgcatgaattattccacataaatagctccttgttacaatcaagccaaagaactgtcaaaccatattgggatctacagagactcaatcgccaacaacgacataaggcaaaacctcccacagagaccctcttctctttcacataacactgtattttttaacaatgtttaacagttggaaatgctgagaagccacagatgagatcattaggagaaagtattttccatcatgcttttgtcagggaaaatcccttagtagttctatttctgagttatatttttagccaggctgacaaaatttaaagcaaagtatataaaatgtgtatttgcaagcatctttctctaccaaatggaattcactttaactatcacactgataaagatcatttatcataggcttgtcttctgcatgaccctgtatttggagggtgtgagagactacaagacagaagtggtcaggacctcaaaagatggcacgtgagccgctgcttcaaaaaattaaccagacataccagaaaaatatgatgatgtttatggtctgataggcatctctgtgatctgtaatttatgtatcctatctctgtgcaaccaatggatttaatgggtcagcaagcttcaggaaaaccctaaatggatttgggttcagcaaacagccggtcatcacttctaccccatgcttctaccccacttctacccaccgtgctgaactgcgaagccaaggacttgcttaaactatcaaatccagtttcctcatagaacttttggcccttctatttgtaggtccatctttgcctttggttgctgacatcacattcccagggactgttttctcttgtataaacatatatccatgtaaatccttaaaattcatggcctttgggtttttccttgtcagtcaatctgaatgtccccttcctcagatcctaatagctctgagctggattaggttttccctgatttgcccagcagtgaattcagcttaatttaaaatccactctgcctgagagtttctatttttactttatgaacccataggactgatgaacaatagttagaattgtattcaaattttggatagtttgaattatgtattagttgggaggttcttctttcaaggaaaagaatacaaaattaggtacaagcatgtatacacacatacacacatacacacacacacacacacacacacacacacacacacaaagaaatcacaagtatttactgaatacgccagagctgttttctctgagatttctttaggcagttatctatagacattgtcatagaaatgcttccagattacagtgtggcttcctctccttgtggagaaaactctgtagctcccaaaacttcactaggggaggtgcaaatgagaaaccctagattttaaggtgaagagaatcaaacttacattttccatttgcagaaatgtgttcattagcttagtgagattggttggttttgcttcttattgtctgttaccccctctttgcttgagggtggatgtctgtttctgacaatgatttttgtgaccctgaagccatgtaaaatggaactagtaatacctactgtatcacttgattgttgagaagattaagtgaaatcggagtgaaatggattaatatatcattgtctgaaaattgttacactagaaggcaactccttagagcaagggaattttgttgacaaactagcactcttgctgggacatgatacagagttcaatgattaggggctgatttgcttgaggaatgtgaatgaatcatagatgctataattgcccttgttctgtccctaaatgaagaaaaacgaagcagctgtggtcatctacattctcactgtctaatagccacaagtggtctaaatccagactaaaatacaggggactctggttgcatttatatttatcccccagctgtttctgtctccctattttaccaattccaattcaaaatgctcttagccctgaagaatctgaactgcctcagttgtgcactgtcctctgggtttgcagatgccatagaaatgtctgttctgataataatgtactgagggcatcatgcttatttaacctctggtgaggtagttaggaaaatgcttctgatactgggtaagatcctgaataggaggc

SEQ ID NO: 2471 - DNA, 81779 bp, Homo sapiens
ttctatagagattatcatgtggcagatattcataaatgctttatttcaggtggaattttaccttgagatacagctccacataaaaacattgttaaataaccaggtattaaatatagtccgattccaacttccattaagtcatttaagaaaacaattcccattgatgcttgtctgagtgctcaatattctttttaaatcaggggagtgaaatatgaaagtaggcaacatactctggaatttttgttgagcctaagtaacttcatttaaagataaaactgaaataataaacatataatttccagttttaaattttaagagccaagaacacattaggtgcacttctcattaaacaaatgagataaggatctatttcagtagcaattaggagaaagaagaaatatgagtgtcgcaaccattctattcttccctcaaatactatgaaacttataacatcacaattgattatatatacacacatatgtatatagatatacgatatattgtgtcatatgtatttacagatgcaatacataactatttgattgcagctatttttatctcaaggagatttcaagctcttggacactaacatttttatctcatggagagacattacaatgctctatgaatggggagtattagctcattaatatttagaaaaataacagattgtcataaagtagatactatcctgttgaccaaatatttgtatctctcctttcaagcatggaggaaaaaaaaattagggggaacattttgcaaaataaccgtttgatttttaaaaaaaataataattttcaaactgatgcttttaatttaataacaaaataatgttattaaaacttaaatacttaacatgtaatttagaataattatctaatggcccagcttacatttacttttacttgaatggtttttaaaagttttgctttttctataatttcatggagctaaaatattttatggatattttgatgccatgcttatatttggctaggtaaaactcacggttttaatgctgacaagaaattagcaggtcctaacaacttttattcacaaatgaatgcattaataatcaaaagaaataaagaaaacattatactattttaaaggaaacgcttaaaattttaagaatgtgattttctagttaaaattgaccctagtgttcattattttttaggctttttacataaacttacaagattttagttttatgtatttatattaaactttttacatgagaccagtaaatagcttactactactttttcatgttatgttgccttctctcaccatagatttttgtcttccaattccttaaagttgcaccttagtagtaaaaagtgtgtacagcattatcagcttttcatattattttactaattgcaataaaaaataaagctcacctatttttaaaatgttatttaattaacctagttattttgaacactttgtatccaatattttttgaaaagtaagacgactttccaaattcatttatctctaaagtacttagtatcttacatggaagataatgacatgtctgtatgatcttcagctgttataaaatgtcaggtgctggaaattcttaacagagctgcccataagtcaattaaatcatggcgccacatcagcttttcccccaatcccaaaagagttaaaaaaaaaaaaaactctaataacatctacaattaatagcattcctgtagcctgtaggtctggcctgttactttagtcttccgctgacaataacggagggccttattatttttccccctgagcatttattaggcatgatgaggaaaaggttacatctctggaaaagagcacaatcttcaactctcttcaggttagatgctttaatgggcattacattagaaaggcattctacactacctattatattacttctcccaattagaaattccattttaatgtgattgccaaaaatttagtgcctgcccatttgataaaattgagagtggcatttgctaaacatcaattaacagaaaatgtgaggcaaatgttgtatgggtagattggctgccagtggggagaaatgaatgggtagtaatggaaattaatggataagggaaatctactttaatttccttgaaaaatgtgctataacagctatctgcattaataaatcaaacttattgtttaaaaagtgaacaacaagatattttgatttaacaagacagcaatccttccaaaatcatagaactcactatcaggtatcattctcttggatatattcaaactgcaggctttgctttggcaaataatctttcactatccttagctctaaataagatcaaactgtcaataaccaggaaataagttgttaaaatgtcattctccaatttatcattttaaataataaaagttgttttaagtaaacacgtttctttccatgtctattttttaaatttctcctccataatatcttccattttaatcccacaataggctgtggccttttgttaatgctacttcagatacataaatttctgataactgaatggagacataaaaagacataaaacacttacatttgaacttaaaagacaatatagatttatatgaattcttttatcattttataactacatttatctaagactcatttaaagtgatttcaatctgtatttgtttcctctaacatttttctttataacaaatttagttaattccatcatctcatctgaattctatgatcacacaaagccacctaaattaaatccatacctgaacagtctgggtaaattccccatataatatttcttatttaaaactttagtattaactaagtcttttaaggaagtatgggcactgattatgttctggaaaactggaagaatatcattaatcattaagagcccaaaatatggaacagggcatgtacatttatagagatgtaatgatttttagcacagaaattatttaccttaaactaagtactaaatgggaagagagggcaaaaggctgtaaatggagaattcttcttccagttttgcaattaacagtgttaatgtcgaataagtaagtagcttttacctctgtgcattttgcacttttacctcctctgggccagaggaggcaacctgcaccatttctaaggtcttttctagaagtttgatgagtctgtgttatttctgttagtttttctgcttatttcacagtaggctaaaattatgaatgaaaatatgtaaaaataaacttagcatggcaattttggcatagcatagagctcatggataatgattacacttctcaataaaacagttaagaatctctctcggggctaactttttattttaggatatgggataatgctaacgaaaggactagattagaaatttatgattaaaataaaataagactaatactgttaataataaatacttctgataggtagactggtgattctggaaagaatgatggcaaaacttttcagaaagtttggtcctacccattctctttgactgtctcctgcacaaaggcttctgtgcctcttcttttcattttggtacatgatccaatcaagagaatatgatccacatctcaaagttttatataatgcttgcaacaattctctactaatatgcctattgatgatactgtatatttgtattcatcttttccatcttctcagatctcctacaccctgtgtactaacttaatatcagccattaataactgagtaaatggaagtgaccaaaatgaactctattttctgaccaccaattccaccagtccacctctatctgtacccatgctctctccatataatgttcttctcccatcagatgtcaaggttaactcttctggtggtaatctggatcctggatccacttcctgtttctgactcaataattttgtttctgaaactaaatcactcttacaaatcacaaattatctcgttactagatcattcacatcagcattcagaaatgctgtattatattttcacatttaataaaagaaaaataaatatcaaattcccctagtgttgccccgtttatttgctcctcttcaaacaaaattttctcaatttcctctttcccattttcctctcaacacataatagttgagttttgtccctattatgtcactaatccttctgtttaaagacaccagtaatctccattttgtcaattccactggtcacttcttcgttccatgtcgactcatatcactcttctgcttagagcttgccgataaatttctatctggtttagaaaaatgtctgaacaccttagtctggcctatttgtctacttctactgaaacttcatcttcttttccaccctcaccttctgcgccaggtaagtcccagtaacactccaagcctcttcacaatttagtgcccttgtacttagcaaattggccagtgaagtgttctccctgaactccacacagctatgcccttcctgcctttcacttctcttgtcctcagagataccttgccggatgacgcaactgaaagtcagacatgctctttatactgtttttattttctgcggagcactaatcattaattaatatattaattcactgattttttcctcaataatatgagacttataagaaatcttacttttcttttgcttcttcatttccagtctagaacactgcctggcacaaagaaggcactcaaaaaatattgcttaattttctcatctttgtatctcaaatgtcattacacatagtaaatgattaataaatgctggttggtattaaatgattataaactctcttgatgaatttacctacactattattttatgatggtaatttatcagtggcttttaataggtattaatatctttcaggaaagatttgtactggaaatagaaagtataaatcaggaagtaggaactatttgatctctcaaaactatttactatttaagcagttgtttcataaatgttaggaaatgtttgggaaataaaaagagttttaaaatcagtacatatatctaaatttaggacaattgaggcaactctttaatctattaattctatgactatatctagatcaaagctttggttttagggcaaagtactgtagaggccaaggagaacctcagaaggtttgctgaaaaaaatcaaattgcaaagttgattaattggagaaaagacaaacacatttatttaatatgtatatatgggagccttcggaatgaagacccaaagataaagaggaaattgtccacttttatgcttatgttcaacaaagtatgtacagcagtgcagaaaaaagggtaagaactaatgctgatatactgagtggggaaacccaggaaggtctatctgtctagactcttcctggcctctttaagcctgcattccttccttctgggtatagaacatgaccccttctggaatgggagttttagtacctacagtcaaacaaggtatatcagataatttctttatgggtcagtttttacacagaaaggtggagagaaaaagtaatatttgtaggtttttatggctggctttggagaaaaagggttctagtttctgtgacctgccttggggaagagggattataggttctatggctagccttaaggagaatggaactgagagaaaagagggcaggaggtcagagaaaaactttagcttctgaggctgctgctgaggccttcatttggtgatattgttttctgaaccccaacagtacccaaaagcccacaaccgtatattttgtattatcaggacattcttcactcaaatcaaagcatctggcatcccacatttcacctagattactttggagttccaaggtacagcaaaacacattaaaaccaattaataaagaagaataaatttatattaaggtgagcagtaagatggaaacaccagaataaccaaacactcaaaggaccttacaaaaaattattcttgattccaactttgaatgttaatcacattttagagaaaaaataattaagatcagttgaaggaaagcaaataatgaaatctttaaagttcactactcttacagattttgaaaaagttaaacagagggtcgttatgtttaaaatacgttgtgggactctattattgaataacagccttttaatctttgcggtttttgctactagatacaacagtgctcttttaatgatctaaatctttccattagtctaaaaagaacaacttgaccacattatccattatctttgtttccagaaatttactcttgaaattctttaaactttgcttttatatctcttatattttcttctaacacaagcaaaaatatttgaaaatcacaatattttttaggacttttttctttatcctgcaagaaaaggtgactttaaaattgttgccctaatcaagatttgtgttgacttaaaagggtctatctacaaacttcaattttatattggcctaacatgtttgaaaatataattttcttttgtttgaagaaagttcctcaaaataggaccaattgtttcatatttcaatattcacctcccaaattagtgcatagtagacagctaataaacatctgcagaattagtaacataaacataatgcttgttagtgtcaagtggctgaaattcgatgattccaatttctgtgtttaaaacaataacaggccgggcgtggtggctcacacctgtaatcccagcactttgggaggccacagtgggcggatcacaaggtcaggagtttgagaccagcctggccaacatggtgaaaccccgtctctactaaaaatacaaaaattagcctggtgtgctggcaggcacttgtaatcccagctactcaggaggctgaggcaggagaatcacttgaacccaggaggaggaggttgcggtgagccgagattgtgtcattgcactccagcctgggtgacaagagcaagactcgatctcaaaaaaattaataaaataaaaaataaataaaataaattttaaaaataaatatttcaggaaatacttaagttttccttgaaaaacactccattcatcctctttatatttttacacaccttcaaattctttttatgacatttacacctttctgatcccacttgtaaacactctgtaaacattacacagtcagtgtttaaaaatttttttcattaaaaattctttctcaacataatacaaacacagatttacgcatttacaggacaattattcctctctcatttacctttaaatagcagtgtccctgcccattgcttactctaccagtttgatataatggatcctttggtggcaactacatgcattttattttcccaaagagaatcttaatatacatcacttccttcacaaagaatttcagtaagagggaagaagagatatcctggagactcaaaatatcattattaattgcaaccagctaaatctctgataatttattttattcacaaaaaaaaaaaattatttgctgtgaaacaaagaattcttattaggaattattaataaggtattatgaacaacctaaacttgaaggttaaatgtgtgtatatttttatatgcccatttggaaaggttcatacttaaaaaaaactctcaatactcatgttgctaaataataaagaggccatgaaattaaataaatacatgttaatattaatgctttatgttggcctgaaacttgctttattgtggctttgatctacttttacccagggctgccaccaatctatatgccactttgtgggaagtggaatatgagtcacctccacatagagacacagtgacttagagcagcgatcccaaacctttttggcaccaggaactggttttgtggaggaaaatccatagactggggaggggggtggtttcaggatgattcaaacacatttattttgcactttatttctattattattacattgtaatatcgaattaaacaactatacaactcaccataatatagaatcagtgggagacttagcttgttttcctgcaactagatggtctcatctaggggtgatgggagacagtgacagatcatcaggtatcagattctcataagaagctcacattgtagatccctcacatgcacaggtcatcacagggtttgcgctcttatgacaatctaatgctgccactgatctgacaggaggtggagctcaggcagtaatgtgagcaatggggagcggctgtaaatacctggttctctgggggttgggaacccctgacttacaggcaagacttgataaactgatcactagcagaaaatcaactgccatctgccttcttagctaaatgcccctgtgcaaggcacaaagtttgtaaattaactcagtggccctgtcctttggatctaggactaagaattcattccacatggcaatctgtactgggtatctttgtcatggtgtcttccgtgtctgttttcctttatcaattaaaaaaataactatgatctcctattcagagatcctttgcacagagttagctatagaatgtattataccaggagcaatgacttaatccaaatgcattgcaactagaggctgacttgaaactttaaagtggccagggatgcaatcatctgtcccaaatgcagaaccattagctaaacaaatcagaccgactctctcaaagacactggcaaacactggtcacagaaaatgctcagagaggtgcagagacatacatgaactattcctgcagaattcttactagggaagccaattgttcaagggctaatgattttctaattacggtatctatatatggttctcatttgtcttaaagatatctcagattaatcctctatttctgcaacaggaaaggaatgcctactaagtacacagtccttcttgctcttaaaaagagttatctgattcgggagtcattctttaagtccaacatttcatctttcttcattaattaattatatgtaacaaaagagttacatatagagtatatgtatatagagtatagaattgacactcaagcgacaaataaaaacaatggtgctatctttggtgatttataggctttaaaaattatcagacatccttggggcaatataagaaaattatatgtattcattcctagtaggtagaaaatttgtgttaaaccaaatctgtatcacagaagttaatttttataattgtagcttcatattttttatttatctcagtcattattagtggatttaaagaataaacatcatggttatagatttctggcttttgtagtgactgattcaattaacattattaattgagccctgcatattaaaaactatggcatgtaatgtgagagtacagaaagaataaaatatgcagtccttgcactcatgagataatacatctgatgtaaaaaaaaatactaaaaatcatgaaattatttgcacattacagagcagcctgagaagtgcgttctactctaagtgatccaagtttcccaaacagagatcaatgagggtgactcgttcaaagctccctaactaaaattaactcaattattcaaactgccattttttctcatgatgtgaatacagttttactatttcaataaaagttatagtgattattgataaagacttttggtacaaaatgccagaccagggatcagaaatgagcttctattccatgttattctcattttggccacaattaacttacatctataggacaaacacccaacagatctttaggcctgaaaggcagaaagaaaccagtacctggggattgtgccttttcaagcttacacagcaggatatgaagaaaagaggtcatgatttgtgctaaagtaactccaaagaataacatatttatcagaatacaaaacacagatatacttgaggaaaggctgacctaaaattgctgaccatcttgtctggtagtggagctttttcttcactctaaacagtcagatttttagtctcatcatagatacccaagatttcctgttctgaacaagtcagctctttatatttgtggcattatcttactaaggccctcaatgtaattcctgggtagcttttatccctatctgttttttttcccatctaaaatctaatcttcataccaatatgaaataaatctagcgtaattgcaatttgagaatgtaaatttcaagctcttaaaaactacagtgcctaataatttgcattgtaactaaatacatgtgctcacatacccacacactcccacgactcataattaaatttcatttaaaatttgttcccttactatataaaatgtacttgtattttccattcccttccattgtatttcatttcatttcattccactccataaatgccaaccatgagccactgaattaattttatgatcctctaaaatagtggttcccaaaatgtggttccagggccccctggaacacccaagactcttccagggaatccacaaggttcttttcataaaactactaagatgtcatttgtctcattcactctcaacatcttgcaaatgtatactagtgttttccagaagctacatgatttgatgatgtcatcactctgagagataatggaaagtattcttgtatattcttttctttaaataattttctcaactttaatttctaatacagtaaatatttataaacataaccatataaacaaaaactctttgggtctctcagtaatatttaagaacttaaagagatcaagagtccaaaaagtttgagaactgctaatctaaagcaagcttccatttgaaaaacagtgacttaaatggaatcattgcatacatacacacatacaagtctctttccatacttttctattctctgcaaggcaaaatgcaaactggcaccaaatgtcttacaacaaattagctgtgattctactatttcctactattctctgctctttactaggaaactccatctaagtcccctaaatatataatgttcacctctgcctttgagtctcattttatagtatactcttgaaatatatttaacactattttctgctaacataagtcctatctaactatgtggacatctgcaatttctttgcttgccctgcgtcctttcttttttggaactgacccttccggattccttgaattcacacgggaatgcgaattatgtggccctaacctttcataggcctgaggattcataccagtcaatcaaactaccccatacctttggtactagtgtgcagattacatgggaagggctaacccaagagcagtcgagggagatatatcaatgttaggggaagaagaaattgtgttttgttctctaagattgctcactgttaggaaggcaaggagaaggccagccttattaagcaatggcttagggacactgtggcacaattctttttacatatatattttttatattttgtcccagtgtccccttgactagacatctgcatatgtctgtcctttggcattgctcccaataatgcctgtgtgccctgtagactccctattttctgatgaggacttgtactgttttcaaatgcctctctattccctttaagacactctattaatttactttgcaatcaattattttatgttattctttttttttttttttcttagaaactcactaggtgcacaaaggaacaattctgtctctgcaactaagtggggattctttcttgtatttcctaaaactctaaaagaactctaatttttaatatatttttggaacctatttgcttgaattttttcccttgaaaatgattgacaaattgaatgctgtgttatcttaacagtttccttacatcttctttaattgctgtgtcatgcacagtttttcttcacttatgttttgaagagaatatgttatccttcccccaccctaaatgttatccctttttgatttgaaaaggcacacaacttaaacacatgaaatgaagataatttccatgctatttaatgtaaatttggaatcttctaaagtaaaaatattaggggaccaagtagttaatgtctatattaataaaggaaaagtgaatacaccacctctgtaatgttagaagacagaagtactcgggaactgtaaccatgtgtacatttcagtaagatgaaaattgagcataccacaaacagaagacagaagtactcgggaactgtaaccctgtgtacatttcagtaagatcaaaattgagcataccaaaaaaatcatcgattaaataacattccaaatgtcctcagcaagtagactttgttatgcatgcttgggattcatattaagatatagccaaaagaattcatgattccgttacctccttcagaaattgaaaacaatgatcatcaaaggtcaaagatgccttcttatgctaaattttattatcaacaggtcatttgaaattttgaaggcatagcttaatgttcttagaattagcacttcttaattaaccaaacagcataacagaattatagagagggagaaaaaccctcagttaaaatgacataaatagtaatttgtgaagttcaatacctcttggtctgctaattattatatgatgcttcattaccatttaaaataccacatataaaaagaaaaggaaagagaaagaaaatttagagcacattcattatataattttgatttattttacaaatgcaattataatcatatttgggggtcagagataataattttgctcaatatttcataaggaaagaaaatctaatttttcatatgtagtcacattttaatatgagcatattttatatgtgatacataatattatatacataattttacatatgactggcagaatttctgcattatatatactttttatgaatcacttaagttggtttttaaaaacacaactacatataccaagaccacatatgcctcagtaagaagaagtatgaaattatttaaactctcattcaggaaacactacaagtttaaatgaagtaacagaaagttactgcagaataatctctctattcaacaaaaatattacacagtttgaaagtaatgtaagtgggtccaccacattaaacacactcctaccctctactgacctattttctagactctaagtcagagtatggaatttatctaagttacttcaatcctcttatctttctaaaaaccaaaggcagtatgcatttataatgcttccttaactcacatcacttcataaatctgttttcttaaaaaaagtcatatcataaatgagcatgcaaagcacatactgcctcattcaaaaaatgtttaatcattagaaatagggcattgcatctattatcatttttaaagtgttaatgtgatagcaatctgaaacaacaaataaaacatctaagaaaggaaagctatacaccttttcttcttaggattattctcagtattgcagcatgttgatggctttactaaacttaccaggctattttctcacctaaaagttggacatcagtgggcaaaatattgccctactgatactacagtgatctatacattttaaatattctttaactgttccaaaatatatatattcattttaaacaaaataggaaaaagaaacagatatgaaaaagacattacctgtaagtccactgcccagaggaaaatgccattaaaacttattcttatacatattcttccagagaccatactctgaatatggatattatacatatatatatatatatatatatatatatatatataaaatatatatattatagatagatttgtttttaaatggaattataattttccatagtaagctttattcaattcttaataacaacaaatatattttcaggtcaacaatatgtatttgtataatctgcatcaatgttgttaatggctgcacaatatattttcaattaccataccataattcagttaaaaatctcttaccagatatctaatccctttccttccaacttctgatactgtaaacaaaatgttggaataaatatccgattactataatgtgtgcatctttcttagtgttttgcatacaatgcttggctaatgcagggtatcaatgaaagtttgttgcattaatgattggatggatgaataaagtaacaaatgtgggtttttaaaatatcatttaaaggagcacgtctatttgatattcagattttgagtcaaatcacttcacacttctttgtgcttttccccatgaattatgataacgagaaaacatgcataatgattaaatgactttcatccccggatgcttccttaatatgtgtgaacttgtaggactataagtaatgctctgtgtgagataacatactcaacaaatgttctaatagagaagaaaaaacgtaattgttgtttttaaatgtagtataaacttcataggatgctgtaattttccatttatttttcttgcataaaatacatagaattacataggaaaaataatttcagcataactcatatgtcccaactctcctctaggattttctaaatttgatttaacaagcagctaatgagcatttatgtctgacattaagctaatcacaatagagaatatttaaaaccttgatatagctaaaacacataacttacatggtcatcgtatgtaatttaattacagaaagtaagcgatttcctctgtgatatgagaaaagactaagattctccagctaagataaacagatgcaatatttacatcagctggaaggaagagagaacttcctcacccatggacaatgtgacagcaattccatccctattctcagcacagtatcctccttgtttaacaaataccttggaaacttgccagttttcaggtatttccatcttgggatactagccagttattcaggacatgaaaccaggacaagaagccagatgtgcaacatataagagtaataattattttccttttgattcccttatcatgacaatggaggatataacctatattttcaattataaattatttcatagactgacagaatttataaaagttcacctgaatttttaaaaatgatatgcctactatgcacaaaatcacataccagaccatgcagggcttgctctgtgtctcagttaaatctggcaacgaaccttggtcaacctgtaaaaccccatggattctcactgaacacactgtactttctcagaagaaaaggattctacgtatgccatcagaggctactcagtaagcaaccaacaccattcaatatattcatttatatttccctaagtttcttcactgtcaacctttaatatctattttcctgaaagagagctgaagcacacataatggtttcaaacatctgtttgttctaattttaacaaaagttgtcccatgattagaagccaactatttggagtaatatcacgtttgttctctataaataatataattaaattgctacaactaacaggaaaaataggaggtagccaacaatataaataaaccacaaaccgtgtttaacctagatttgcatatcgttctcttagttttgctatggttggaatggttttactagagttaaatttctttaaatcaggagatgtctgattaaaattttgaaatgttgctttctaaattctgctttttcttagctcactgcaacctccacctcctgggttcaagcaattctctgcctcaaactcttgagttgctgagactacaggtgcaccccactacatgtgcctgaagaaagtaatggcaaaaaccgcaattacttttgaggtaattaatatattaatagtttctacttttgttgtatatattaataatgagctgttcattcaaaagtttttacctaaaaaacagtttgctaaaagaaaagccattgcattacaatattttgacagcttttggcttagaaattagaaaataaaataaccaccaactaatataatctttagaacatttttctttgcttttcatcttttgaataagtgacaaatattaattaggaatagtagtgatagtttatgaaggtaataaccactactgtaacatgttaataatttaattaagctagtttctattatgaagcaaatttagaaaaggggagtaaataaatgtacacaataatgcattttatctcttcaatcaaaaaatccatagatgctaatgtaatttgttaaaatgccacaacgctattgaaaaccaaagttgccatatgataaagtgatatttattaaacctatcattccagagagttttcctgccttttgttataaatgtatttaactgaggccatattttcttcacatttgttccctaggtttgcttccagaaagattatctatggtagaataatctttataataaatctcaatataccctgctgtgccctaacactttaacactttagggcaacaaattgccctaaacacttgttagttcttctaggcacagagagctactatggcattaaaatagatgtatgcagcaccacattacattttaaaaagtaattacagatatctcttctgtgatcacctataatgtaaggtccaagcccttctgttgaggcaggaactatcagaaagataaaaattgattctgaaataaaatgcttatttcccaatattataagaaacataactgtctcggcgtagtggctcacatccgtaatcccagcacttagggaggctgaggtgggtggatcacttgaggccaagagtttgagaccagcctggccaacatggtgaaaccccttctctacaaaaaataacaaaaattagccaggtgtggtgacaggcacctgtaatcctggctactcaggaggctgaggcaggagagttacttgaacgcaggaggcagaggttgcagtcagccaagatcgcaccactgcagtccagcctgggtgacagatagaaactctatctcaaaaaaaaaaaaaaaaaaaaaaaaaagaatgaaaagaaacatagaaacatacccaacttattcattgtggaagattgtctcttcagccatttgtattacgtattaattttttttatattatggtttctacttttgtcatacatctattaatgatgagctgtttattcaaaagtttttaaccaaaagaacagtctgctaaaagaaaatcctttccattacgatatctttgacagcttttggctcagaaattagaaaatgaaatgataaccaccaacaaagggattctgcagctgagtatggatttcctcccagtgacaggcatttttgtaagcacagagcctaataattgtttgaataaacaatgtgtgtgtgtgtgtgtgtgtgtatgtgtgtgtgtgtgtgtgtggtgtgtaatctacacagaaaattgaaaaaaaattttcacaatggttaatggtattaataggaataaatccagatatcttaaaaagagagacagagagagagatagagaaagaggagctctgaaaataattcattaagactctttttatcctgaaatccaaaagaacatctgagcttccatcattcatcttaatagtttatagagtcaactctaatttcaccatggatgaaagaataaacttgaaataacaaataggcaaaaagctatggagaaaaagcttacagatttatcttaaaatttagcctgacaatttccaccttgacagttcggtcatgtttcctaaaaatgattagctaaaaacattactttatagtgattcaattgtaagactttctgaagaacaaatcaagactatttagtaccagatataaattattttaggcaactcttttactcttagttttattaatgaaaggactctcttaaagaatcaagtcaggcattgacactattttgttttttaacttcatcagtagttaatttggacttcacagcagaatgtacactgaatacatgctctgaacgtggcctaagggacaacactaacctgacatcaaaaaggcctgttcatattactaacattaacacagcatattacatatagaaggtgattcgtagatagggagtaatgaacaatgattaaagtttacatgaacttcatctttcagatacaactagaagcatttttaacccaaagttatcaataaggcaccatttggcatagcacctaagtttttccttttatacttcaccttaaaaagcttgctgttgactacaaagatgttgaaaatataaaaatataaaaataataagaaatgtctcaatagtttgcatgtctagttgatcattttaatgtgcacctaatactaattttaaccatacacttaataaaatgatccaaactcataaatgtattattccctttccattccaataactctgtttttaaatagtttgcaaacacctaactgacaaattcctgaagctgcctgagagtcatgaaccacttgtaccccttcccaatttattcacttatttattcatttattcattatttctacttaaaaataaaaaatgtgttggtcaaggagttttatatatatatagttctattaattcaccaaattactaaagccatctttaccaatcaaaagttactctaaatttgttacattagaagttcacatttccaaatcacagaagatttactaattattagtctagatatagtataaatattttggcttccactttttgccatttatttaaatctaattaaatgctcttaattgtatatctctaagtttacctctcaaatcagagaggatggaaagatactctttgcatttaggggtatgaggaatccttatcactttctcctcgatagaaaaatcaatttatttccttttctaaggccactgcgagatgcttttccagctccaggctcaaagagagagtgtttcatccctatttcaatggacaccagaatcaatattttctttaggtacttgctaaaaagtagttacattaagtccccacccagtggtactggccttagtcttttcttactataaaagaacatggctattcctgtttcttcctatactagggatctcttcaaacacaggacagttaacaaattgtcagtaactattggtaaacacatccttccagggaaaggcttcacatttatttgcctacatacacatattagggaacttttcttatttagatataatagtgaaaatgtttgtaaaaggcaaacgtaaaaaaagaaaaaacataaaataaaaatctgttcattttaatgaaatgcattatgtcccctaatctgccaggatggatcttgtctatgtaaacaaatttcatagtgactttcaccttcttcaagatacttactaggaagtatcttaaaggcaatgaatataactcttctacataaaattctgtacatagtagagtggatagacattagctactaacaaatatttgctggcaaaaagctagagcaaacattcaaagcatttttttatttttattttttaattaatctattttttttgagacagagtcttactctattgcccaggctggaaggcagtagcatgatctcgactcactgcaacctccacctcctgggttcaagcaatcctccctcctcagcctcccaagtagctatgactacaggtgctcactgccacgccaggctaattttttttttttttttttttttttttttttagtagagatggggtttcaccatgttggctaggctggtctcaaactcctgacctcaggtgatccacccacgtcggcctcccaaagtgttgggattacaggcatgagccaccagagtgttctctgtattaggctgcccagtcctgtttttgtatgactctctatctaagaattagaaaaaggtttctctttttaataaataaaacaaaaagaagaatatataacgaagagtgtatgcggccagcaaagcctaaaatatttatgtggtccattaccgaaaaagtttgccaatctccattttacagtacagaccctttgcctaatatatgtgcctactatatacagggtattagatttccagagaagggaactaaaaaaagaaataattttgacttttcttcctgagtcctataggctgaaggctatatctgggatagaaagggattaatatttccaaaatacttaaaatgtgttttcctcttcatcaaatctgaatcaaacagtctgtattaaaagtgaaaagtatattgccctgtatctttaatatggataagggcaccagagttgtgcccttttttagccaaaatgtagttatgaagaaagaggcttctttaatagatgttaacaaatcaagtcagtgacaaagggaatgtgaatagagaaaccgcttaaagagtaattagtttgtatttaccccaaattttatttagatctaaaaaaaattatctctgcaaatactttatagatctagaactcttttagttacataacactgtcagttaaatttcaccaaatagttactgggagattggaccaaaattgcagattcaacatttgttagttttcctttctgctctaattccatgaaaagacagaatatatactttttaagatccagaagagtgctagaaaacaaatgacagattttgagggctatcttaaaaatataaaacatacaggaaaaaaaatgtgtgaagtaaatctgtagattaccacagactaaaattcacatggacaaaaatgctgtaggtttggtagtataatagtaaatatcaccaacatccatgataggtattctcaaacaaggttaagcaaaaaactaatgattactatacatttaaaaaggatcaccactttaaaagagctatgccaatttccactaaaagaaaaattttcactgagaacttactgagaaatgggaataaaaattacctatattagaagaaaaaccataacggaatcagacttatcttcaacgtcggttaatagaagagtatggagagatggcttcaagcagaaaattctgaatctagaatgttttactcaagcaatccaacatcaagtagaatgaaaaatacaatgttttaagatctacaagaactcagaaatattaatatcaatgaaaccactctgaaagaattaactgaaatgtactacaataataaggaaaaaaggatccaaggaagaagataatggagaatgagaaatagtcaaataaaaagataaacataaacaaatcaaaaatgttaattgaaaatacaggagaattgagatatgggaggctgtgctaagcaagaaatacagttcaaaggcatgaaggaaaagactgatacatttacccatataaaaaaatgaaatgaaaacaaaacttcaaaatgaggaaagataaaaatgtttaaaaagactatataatggctgataaacatatttgtcccatatatgacttacaaaatgtcaatagctagattatataaaaagattctacaactctcaaagaaaaaatgagcagggatataaacagaaaaacactacagagaaattacagagaaaatgaacaaaagtgaccaataaatatatttaatgacttcccatctccccagtaactctgtattaatagagttaataaagattaatatagattaatataattaaagttaacttaacatacagttaactttcatttccataatggaaattaaaacagcaacataattctctctccatgagactggggcaagcaaaacatagtaatattaagtcgtggtgaggagaattaaaacagaagctttatatactggtaatgcaaatataaattaggagagactcttgtaacgtaaattggcagtagtttgctcttgggaatttcatttttataaataaaaaatattcgtagatgaataaatgtatccatgtgtgagttaaatatggacaaacatatacagaatatccactgcaacattattttttatagtaaaaaacattgaaacaacctaaatatttaccaacaaggaatcagtaaatacatcatcttctatgccagaaaatactgcgcagatttttttttgaaaacactgaatatttcatgtgttgttacattgtgaatactaaacattaacatagtgagaaaaatatctaataaattttaaaaagtttttcatttatattttccatttctccttccactcatatatcgattttgcccttatgcaaactacatatctgtaaaaatatctaggtcttttttaaactttttattagcatataagcttttttataaatataattgccaaatattcatattttttttccaaaaaatcgagatagtgctatcaaatatccaaaacataggaatggaaaaaagcaactcacagaaaaaatgcttattagataattctatttgtttaaaataaacacaattgacatagatatatatgtatatatgcgtaaatgtacagaaagtaaaattgaaaaacagcaccctgaaatcttaatagtgctttactttgtagaggataatgagaaagcagtaggaatggaggactcttttccatttcacaatacatttctatatgctattcatcttttacaataaaaatgcacttatgtgacttctacaactaaaggcattcagttatacaaattaaacaagaggagaaaacttttaaaaaacaaaaactcatttttttcactgtcagtcttaacattcattttatttgtcataatttgaggttttaatagttcttcatatgttgactacttattagtaaataaacaacttactatccaattttaaagattttctatttaagttagtacaataattcaatataaaataaaaaagtattaacaataaaataaagattgcaccccacaaatctggatgatgttgaagccatggtcctcattttcttcttctagatattcactctgctattacatagagtcaggccagattaacatatgatttgggaaatgtatgctctttttcccacattctggaattggaatttgtggtgacatattttgaacaattaatgctcctagaagatcctgttacaaacttagaacaaaataataaatgggttattacatctgtgtgtgtctaaagtttatttaggaaatcagaatcttaccaagaaaaaggcctcaaatcagcgcttcatgaccactaaagtataacaacctcccactctacattcactttgtatgaatacacttaaggcagcttctaataaaggatgcatatgttctgtgttattttggaacatatactgtctgttaggttgaaagagcttgtccatgaatcaataataacttggaatctggacatctctttggagattaatggatagctaagtagagctattcacaccagagaccactaacccccattggtccctgtccagtttgtagcagctgcagaaaaggaacactacgaaacacagaattacttttttggacgttattccaatgatcctcagcaagtgtcttttgcaaaaaatcaaaatggattaattttttaggccaggttcactatattctattcaattcagaaaatccataagtctaaatccggatagctgctattgaaatgttcatacactactcaggtctattcagggaactgggatagttctgatgcaacagtgctttaataagatacagattcttccataagggtcagtgataactccaatgttcagctgacaaaaataagtcaggcctaatttaccacatgagtcttgtcggcgctccttagagtttatcctgccaaatcaatgactattcctgtggcataaaccagatcattttctttttaaggtcttagtcattatttattaactcatctagtaaagtactcaccttgaaataatatagactttagatgcaaaccatttacatttattttttccccaaaaagggacttgtgatgaagtgaacagtatggcttcatggcttttactactatgacaaactagacagttttgtttggacaaataagaatgccaattttgtttggaaaatcaaacgagaatgctgtctaaaggttctaaccaaggagacaatccatccgtaaatgactgtcaaggtgagctagccctagaccaaacaaggaagaggttaacagctctaaatcccctctcctgtttaaattcttattacccttagggtatctaaatcaatgcaaccatgtgttgtactgagatataattccttgagataactgagataaaacaaccgagataactcattgatatagcagagtatttaccctaatgctccatgcagagaacacaggcgttagcagctgctgtacctaagcttcaaatggtttttccccagtttattagctgtatgagggtgcctaaattatgcaccctgcctaaaacttcagttttcctttatgcaaaataggaataacaacagtatctactctactaggtggttggggagatcaagtgagatcacggactcctgcctttacctctgctttatgacaacttctctccttgtctttcaatttatttattttctgcctttcccactttttccccccatattttcccctatttttcttttttaaaaaaaatccaggaacttgcgtcctgagagatatttttcttcttttgctttgattcactgtttttagatattctaaattggcaaatttatcccaattggagggataatcagtgagaaataaacaacatagtaacagaatattttgaaatttatgaaggttttgttttaatgtctccaagaatttactaatgacagtaaaataagcagattttgttcttatataagaatgaaatacatgtgttcatctcattactatgactacattcaatatttgagtgagaatacaattgttaaagttatttatgagatataatttacatacagcaaaaaattacccttataagtgggtaattatatgaatcttgacaaacacttacagtcagataaccaccaatacaatcaaggtataaataatttccaactctgttcacccttgcccctacaacccaggcatttagcaatcagcaattgttttctgtccctgtagttttgtgttttccagaataccataataatagaatgatatagcatgtagacttctgagttggtttcttgcccttagtgaaaaccatatgagattcagccatgttgttgcctgtattcgtattttgttcttcttactgttgaatacataaattgcatggatgtaccccagtctgtctatccactaagcaattgatgggaatttgggtggtttctaaaatttatcaattataaataaaaccactctaaacgttaggtacaggttttgatttctggtatggatgtagagaaaaggacttacgttttcacttgtctttgctaatatgtaggagtagcattgcttggtagtatgttagactttatcagaacctgtcaaatggtttaatggttttcccaaaacaactttatcatttctcattcacaccagcaatgcatgagatttttagttgcttgctctacatacttgccagtacttgatattgtcatttttttaaaaaattagccattctaataaaggtgttgtggtagctcattgtgactttaatttatgtttactaatgactaatgatgttgagcatcttttgccttccatatatcttctgtagggaactgtctgctaaaatattttgatcttttttacattgtgttcattaacttatcattgaattgtaagggtgtttgtgtatttaggataggcatgtattattcaatatcaatttgcaaacattttcttctatctcttgagttttccttttatttctcaaatgcacctttgaagcccagtgctaaaaaaatcaatttttaagaaggtaaaaacttacttaaattactacttcacattatttttccctttataaatgtcaatgaaatattatggtcatatgtttttcaaagcttttagctcattacacttttcttatctactttccaaaagagaagactatgcatagttaacagttcaagcgctcttttgaatttctttgccacatagcttattctctagggaagaaacacttacataaacatgttgctctgaagagtacagaggggaaccttagtgacacagtttttggttctgtcatcaggtgtagacatagactttagtttctcttctctcttctctccattcttaatacttttccagtttgggtttgggcctacattcatcctcgagtcctattaaacaggagtatgatttttgttctcccaactcaacaagacaacgtcttgctgagtttccttttctcccaggagctgtttcccagatccatggctcacatgctggccaaggagctgaagtgtcgtagtgctgcactaaaaaagctttcccaggtggagacctcgccatttctcaaatcttagccttcctctctgggataagtaacaacagacagagcaaagaataaaaggaaaacaagcactttgggagcatccaatagacctgggcctatgttctggatctgacattattcatttgtttatttactctttctttaatgtattcattcattcattcagcaaataactctttcagcatctgctctgtgtgccatgctaggaactaggaatacagtagtaaatgagacagacttagctttttccctcaaataaatggcaggtctgtcatttctttgttgtcctgaataagctgttaagcttttttgtgtttcctttgtctattctgaaatggagaaagcagttcttagctcacacatctaatgaatattataataagacaaaccaaaatatccacattttaaaaaataaggtggatgtgatgttctttgtggtcttccatacccccaattttctgcaaaggtgacctcctaaataaattatacctaaggtggaaaagaaagatccaactgcagtagtacctcatcaaaatggatgcttgtgatgatggagagctggttttagcaagaagcccaagccagccagctttctagtatataatcctgataatctactcaactatggtcctactgcaatagcttctgaataaatgctcaacagttcaggttgcctttccatatattttcactcctatactagtgctttgactagtctctatagttgtcattcacccatctatcctcattgtaagcacactttgcatttgtcaatgaggcctttgcacttgaaggagaaaaacatggaaaatagaaccagaaaatagtctgacatcatgtactaaatttccagaaaacagattatctaatatcttgggaacgcgattcaaggagcacgttcttctgagataaaaaacagcttttacaatacaagctattaaaaggcaacgatgcaatacaagctttttattgttaactccattctcataacttcagtttcaataaaagatcccattagaaatgcttccccatgtggcaactgctctggaatttccgccattattttctaagcattttatctatttatatcataaagctataaaagaaaggtctggatcaacagtgtgtacatatgaatcttttcgtctaaaagcctaagactcaatccgagaggggataatataaaactttagaagccacccagtttctgtccaatctgccatgaaataaattcagagacagaaagagagagagaagaataaacctggctgttttctattcataaaggtctcctccaaaagctagtcagttctaactagctaacagaactagcaataatgagtttatttagtataaattttgcatgtgttctcttttattccttaactagtaaagtagatatgagcattacccacattttatagaagacaaactgaggattatagaagttaaataaccttgtccaaggtcatacaggtagcaaacagcagaaaatatttgaatgtaaatattctaccctcaaaccttttattaaattatgcaagatagaactttgaaaggctaacaccctcatcattagcacacagtaggcatataatagaaattatcagctggtagatcagtgaatttgagggctccaaaataggtttagtgcttataaaaagcacagttctttgtagacagaacactacctattatgacaataagctgttggcaggacctgaaagaaatcagggagggccttttgaggattaagaaggtataatgaaaatcaggaagctggtttaatgagaaagaaatgcaatatactttgcctctccgattccttttgtatttggtgtactcatctaggagcaactccgtttgttttcttactgtcactctttttttcacatggcctggaaacgattcatgtttctttagtgatgcatggggagagaatagtttatgcagacaattataaaaaggatggattattggtagagactgatgggtcaatataacatatggtgttcaatgcaactacatatctttggaagttactgacaagtctataggtacagcaatataaagcagattttaccaagtgcataaatttgcagaatgactatattttttaatcaccaaaagctatggactaagccatctctagtgacttgtgaaataacgtatgcaagaaatctaaatacaaggacatacaaagagtagaataatcacaaatatatcaacagggaattatttgaagcatacatgtattaggagtaagttctattacacgagagaaaggtaaatgattgttataggagaaaacaattatatattgtctatgagagaaggtagtcattcaatatttatattggaagatatcattaatagacgataatctaagtctttcattttacaaaatgagaatggagaccgaaataatttatactgtatgcacatttatatagttagcctagggctagtctcagtgtgccatactgccccaaagatttttcgtgaactgaaaattatagtacttttttatttatcttctgttttaggttccctttgattctcagatatttttcttttatgtttctattaactcagccattcaccctttcccttctttagtcactgcctgacacttggttgcaatctacctttatacaattaattagggtgtaattctccaacttgctatgattctttttaattctcagactatcatccaaattctttgtcagccccactttaaaagttgcgaggacaccaacagctcatgctaaaatatttttcatttctggtaaaatgccatgtaagtggaatgctaataaaattttagattccgtataataaatataatccatatagcaggccatgttgctatccacagaaagcttctccacacactatttacataggattcttcactacaaaaatcacatggagaacatcctttccctattctttatctaagctattccttggtaagaggaaaggttgatgattatgctgaaaaggggaacccagagcactttgcaaatttatgttctttaaccggcatgtattttaaccttcaactactttctattttcctacattgactattctaattcatctttccagaacactcacttccattcccaaaatacacaccgacaaaacctaagattttagattttgtttaccatgttctctgtgccagacatggttctaaatcttccatatttatcattcaccacattctttcaagatagggattgtcattgtctctattcacagatgagaatactgagccttagagaagttaaataatccaatcagtcttatagagttgatcccaggtggtgtgatcttagagtctgtacaattaagtactaagtttcattaataaacaatctcacacacacacactctctctctctctaaatttaataacctccatcaaggctacatttccattatatctcaccttgcatttttcaaggaatacacttattaaaagaaaaaatacagacttaaatagggagataacttatcctcaagttttccaattatacttaatcacctagtcaaaagcattcagctttgcataagtccctatattatcacgacttttgttttgacaagagaagaacatagccagagaggcagaacagaatgtacatgccaaggatctaggtttatatctagtctaaagaaaacctcatcataatcagagaattgatttttaaacttcctcttccataaggagaatttctaatttaaatgcagttcactaccagagaatgcattagttctgtgtaatgcatccagaaaatgttcaataaatattaacagataattactaaagttatagataatataaattacacatgtagtacacacatctgagttttttaaaaagcataaattcaaaataggattttaaattatatacaagaacaacaactgcaaaattaacttcctgaaaggtacagcaagcacaggatacaaaataacctgaaccttacttagtaaacacatacaaacggtgatgcaattacactgtttttttaaaaaaaactattttcttcacaattcattctcaatatgattttcagttttaaatactaaaatcactgacgcttaaagtgtctgttctcagtttaagagaaatatagggtaataacattgaatataaaagatcattttagaaaagaaatacatattaatgtatttacactgaggcctaaattatcaaccaatatgttgcttattattaatttcagagagaactgcattgctttaggggctgagaaggggcctaaactgagacataatgaactgccaagctgaaaaggatgttagaggtcattaagttacgccttatagttttccagatgaggacactgagacacagagagtagttgggacaacccgaggtcaaaccacaaattagtggcagagaaaagacaggaactcagaggaccaaacgcagtggctcacacctgtaatcccagcactttgtgaggccgaggtgggtggatcacctaggtcaggagtttgagaccagcctgtccaacaggacaaaacaatacaaatatatctacacaacaaatacaaaaattatcctggtgtggcagtgcacacctgtagtcccaactactgtggagcctgaggcaggaaaatcgcatgaacctgggaggcagaggttgcagtgagccaagagtgtgccactgtactccagcctgggtgacagagctagactctgtcaaaaaaaaaaaaaaaaaaaagagctcagaggatcctagacctcagggtactgtatttgaagatgggacaatcttggaaggtgtcagtgaactttaaataaatagcaccccatctagtagtttctctttcagtcatggataaatgcaactggagacaagtcttggctttacgccgagcaaggcagctcagagattcacagcaataattcttgtgtgactaagcaaaggcctccactgctttaaatccctgcatgctttaatctccagctgtctttctggtgtactctctcagggtagggagggatcttaaagataataacttttagctttgtaaaaagttcagatgattttaatggctaagtatttacataggttatcattttcaaagtccaaatgttggtcaatgaggatattatggaggggaaaagtcttgcctacgtggaatatctatgactttgataatgaagagtgagcaggttctgcaaggagatatgttggaaaatactgagctcccatgactaaaattaagacaggaaataaatcaatctcagaatttctcaaaagatgttaaatgggcagtttgctggttttgggaagtgagaagggaggtggtaattattttaatccgtatttttgtggcacaatgccacaaaggtgtacgtatcatgcttaaagtatattcgcttgaatgagattatcatctcatatctgcttccaggaatagctcagatagaaactggtgctggggttaaggtaagaaatgatgggtttaccttcccttgtcaaacaagctttatcatttagagtaagcacaaggccagtttaaaccagcttaacttttacatgtatgtatgtatttatattttcatagaactacatatttatttctcacatatttaattagtgtcaaagacagcagtgataatagaaaggagccctggaatgaaacccagaaatcttgagttgacatcccagatctgcatgtacctggcttctgcccttcaccaagtcaataccttcaggattctagagctacaagacgaaaagcttagacttccaccagggaaacctccatattacataaatgggggagataagtaggttagacttattcaaatgcagaaaactagaaaattggctgagctaggactcagtcaacagccactctaacctccttctatatcatcttctactattgtagaagatggaaagttaaaaaccatctttcaccaattccctttacattaggattcttcacatggcgtaggtttcatcaaactcgtgaggggggagtaatcattccacagcccacatgagtgggctcacacagtggtggaatccctctttgttattgtttgacgccataggtttcacgtaaggagaaatatgagtcaatgacaatttttacttttttttcaatggatcctggagtttaaaaaactgcaagaaggcactggaattaaatgattaagtttgggtccaggcacagtggctcatgcctgtgatccaagcactttgggaggctgagctggaggctaccagtgtgtaatcaatccacattatatttaaggaagtgtgtttattatgtcttggccttcagaagtattgctccacttgagcccaggagtttgagaccagcctgggcaacacggcaaaaccccatctctacaaaaaatagaaaaattagccaagtgcagtggtatgcacctgtagtcccagctgccattgcactccagcctgggcaacagagtaagaccatatttgaaaacaaacaaacaaacaaaaaaagatactctgcatagaaattaatcacaatttctttaaatatgcaggtttttaaaattttttgattaaaattttccaaaggaaatagctccaacttttaaatatttgaaggggaaaacattttattttatttattttatagacaggctctcactctgtgccctaggctggagtgcagtggcatgatcatacagcatggtaatctgaaattcctgggctcaagccatcctcctgcctcagcttcctgagtagctatgactacaggtgcacactaccacacccaggtaattaaaaaaaaaaattatctggagacggtttttgctatgttgcccagctggtctggaactctgggccttaagcaatcctcccgcctccacttcccaaaatgctgggattacaagagtgagccatcacatcagccacattttcatttagacaatttaatttggaacaattggagcaatgcttctgaaggccaacacataataaacactcttccttaaatataatgtggattgatgatacactggtaggtatttatattttgaagtgccatgatgagttccgaatgtttagataagaaataaaaagggaggactagaggaagtgtaccctccagagaagccaaatttagtctgggaaatagaaatagggtcaatgtcaacagcagcaagatgacgacagaccaatggctgtttacaccagagtctttccaggttttctgacaagttttgtgttacttcatatcttccttatttaatcctggccattaactacaatacagtactaacattttaactcagctatacaaacccaaaacttcaataagtttatcagagacaatactgatatgttaaaaaaattactcacaaaacacatgcatacagaatatagtaatatcacatattttgcaactgtgtccacaattaagacctcctgtactaagtagaatgtcactgcatatagggtattgaaatacagaagccatttcttgtgtagcacccaaggaaagtctttcacattcaaactgccttttacattaatggaagtgccaaaatgatttgcatttgtatattcgcaaatcatattgttttaatatttcaaagaacggatcacactcaccccttatcctatttgattctattaggtcttcaaaaaggaactttgggtggacacaacatacagaaatcctattaagcatatgatttcatgaaggtatgcatgtagagtgtttagaatatgacacatatttaaatgctccattaaaaaactattaatgttaggattagaatataaatctacagtaaaatggtattgatgacagaaacattttaatcttttgtcagtcaattattgatatttcaaagtattttataaattttggtacaacacatacacccaccacaataatgtgaatcctttcaaattcttgttttgcacatatagtacagtataaacttgataaatgttttttaaaattaatatagaaatggatgaatgagattcaattagcccaatgtcagatacagttgttgaaatacattaagtattcaacaagtggatacaaaaatatgtttgaactgccaattatagcaaggtctctgtgtcaaattaaaactaaaactaagatacttcgtatcttgttaaagactggcttaatttttgtcacatggtatacttccaagtgcttttacctgaagaagactaagcatttctccagcatgcctgtccataactagtatttatcctctatgcaatttgttaacatggtacctaagagttgacaaagaaaagcagatacctctttagctagataattcattaatccatgttattttatcattttgtggcccactgtagtgactctcacttatccatttatttgttcaataaatatttcctaagttcctattatgcactgtacaaggtggatactccacagtatgcttaacaggtatggcccctcctttctccaagcttagtttagaaaggcaaataatcaggaatgaaggtgtttatatggggctgaaagattagggaggagtaaaagggaaaaggagcaacacttcttgcacatcttctatgtgacaagcacaattccaggtactcccccatagttcctcttttcagggaattgttgctgacatgtgatgtctcccccaggcacccagctttaaaatttctctcttttgtactctgtccctttatttctcagaccagctgacacttagggaaaatagaaaagaacctacgtgaaatatcgggggtgaatttcgactgatagggaatgacctctccagccacccagtaactcaggtcaaacattttggagccatctctgactcttttcttccatttccactctatggtaaaaccatcattaaatcctgccagctttgcattcaaagtatgtgctaacattaaccagttttcccatttcctccactaccaccctagtccatcatcacatctggtcatacaaaggttactctactgcctctcttgtgcatctgtaagctattctctctatgacgaatgaaacagaatcatattcctatttttcagatacttttcaaatacaaatgattttctgttgaatttagaataaaataggaagttcatgttgtggtctgtcaagttctataaaatctggccttcaattaccgtgcccatctatctctcaatctctgctttgctcagtgtgttcaactactccaggctcccactggggttttcaagcacacctccacttcaggcctgtttcactcacatggagtattctcgctcagagctgcatgtttctttgttgtgtttgctcaaatgtcagcttctcagaagactgaatgtgttcaccctcgctgaaatagtaaccgcccttatccattctctatgtccttatcctgcttaaattttctttatagagcttgccattttctgaacatcaattacattatacataacactcctattgatttctttattatctgccttcccacctgaatatatccatacaaacagggcttccactatacaaggctctatcctcagcacctataacagtactaaccatgtagcaaaatccaagaacacattttttgaaataatggattatttcatttgattcttatatgaaattgctaatattattactattaccaaaaaaaacaggtaaaaaataatgaaacaatttttggaaagagataaaataatttaggaaacagggctcatgattgaggattagatgactagcagaggatttaaaaagtgaagaagtagaaataacagagacagatgttttgattttttttaatttctcaatttctttaattttaatattacaaatgaaatattttggggaacaatataccttaattccgtaaattaatattttaaaattaataatctgctttgttaatttccaataaaaattaaaacctatacatgaagatcatttacaaaagatgagaaatgacacagaaaatatagagtgaacactacttaactactcctccacttttctgtttccatgtcagacacatgcctggtttctgacccttgtcagaccaggaacaaattataatttgaaagtagggcataaagcgctggagttgagacttgtaaggatgtaagagcttacaacaaaagaacataggaaagtgtggtgaaggctaaagagaattagaatgcctttccccatttggtgaatgaatagatttttgtgttttgttttagcatatcttcaggcctgaatggaatgctttgtgtagtaaacacagtaaagctcaaatcgagtttactgcctccatatggttccaaccacatacgtacaatggtagattcatggggttggggggggggggcgtttgtcaggggaggacaagtcattttcctagaaaaggcaattgtgtttctagaattttattaagcaagagttcaaaagcaagccagagcaaaaaatcgtactcagaacatcagtttgttggtgcctttccaaaacagcaatttgataaaagtgcatctgcaagtcttttatctgcaaagttaatttcattattgcactatactgtacttaaaaaaaagatccacacatttattaaaattgtaataaatgaatcacttaggctttgatctcctacaccagttttactgagctcccctaaagggagatcaattaagcatacatttttccaccttttaaaataatactctcagacagagcatttgaatttcattttattaaaatgtaggcacagtaaacattataaaaaataaaattcccacaattcacgctattttaaaaaatatcagcaactgtctcatttcattcttgataggaaaaataaaattttagtttgatgatggggttcaggatataatatccccaaatataacagtttggcatgctgaaaactgcagaagcaggaaggtcactctcatcctcttctgcctttcactcctgaagcacatcacaaaacataggaaagattttctgaccttctcctgaagcaggtcataagatattcaggtgaaagataccctccctatattgggaggaaaggaacatccttgtctctgaagaagggtcacacagaagaatctaaacaaacaccctgataagtttccctaatttattacaattaaatcataccaaatttgtccattcatacttttgtacaactgtccactcttcatcaaacctagcacaaaatacacaggtttaactattttttcaggtcttcacttccttacaaaggcctccatgtcaagtaaaacgtatatgaaataccttgtatgcttttctcttgtttattagctattttgttataggaacttcaaccatgaacccagaatgggtgagggaaaggtatttttcccctcctataaagatatttcctaagtgttctctgacacaatacactaaaaactactttatgacacaaccagaagcactaataaaatgttgtgtttctaggaaagtgctctcttcatcaaatgacatgctttcgtagaaaacagaatcttattcaatattgtgagagttttgatttatttgctatagtgtaccattgcttctgtgttccaaaacacaaaacgattcatataataatgaatttgttaaaatgactttccgtaagaaacacacatttattttccagtgcatataaagagcttagttatgagtctgaaagtatcctctatgtacctaggaaggaagttcccccatcaggacaggcaagggaaaaaattctctgtaaatataaccgaatgaaaacaaaaggagacacatcatcagaaatattacatcatacatgcaagatgacaaaatacaatttttgaagtgttattttctttgctacttaaaaatggaatgacggaaattatatggtggctgtgttcttgtcctggctatgaaactaatagggtgactttttcaaactgttttctttctctgttcatctctaataagaagtggctgcagtagatactctttaagatttcttctaactctaaaattctatggattaagtaatttaaacattttcaaaggtattttcatttcttcatatattcttcctgagcttatgacaaattaattctatgttcaagcatttatggacagactcttccaactgaaagaactggtgaatttaatgatcttgaaaaaggaggagaaataggaggaaacacttaacttattactatccaagaatatcctaaaattctactcatttgagcatcttctatgcagccctcataaggtaacaaaaacaaataagcatagaaagtcttggaggaactactgattcctaaataataatgatttatcaaagtaaaattattgttatcaaccagtggaccagttaggggcaccaataaagtaatgagagatttctaactgaaatacattcacttatttaccctgtagcataataaaaacgaacgtaaggaatatacaacattgagagcattgtttcaggtcattttcacatacgattctaattactaaatattccaggatgagaagaaatgactagagataaattatggtgcctattaaaccttttattgaaacctcctttccaaaaattaatatcacatttaatcatcaaaatatcctatctaaaaatttgatttatttagttgtagtctacttccacatggaatttggagtaactgtgtaagacatgaaagaaattctaattgaaaaaaggcagactgggcaaaagataatcagataaactagatgcactacatgtatgtagcttatttgcctctgactcctggtacatatgacaatatatcctgcttgtacacacaatagtaacatatttctgccacaaggaaggacaaagaaggaagcaaaggagagggggaggaaggaaaagttgactaattgcattttaaactgttaccaaacaagaagtgagttacagaaatgaatcaccactactctgaagtttcagcttgtgaataaagttgccctggctgatactgattattttctacttaccattttaactgtcatctttttagcacattaaggctctcttttcatagacctgcagaaaaccggttttactaatccctttcctcccagaatgccttcgctctttatcctggatgtaccctcacttcctgttttttgttattgttgttgttgtttgcttgtgtggtggtgggggaaaaaaaaaaaaacttagaagacattgaaccatatatccaggtttccggaggtgaactaacaaccccaagtttggggtctagccaaccctttcacagatgctggacagatactaagcaaactactgctcacacacctgccatgaataaaattttaaattcatgacaaagggcaacctgaataaacagattctgggtgagaaaataaagaaaatgtgcagagcctaaaacagttatagcagccaatacataaagtatttgctttcagtaagtgccatttctgtttttggttacttctcattcccttatttctcccttttgacaatattttgtttggataagtcatcagcctagctgaaattttattacacagaaaaaaatgaataattaaaaagttatgaccatttcagaaaactaggctttatggaagtaactttaaagtacgtggttttataaataagcatttgtaggaggctgagacaggagaatcgcttgaacctgggaggcagaggatgcagtgagccgagatcatgtcactacagtcctgcctggacgacacaccaagactccgtctcaaaaataaataaataaacaaataaacaaacatttgctcaaaagggactcgggggtatgattctggtattttccctctcacctataaatgttatgcaaatgtattatttttcaaggaggggaatgcccagtactgggagaccacttctccatctagaggagaattttcttgtgccaaggttactgctaagtttgaaatagaaagaaaagtgtgcttagtaagcactgaaatagatcaaaggaatgaaaaaagtcctaagaaatattaattttagactatagtaaaacttaatgaatgaaccttaccgcataagatggaacatactggatagtcactataatatgcatgcctatatctacatacatatctactacatatagatacacacctgtatctagctattttttaaaatagtcacatttttcttgtgatttctttgtttctgcaactcttgatttcctctgattactcttttaactggatctataacctacatctttctctggatattcctctggtaactctccctcttttattcctcatcttctttattccaagttgacaattagtttacctttaccctgattactcagttataatgcctattcttacttcccaagaaaaaaatctacacatttttaaactcatttttgaattgacatataataattgcaaatacttatgagatatatactgatatttctatatgttttatgtacaatgatgagctcaatgtgatcagcatatccatcagttcaaaccttatcatttctttgtgctgggaacattcagtattacacacagaaaagctatccttcaaaaatgaaaaagaaataaaatatttaacagataagcaagaaataaggggattcatcaccatgagaatggccttgcaagaaatgtttaagaaagtctcacatatggaagtgaaaagacaataattaccaacatgaaaacatgcaagactataaaactcactggtagtgtcaatacacaaaggagaaagaaaaaggaataaaatcttatcactatagagaatcacccaattgcaaaaataaaccataagagaggaagtaaagaacaaaggaaatacaaaataaccataaaacaatcagtaaaattacaggaataaatctccacctatcagtagtaaccttcaatctaaatggatttaattcccccttgaaaagatacagactggctgagtggattaaaacaaaaatgacccaaatatatgttgcctacaagaaacccatcttatctgcaaatacacacatagactgaaagtgaagagaagacaaaagatatttcaggcaaataaaaaccaaaagcaagcaggggcagtcatacttacatcagacaaaacagactttaggtcaaaagctgtaaaaagagacaaatctacattttttcttggatttctcggtatgatagaagctagcaatcttcaaaacgtgtataaatctattgccagtcattgacatttcttataagaacctgtgtagttgtctcacgtgggtccgcagctatttatttccaatttcctttccatttaagacctacctatgcagccataaaaaatgatgagttcatgtcctttgtagggacatggatgaagctggaaaccatcattctcagtaaactatcgcaaggacaaaaaaccaaacacagcatgttctcactcataggtgggaattgaacaatgagaacacatggacacaggaaggggaacatcacataccggggactgttgtggggtgggggaaggggggagggatagcattaggatatatacctaatgctaaatgacaagttaatgggtgcagcacaccaacgtggcacatgtatgtatatgtaacaaacctgcacgttgtgcacatgtaccctaaaacttaaagtataataataaaatttaaaaaaaaagacctaccatttgagcaactatagtcttataataaccttctgttactctctatttttctaagtacaccacatactcaaaaggtaagctccttgccccttaatatagttacaaggtttacaaagcttagtttccagcctgtttaaccacttttcaacatcttgcctctgtgcactacaaattctaagttatttgtagttcttcaaatgagtaagtgtctttttgcttgctctaccctcttctccctatgttcccttagctctaattcctattcatattcaagtttcgccttagctgtcttatcctctaggaagcctcctctacctcccaaatctgagttgcttgtgccctatcattactgttcatcactctgtatcgtggctgaccttctaaatgtctatattcacctataatctatgaacaccaatagagcagtgacctgcctatctgatgacaaacataaccccagtgcctaagctcaatgactttacgtattacttaaaagtcataaatgttaaacatttttctctagtgcataaattacaacattagatactataatgagctataactcttcgtctctttttatttcaaaattctattttgtaacaaattactttgtttccatatgcaattggacatgtttttcagataattatcagaagattaatgagcattttctgaaccatttctgaaatacagaaagggtattcaaaaaaaattattgtccaaagaaaaattgatacaatacttatttggaagtcctgaaatctaagagggttaaaaatatgtgtgcctatgacaatttctgaattatttacaaaattttggtgatacaatatagaaactatttacatactttccttatgagttacttatgaaaacaatgttaacataagttactcgaagtgttaggggtttaggaaaattgtgcataataagcacataaccattatacacatcaaaacgtacttttaccttttgtgtgtgtgtgttttatatattatttttctatttttaaatgaagcagatttgagaaattattgattggatagtttttgataaaggataaaagagttagacaggttaaatacacatttttatgggatgcacttttacatgaatgtttctttcttaaactgagtaaatcctgagataaaatattatcaccaaagatatttagctaaattgtggacaaatacatagagtaacagtctgtagacaacagcaaataattatctggaatattcccttcatttcaaaagttttcatcttaggtatattgtttgaatattttattatcaaaaagccaaaatatgatgaaaaagtcataaagtgataaaatcctaagaaaggaaataacagtggaaagaaaaattaatcttgcacagaatagaaggaaaataaataaacgagaagcacacaaataatcaaataaagaaaataatagtagaaaacaataaacctgttttgtatgctgagatttgcctacagtcttcctataaaattctggaaactatatctagaggttgctctttgattgttgctggcaatgtatcatttggttgggaaatacattcacacataaataaaagagatcagttataaagaaaaatacaaatgtcaaatcaattaaacccaagcagtgctccaaatcaaacaaagaagagagtcagagagtagctcaaatgctattatactatctaaaaagaaggggtttacttttgatcctttgtgtatatgactccatagaacctgcctgagctattctgaagctgtgagtggcgatggtgaaggcagatgagaaagcatgacgtgtagagacaaataaagcttgggttcaaattttctccttgctatttagatttttccaggaatttgttttcctaaatacaaaatgaaaataattaaatttggtttgtgtttttgagaattaagtgagataataatcacaaagttgatcactgcagggtatggcatacaatcattacacatcaattcctttcctctcttgcccattactatctatacagggcatcttgaaaacgtatttattaattgtatttcttataatacatcattttaattgtgtataaaatatactcaaagatactaaaagcatcaatataataatttcctaacataacattttagctctttgtaaatatatataaatataaatttataatttacaaattaatagccacaaatgttttcttggaatgtttttataaaacttgtagtcatatacttctattttttatagactgcttttaatttcgtgataatattaaggttatttggtaggacaaatcacatttttttttagttttaggcaattttttcttaaactggaaaaatctgagacatacagtaaatgaaacaaaaatctgagctgtagagtcaatgaaaacaaagtataactaatttgtggaaaggcaaaaattagaacccagcaatgtactattctactaaatatctttagtttccacataaatcatgagttggcatataacatggatagtctgaataaactcttgttacttaactccaatattgccctaatttcaaggagctgatccagaagaggaagatctgagttgggacttcagaccaatggcaagattcaagcctttcatctccatgctttctgcatttctctatagatattcagttgtgaaacacctggagtttatgtgtagttggctcacaccagctgcatttttgaagaaggggtaaaataagcattttgggttagatatgaaaaattttatgcaacaaatgcatatttggaaactgcaaaatgagcatgcaaatcaatttatatgcatcgatgaatgaatatagacgggctattttcaaagtataggcattctagtgtagcataatatatcgggacaaaaggaatgggaaggaggcaaattgctcagcttagtcatccatttgcaatggaaaattgcattgtcaagttccattatgcctgcacaaatttagacaaattaaagagtctactaagtaattattgataacatacatgtgtatgaagtagagcaggaaagttgtgagtcatttggaacttctcagatgtttctaggattttcattagcgaaaggaggcattgaaagaatgataatataccttactatgaaaccaatttgagacacaacactggcctattcagccatatctcttctatggtgacagagatggataacaaccggaaaaagtgtaaataaaacattaacacaaatcactctgctgaggagaaacgttacatctggttctggaccctgcatcttgttaggatcccttcattcattacttcattaccaggagaattattcaatctgacacacgagaccaagttaaaaaaaaaatccttagaattatacaaactttaaatcctatatttctctcttttacagtgtgtgttcagaatatattctgcaaggttactgtggtattctcttctgacaatataaacattctactacgtttaagacagaatgttcaaccaaggataacataaatccctggaaagtcatataatgggtctcatcttctgaaatggactattggtttgacatttcaaacatctcatagataatccctcaagatggagagtcaccaacttcctttgataatctgctcttgcacttataaatatttatccttcaacaatttaaatatgttttttctttaccctcttcactgaaaacagcaaaacacctggtctttacaggttatgtgcctttttatacataaataagtatataaattctattttgcatatatgtgtatgtatttgacatttatttatactcgctaaacgtatttttaacaaacttccataccagttcacaaaacacacctcattcatgttatattgtgagtcattatacacagctctaccataatttatttaatcaaatccatgttaataaacatttggatttgactccatttacttgttttcactattacagacaacatgcaatgagtaccagtgctaatatatttgtgaggcttgttcaggtatttctgtttaaaaccaaagttcctagagatgaaactgttaaaggaaatacacatttacattttcatagttactgttaaactgcctctcaaaagaactataataatacacactccatccaaagatgcacaagagcataagagtgtctacgttgccacacctttcggccaaaactgggtatgatggtcttttctgtgctttttttttttttggtcttgctttgccacccaggctagaggacagtggcacaatcacagttcactgcaacctctaactcccagcctcaagcaatctacctcagcctcaaaaatagcaggaactacaggtgtatgccacaacatctggctaatttttaaaaatgtttttgtatcgcgctttttgcctgggctggtctcaaactcctggcctcaaacaattctctcacttcagcctcccaaagtgctgagattacaggaatgagccaccctgcccagcctgatggcgctttttaatattttcaacaagctaaacaataaatcatatacttcattttaattcacgtctttacttattattgaggtcaagcttctttttatacatttactagctatttgatattctcttttaagaaattgcctacttgttttgtttgaccattaccgacaatattctcttcttaatatcttgcagtgagacccactaacgtttattgaactcctacagtgggccagactctggtagctcttacgtatataaaaggtgtaagtgctcccctggggacttagaatcaagtgaagaaatcagatgggatgataaattactataataaaatgtgttcagcataagaataagggtctacacaaagccagcattgtccctgctggagaaccaggggtgagcaggaagagggtatcagggatgatttcacagagaaggagaccttacagatgggttttaaatgatgggtgaaatttcactcagtagagattcaatggaaggcactaggtccagagagagtaacactagaaagaaccccaagacatgtgaacacaattattattcagaatataaataatgactggcttagatcacaaagtttctgttgaaagaaaatggtaagaaatgagtctggataaggagaccaatttatatacaagtgcttgcctgccattcttgagaatctgtattttatctttcagccaaaggagcagtactatttataaaggatcactccagtagtagagacaaatggctttgaaaggggacaaaaggagcaatgcctgagattgggaaagtggtaagtagactatagcagcaatcctgatgagggagtatgagagcctaaaatagcataatatcaatagaatcaagagaacttggtcacagaaagcatgtgattaatcctttcatctttctacaactagtcacactggatattcatctctgtggcagcatttattgcattgtaatgaaatcatgcatgttgtctaccagcccaccccactaaaatgtgacgctttccaactcttagacctgtagttgaccaaaacgttgtttcaccaaaaaataaactttcaggtttcctcactttccttgtgttcacattttatgctgcaacaaactcagtatttattaatctaaagtctttttttaaaaaaacttagcctctataacattctaatgccttagtgcaaactgttttattttgatatggaagaatccagtgattacagtaatttgaaatgatggtgacttaattaagagtgtgaagcaatccattaactataatttgtaaaaggagccatatgtttttcactcttttaggtataccattggacttgcattttcaaaaagtaaacctgctaatttttgcttcaactgaggatatcattaacaatatcaccagtagcacacatgtgtaccttattacagatcttcatatactataattaatagtgagttttattcgtatttggatgcctgaattgtttagacttgtatttaggtttcaagccctttatttgtgctgtcaaacgtttagtcctcaagggcttgagagcacagaggtgaacactgcctaagacctaacatctcacctcctcctgtgtgatggcttcttaatatgtggttcaggaattatgaatggagaaaaacaacagaggggtcaaagatgaggctagatttctggtttgtgtaactggctttcctgggaaaccaaaaacatgacagaatacccagaaatgcatgtttttcattttgtgagtactataattttttttctctggtttttgttttctttgttttgtttttaacccaaaactatttttctgccctctaatctcatcctcctccaggaacaattcataccagtactaccaaagaccctttcacccaaagctgtatttcacagaggaagaacaattacataggatataaacggactgagatgtaagagacaccactcgaatattctgtggttatgcagcagggcaagaacatcacacctggtggaggtagagtcagtactgggaggataccctggagatggcaaagcaaacaagaggaagtgcaaggtgagtctgcaatacaggcagcggctgtaactcgagctcaaccagctcaacaacgtttaaggaaacatgaaactggggcaatccactgtgtaaagaggacaagggcagctggctcagggcaaacataagcatgtgggtggagagcctgcccagagtgtattccagggacaccaatgtgcaacaacagcaagtcaagtcactgggggaagtaattcatgggccaagtgttctgtaacagttggtgacatattttatgcaaatgtatctgtgaattataacttcagacactcttgaaatagagttgttttttttttttggcagaaattaggttttgtagggggaggggagagtatttgttttgggctttttccaactcaggacttgggagatttgcacgttaaaaggctttcagaaaagtccaattatttacataactacagaactgaaaatatatttcaaatgttacttagtccaggctgctgaccagaaaaagaggaaccttaagcaatttaaaactagcagttgtctatttaagctactaaggatctctagtgatacagattcacccaccacttctgctgacctgttctcacatttatactagaattacaagtgaatgctgttttctctttccttcggcctaaaccagcacaattttgttcaaatccatttccattgtttagtcctctgtggaccagactaccactgccagttttccttagtccaaattcttttttctgtttgtcagctcatatttttctgtcctacttttcctgcttacaaatgcaatgctatcaagatttttccctttatacaattctggactgcctgatctacagacactagtgagagacattttttaagccactagataacaaaaacctatcaagaattttatgaagttcttgtccatgcaatttccaaggcatgatgggaaattagcaagtcagacaaaggcaacagggaaggtgagggggtcactgaaagtgcagtgatgctgctgctgggatgaacagaccaggatgactgtaacacatttttggaactagcctttggaagagcattagccagctgaagtgatagtgggtaaaataaacagagcgggggctattagaggaaggaggctgaatgtcagaccagttgcaaagaacgaggattggaacatttttagctcagtgaagacagcactctttctcttaggcagataaagataattgaagaggatgctaaccatatggattttatttccactgaagacataaaaaaattaatttatgtcagcagagaaaggatattcattaaacttaagggagaaattttctgctcaggaaaagttattaaacagttaaatggaattttgaaaaagagaaaaaatatgacattgcattagcttatacagacttctttgaaacacaggagagattatcctatgtgaaagggtgtggaggatatacagttagttattattttataaataaaaaagaaggaattacaagtgaagagtctggcctcaggatttacgcagctatgattcaaatgtcaggtttgtgaatttctagtgcgtgaattggggaaaattttaaaaatctttctgggccttaattttctcacctatcaaatgagaaaaaagtcacctactttttagggttgtagagtagaccaaatgaattaatagcacaaagagctgaaaatagtgcctgacacactgtgagagccatttaagattttgctattgttgttgatgttgtcagttggcaggaaaaattccaatgatacactgccagaaatgacagctagagacaaagaatgattatattttctgtaggttaaatgtagacaattacgtatttattcttgtcttttccttcctatttccctttttggcttaagcccagagccagaagtcaagcaatgtatgttcctgtcctgtcttctactaaccagatgtgtgattttttaaattttaaaccaacagttctcaatgtcctcattgtttcaaattctgttaactcttctctgtgtctgtctgtctctctctctcaatttactttaatcacaaatactctttttctctcccatcatcttttctcctatctcctgttcctctcttctggtcttctgtctcattttctaaattatcaaacagctcaagcttcccagcttccctgaggcttgagcatctttccatcctccacctcctatgggcagaagacactcagaattgtgtatttggctccagttcaaattgttattgtctctgtttaggatacaaataaggattttgtccaggatggataatgtcttgggtcgaggagaaggaaggtgcccatcattcttctttattgccaagaacctctgggaacatgaacagctcccagctaacagcaggagaggagcaccattcccagaagatttattctaactcctgaagctctacctatgtctgtacttttatgaaggaaatcaatatatagagtcatagaataacaatggataaacttcaagtgaaaaaaaaatatttaaatatcatttgaagtcaaaaaatacattgtgatagaagaaagacatattttaatccaaccatttttaacttaaataaagggtgaacaggacagaggaaaagaaaatgaatgtctaatatattataaaatatatgtaatgatattaactgaaaaatggagcacgtttttaaacttacaagttaccatttgaaaaaaactactttaaatttcatatggaaccaaaacagagcccgtacagccaagaaaatcccaagcaaaaagaacaaagctggaggcatcaagctacctgacttcaaactatactacaaagctacagtaaacaaaacagcatggtactggtaccaaaacagatatatagaccaatggaacagaacagagacctcagaaataatgccacacatctacaaccatctgatctttgacaaacctgacaaaaacaagcaatggggaaaggattccctatttaataaaccataaagatccttgaagaaaacctagacaatatcattcaggacacagacatgggcaaagatttcatgactaaaacaccaaaagcaatggcaacaaaagccaaaattgacatatggggtctaattaaactaaagaggttctgcacagcaaaacaaactaccatcagagtgacaggcaacctgcagaatgggagaaaatttttgaaatctatccatctgacaaagggctaatatccagaatctataaggaacttaaacaaacttacaagaacaaaacaaccccatcaagaagtgagtgaaggatatgaacagacacttttcaaaagaagacatatatgtagccaacaaatatgtgaaaaatagctcatcatcactggtcattagagaaatgcaaatcaaaaccacaatgagataccatgtcatagcagttagaatgacgatcattaaaaagtcaggaaacaacagatgctggagaggatgtggagaaaaagaaacgcttttacacctttggtgggagtttaaattagttcagccattgtagaagacagtgtggtgatttctcaaggatctagaaacagaggtaccatttgacccagcaatctcattactgggtatatacccaaaggattataaatcattctactataaagacacatgcacatatatgtttattgcagcactatgcacaattgcaaagacttgaaaccaacccaaatgcccatcaatgatagactggataaagaaaatgtggcacatatataccatggaatactatgcagtcataaaaaaggatgagttcatgtcctttgcagggacatggatgaagctggaaaccattgttctcagcaaaataacacaggaacagaaaaccaagccctgcatgatctcactaataattgggagttaaataataagaacacatggacacagggaggggaacagcacacactggggcctgtcagggggtgggggtctaggggagggatatcattaggagaaatacctaatatagatgacggattgataggtgcagcaaaccaccatggcacgtgtatacctatataacaaacctacgtgctctgcccgtgtatcccggaacttaaagtataatttaaaaaaataaataaatatcaaaagcaaatatgtgtataggttccctaacttttctgataaaagaggtttctgggattctttttttttttttcttttaagagatagggtcttgctcggttgctcaggctggagtgcagtggcacaataatagcccactgcctcctagaactcctgggatcaagcaatcttcacacctcagcctcctgactagctgggactacaatacacgtatggccaccacatctggcttttttttttttttttttttttttttttttttttttagaaatgaggtctcgcttttttgtcccgcctggtctggtactcttggactcaagtgactctatttgtactcccaaagcactgggattaccttatttcctagaaagttggcagaactttttaaatagacattcataaatgtatactcttacacatttcactgtgcttttgagtagtgaaatacaatatgtaacttcctatatttagaatgttttcaattcagtaaattaaacatttaacatttgtagcatcacgtataattttaaataaataattacattatttgctggaaaataaatcaatttttcaccaaagttaaagagcttaagctgtatagtggtttcttccatacaacaactatagtcatatgctgccatgccagctatttccctaaggagagcccaggcatgcttaattatagaggaacaccattacttagaagaaaaaacatgagtctttaatttccttgtctccgctggacggggctgtggattctgctgaatctagcaatgtctgagtaacacttaagcctagctgtttccatatacgggccaggtgttgcgaggtcccaaacaacagtacctcctaagctctcatcagttgtgtttccatcatggattagaacccacacagaattcattatgtctataattaaatgaagaaagcccttctgatgtcaggatattagtgaagcaactgttcgtcttggcagctccgcttttaacttttggattgccagatccctcctgggaaccaacctaagaaagcactatttgatgtagcagttgttcctgcagtgtggtgtcagtgcatttctaattacagtccagacagttttgagcgtgagtaactagacaagaggccaggtcagcactttggcttgccaggtcagacttattttcctcccacttctttccaataatagtttctcatatatacctgaaatagtacagggcattcatctttccaactctaagaaccactcctaagttcaatttcaagctatgtgttgggaagccaaacacgcttagccaaaaagaggcactatcttctcattacgacatttcaattaagtgcccactgtaccatcatctagattttcagcagaaccatactctaactcagcaactctcattatttatgtgactgagctagttctttatatttgtgctgactcaccacagaggttgatattttcaataattttatcatccaaactctgaaagagatgaaaactttgtgttgcttgttttccaaaataataagtttttcatcaaaaggacaaaaatttgttgtaatattatttagttgcaatattttggggctttactgctggttatgatagagtagaatcaacccatcaagtagaatatgaaaagaaggttaacaaaggaagcaaataaacaagcgttatgaaaacaaagagtgatgaattctgacaagctattccattttctttattatcatgacagtaggaagcagcactaaatgtaagagtctgccacaaccctcaaatctgaatgctttattataagtcagccatttaaaatagtaccaacctgaaaactagtgaacaaacagcccagcatccctttgataagcgaaatatacaagttgtgtcatacaatggacagggctgcctgctaaggtattgggcatacttggacccaaatcccagctctgccatttacgagctactgaacttttagcaagtgatctcttctaactcacagttttctcactgataaaatcgatattttataaaattatcaagtaggactatggtaagactatataagataaggtagacaaagtacactgcataatgcctttcactcgaaaaacactaaatagtaattttaataaaaactactgtgatttttaacagaatgattttaaattattctcaacttcaagaggtgcttatgaccttacctttaaggagaggcatctagtccattttctgaaataacttaatgtataatattttgggggaaaatcatgtatatttgcagatttagaaaatactatgagagttatggttgaactacctggtaatgccttttccaatatccaattactcattcaagtatttactgaactcttacaaaatactcatcattcaattacttaacaattccagcagttgagttgttctaattggaaaacttacattgcctgattgtgttggtaggatttgtgctccgtggatgcaagtgtaaaataagaacctatgttttatttctaaacattataaagaacataaaagtggaaaatgattcaaattcaaacactgtatacagtgtttaaaacagagtactttctctgcttacttttaaaattattcataaataggtctgctctctggaatactccttggatatatgttacaaatatttgacttttatactcaacatttttcaatatagatttccattaaggattactttgtaactaagcttttttgtatattcagtgcattggtattcactgaacagcatttctgttttaatttgaaaggtttttttttttaagttgagggagagtttacatacagtaaagcatatacattttacgtatatagttcagtgaatctttacaaatgtaaccaccacccatatcatgcccaatgctccattgttttgtcctcttctagtcaagaccactaaaaggtacctttatcccaacctctatcatcatagattagttgtatctgttttaaacttcatataaacagaattatatcgtatgcactcatataattgctgccttaaagcacttattttatttgtttaaattttacccaagcggaataagggaaacaatgtcctctttacttagcttgtcataaaatccatattttaaagcataataataagagaactctaccaaatctgatgcatacttctgggcataaatgatctaaaatacatttaaaatgaccccaaagtagatgtaaagaaatatgattcacatttttataatactattagcattcacaacgtcctacagcaatctacctgctaccatttaatatctcccacaaatttttaagctttgaaagagtgtgtatctattatctactcgcaaacaatctgtgaagtaggctggcattagttcacaatatattagtagtctgattaggtggtttcccaattcgcaaccttagaaaatgaaacagaacattgatggtgttattttacttttaacatatattaagatgtaaagtcccacctggaatttagttcttcagattccaaaccatgttctgtttacacacaaaatacaaataatcatgtggcaagaaaggaatctgagagagcatggtactcattccagtattcaagtagaactacatggaatccatgctcaggagaaaaaacaaaaagccttgcaattttctgaacagctctaaagcaactggccaaaattttgttttccaaagctaattagaacattttaagatttacgtattcagcaaaggccgtgtaaatttacctattcctatacttatgaataatgaataaaagaaaaggaactgggccacaaaattatagagaagtacacaacaaaaaaagtataagatttttgcatactgttttttaataaaccaaaaaactttaaaaaatataaaaataatttattctgaattacatcaaatagcttatatactttttgagagcacagtttgcacagcaacttctaataggtttattaaccctgtaataaaatgaaacctgaatatctattgtaaggcctaattttcagtacatatttataggagttaattctgcaaccagtgtagctgaggaaggagtatagaatgtggtcaacgactattttcaggtactaatgtgtctcagagccctggttttcataatgtagctaagaatgacagaaatattatacagtgccagttctttctatagtcaatcaggataactatacttttagtaatcaatttaattcacatttaatgatatccaaaactgaacatatcagtgacatgtatacatatatatatatatacacaattttatgctgaaaaatataacctacttatgataactaaaataacagcttgcttgaacttttaaagccaaatatattacctatcttatctgcagcatatgtgtaaataactttaatgtataagagagtctcaaagacaagttataaattcaataaatcttttttatactaaaactattaaaacttttcctatttgatagacaatgtactataaacttcaaagtaaatggtatcttcaataagctattaatatagtaaaaatcactgcttaaatataaaattgggatggaatacaggtattagtttatgtggaaagtgaaagcatagtttctacatatacttttgtgttaagtgcttgctaaatcacaaaattctcagaatgtgattttttaacatattttgagtaacagctagacatgggtaacattagaacacagctgcatgcaacagaaacagaggctcgttgtctttataaactgaaactttaggcaggtaatggatcattattatactaaaattccttttagacaagaagaagttctatacatttaaattttgcttgaaagtacccctaaagaaaatagtgtcggtggaaatagtcagtgaggtaatagtaacaaaagtaacacgtggacacttacaaaatgcttactatgtgccaggcactaatctaagagattcacatgaagtcacctgcttcattttcttaagagcactaagaagtaagcagtattctcatcccaatttcacagataacacaattgaggaatagaaagtttgagtttgccacttgaaaccaggcagtctggcccaagagtctgtataatttaacctctgcactacaactgcatctcagaataggaaaacaaaatctcaaaataatatatttgactttatttgtggcattttggaatagtaactcagtttttattattacctcatagtcaaaataaactttttaataaacagatgcctttcactgtcatactttaagagtttcccagaatgcttcctctagatcaaaactattgatgagtttctgtgactcagagccttctcaatacaggtgatccaccttttcctacaatggcagacttcaaacaaaactctggcaaaatctctgaatcatttttaaccactatctacttatataataactacttaaatgaaaacaatcttacaaagattacaagcacctacaaaatattttcctttattgtagtagttacaatgttgattcaaacaacaaatatattttgtcactagaacatgtacttgggggtatactataaagtatggcactgtacttggggtatgctataaagtgtggcactgccactgggttccaaagacccataaattcaatgggtgtatctgcaggaaaccacagtacaatccacataaagggttcaggtaatgcttttcataggtagaaccaaagtgttctgaacaatcaatggccttacatttcaacacctaaccaaacccatgatgactttaacttccttcaagaaagaattgtatttttcccctagtttaatctacagcttactgtgggtgcttaacaaatgatgttgactgacaaacagaaaatgtttcctctttctccctggccccctttcaatctgttctctacactgtagctagagtgacattttggaaatataaatgtgataatgccatcttcctccctaccatccacactacactctttgcattactattttatcacttttacagtaaagacaaaaatacttgacatggtccagaaggttgtgcactgcctgaccccactcctctcaagtagggagttagagctccatgcttaaggcattctctcagtggcacatgctgtgccatctcctgcatcagaattctgttcctctgggctttacctgattaatacttttcctctgccttaatttggttaattctttctcactttttcagatttcagtttaataatcactttttattacgtcagctgacactattttaagttttcatagtatcatgcacccatccttcaaaatacataccacagttttaagcttcatttttttaaagtcaatatgccttctcactagaatatgaggtctatgaaagtaataattatttctgcactaccattttattgcttaagcctagtactctggtacacaaaacaatcagtacttgctgaataaagaaattaataaacaaatgaatgaatgaacaaatgaatgaatgagtgaatgtggttgcctatctggtcacattcacaaagtaatggaaagcaggagctttcttaagtcacatgtatcatactgacatgttcagtgacattaaacaatcaggaagcataagccatacgtgtttatggccatttaaatagagaacatgcaaaaaaaagtgaaaacagtccaatgtgggattttaatatacatgactctaaaatgcacgagacctggggatctggaaatcatgagaattataacttaatttcttattgattatccttgttattcttgtttttaaactggatagctatgaaattcactaattctttcaagttgctagggatctatgagtgctcttaagtagaaataatgttcaaggtcatttagatgagaccataacaacggtccaggcacttagatgaaatgaatataaaaaagctatgtaccctgtaagcattcatcactcaggaaaggtgacatttttgcttagttgagttctgaggctgacgctcagggtcaaagaacataagtgatgcataaattagttttgttctatcagccatttttacgtttttttttcccttgaatataacacctgaacctgaaaataatctcaacccgaatgaactggaaatcttatttgccagacgtcaagaaaaagggcttgggaacaaataaaagtgtttatgctcttacccaggttctgccactaacctggtcatcacacataacctttcctggattctctaacaatacataaataaataaaacttgctaggctcaaacacaaagccaggatgaaattgagctcattcaataaaaatattctggaaattcataggtgcataagttgtttcaaggcactcttggctggaggttgggggagagataatatttttattatcttattatagtcttactttttagtagttcttattgtattttaaacatgaaggcagttaaatggtgttaaaattttaaaagtattatagtttggaccagagataaactgaatttgtttaatatttacttgtctgtttttttccctaaattttctcttaatgaagtgaacttatttattttaaaattagtttttatgaagaacatggcagacaatgtacatactggctacaggcagagctttgttgatatttcatctgaatagaaatcatctatccctagccattaatacatgatctgtattgggagaatcatccattctcaattaattattcaatagtcacttgacacacatgaaatagggaaaataagcaaaatggagccaatccttctaggaagactgactctgcctttatcactccatctcccaattctgtgatactcaaaagaatccaatcttttgttttccttctacgtttcgtggtgatcttttgcactccattttcagttcaaattttcaaagtgactcaatgcttcagaagaatcctaatggatttgctattctgagttgaattatcctatgtaccaggcactacactgttcaattatgcatcttggtaattccaaattctttatcttatagaaagagctatccatttgcaaaataaaatgcatttcagatacatctaattctgcttctctttaacaaattactttttccactcttaactgttcctgattatgcatgatctctgaatccctacattaaaaatgcatagaaaaataaaaattttcatttaaaacaccctcccacacagtacaagctgtcattgtgtcatatttgtttcctaatttaaggaaggaagctatatttcatgggtccttcattaaattgccttctctgtattttaaagtggcattaggatacttaagacaattttcccataaaataatgttcattttaaaatttgtttctattaatcagtgcaaaagtatgcaacttcaaattacagtatggaaattatcatatctacctagcatattattcatgattcacaagtagatttgctagaagaaaaaaactatcttttttattttgtaaaacataactgtaaagcctgctctcataaccatagaaatgtactgttaaagctgaagtgctgtataggccatggaatacacagttttctataattacctaagccaaaatataatgaaaaacaaaaacccacatgaagacagagcgcaacaaaatagccctttctttcttcccctcctcctaatcctgtgaaggctacagaagtctcctaaagaccagttttttttcttcctaactaactctccttgctgtttaaacaattacaaatcttatcaagtcttcatttctcttaaagtcaagtgagagagaactgccaactctaataagatttacaaaggctagttccccttagcactgtcagcaaaaatcaaagacattatacaataaaacgcagccacacagagcttttgtccctatagctttcgaaatcagatttaataattcaccttttttcacccatttcagccacaaatgccatttatccatgtgttgattgccttgctttgacccataagctatctactttaaatcctgacatctcctacttagccactgattcgtctttttcacaccactcactcactttctgttagaggctttgctgtatttatacaacagtattttccttggtcattgtcatgtaacagcaccggcaaaacacactgaagaccgaattttatttctaaagaggagaaaagagaacttaggtatgacttttgtagtttaatgccacactgttttaagccccaagaaccacagaaattacaacttggcctccactacccagataaatgtcattagccgaatatccttagaaaatctcttgcaatcccttacatgcatccctgtttattagtctgcagaagcttcccaatccagcaacatctaaatttctctactactttatttctctttataaggcatttgttaattaagaaatcttatttaatctctaacatttttaaacgtcagctgacctcacacttcaagaaaccgcataaatgacaaaattttacttaaatttcacaaatgttggacttggatataacagtggaaaccaacattattccaaaaagcctcctgctaatgaagaaacgcttcacatcctctctttccctttttccacaacgaaaagcaggtttttaccgctctatctgcaaaaggcagagcactgcccgtgaaccctgtctttctcgtcctttaccacgagtgaccagaaccacgtggggattctcaaccacggccgtggtatacctctcctgtgcttcatttctcatcaaacacatgcccaatcttctagatgcttgtttgcatcttaagggcaaagtctgtgtgttacagatttagaagtggtagagacaagtacagtggtcatataggtgggccgcggcccaatatagggcccaacctgccaaagaacccgaggaataagaagaggccattgtatttgccacttggaagggagtagtgttggtagaaaggtctccagaaggaactcaaacttggatatgggggctgccaatccttaggaggatgtcaagggagaagctgtggaggtggtaaggtagagagtcccccagaaacaaggtccttccctcgaagcgaactgccacacgtttgccaagattaggaagaccccatgcaccagcccggtcccctcctccccgagccccgcccaggccccggcccccgtgggtcgggcgtcgggccttaccttggctgcagtccttgccgcggaagccggttcgcgagcagtcgcacacggcctggtcgtccaccacggagcacacacctccgttgaggcacaccccgccctcgccctcctcgcccgcctcgcacgggcttcccccgccgctgttgggcggctcatcgtccagcttcacctcgccgctgtccacgggcaggacctgcgaggagttgaccctcacgtcacgaatccaccccttgaagggctcccgctccctcaccgaggccagggtgagcttgagcgccgcggcgcgcagttccgggggcagccccccgacgaaaaggccgctgaacaccgtcatgtccctgcgcttggacttgacctccacccacttggcctccacctggtcgatgaagagcgtggtgttgcggaactggcggcggatgcgcacgctgtgccaggcgccgtcgttaaccggcgtgtcggccaggagcgtcgcaggctcagcgcagaagatggagaagctgagctgcaggcggccgccgcgcgtcagaatcagctccaggaagtcgcagaagccctcgtcgtcgaagtagagcacgaggccgcgggcgctgcgagtcttgagctggaagctcatctcgctctcgcagcaggcgttccacttggggaagcgcgtccattggccctcggcgcccggaaactccagcccgctgcccagctccgcccagcagcccaggagcagcagcgagaggcacagaagaaaacagcccccgcgctggagcagcgccgtccccatgctcggggctggggtgcggcgggggggtgccggggccgacagggtcaaaatggtcctggacaccgtgacgaagaaataagggtcccgagagacagaaaggtaaggggaaaggcgggagtgagagggatgtgccctcctttatctagttctttttttcttcttcttcttccaataaccccgccctctctccctgtagtcctcttccaactggaaaacgttgaccccagtggtacagggtagccacagaacttccagaccaaagggaggatgcactttggagacaacgttctggaaaaggcttcaacaaaagatcaagggaaagcactgacccatttgagtctgattaactaatttaagagtatctgcagtgtcaacagatacttaactcctcaaatcccattatctgccaggttccaccagtggtaccaggccaaaaggaagcagtgagagtcagtaaaaagaaaacacttttctcaagaaagtacaggaagccagcagtgagccagtatccttggatgcttgtgaatgcctcaagtctgtctccttcagatgtggtgtcttacagcagaacggagaaagggatgcttgcctctttagggcaccatttcttaacccgaggatagcttcaaaggcctgcttcttctgtcatagcatgggcttcagcaccgctgcagccaaagcctaattccttgtgcgtggtctcacaagttggattttacttctcttttcagccacggcaacagtaggactcaaacccagcagttgcgaaatagccagaagctgttagatgtggaaatcgcaacagctcctcttcttttctctctgcctctgcagggccaagctaagatgccagcacatcaattggttgtgtgttggtgatgcattttggttttatcttgtcttttttaaggactcagacatctgcagagaattaaagtcaaaattaaggtctaaagtcaatatagtattatataaatcattattcagctcataacacaagtgtagacctggtcctattagtaaggcaaagagttaaccttcttgtatggagcttttgttatcctcactacaagtaagtcctaacattttctaatagttaatatgacacttttacagtcagccatgacacccttgtagtttattataactgttagttggtaacccgaagttttaaagagaaatttgattatggttatctttttcttttcgcaagatagtttaatttttaaaatatgtgaggggagaacaaatgcttttaaggatttctacctatgttgtgtgcttgttctgtggacagtaaaaatacaacctattcaaatctcagttaagagattttacaattggcaaattagattaaactgttggcaggaagctgccagcttagacttgtatagcattcctgccattttatttttcttagaaggaatattgatggtttcttgatagtctcttgcaaaatttcacacaagtatagttctcctttatattaatgaataatctgttgtaaaagaaaaccactaattggagccagatttatgtttttggcattgtctcaattgccctaatattaacttctctaaaggtgcataaagtatttaatattttgcctaaaagtgtagatctaactcctcctgaagtctgtatcttgctgtcagccctcacaatttgtgtggtcagaagagctgttggcatgtatgtcatctcagctgcagtggctccaggatgctagaatttaaaaccgtacctttgaatcactcactatactattaaatcacttctctttattcaactctaatctgacaggttcttgaaatggtacagaaatcataatcactgatttttttcctaagtcattttttaaccaaaaaattactcttaccttttgaaaaaaattacaaatgtataatctgttcatgtcaaggaagtgcattatttttctcactatttcttatattccccacctcttgcaaacacacacactgcaatatatatacaccatacacacatgcacacacacaccccaaatttattgtctggatgtagaagctcactacccaattaacactttttttcccttacaagctgaaactagcagtaatttatggcaccgcattgtgctgctgcttctccatggggggagctgagagcatttctcttcagtacagagcaatccccacaggtgtcagctgagagccaccaagctagggtatcccacttcaagttcctcccagatgaaattgatgactggttctctctctttcaacacacacacacacacacacacacacacacacacacagtgtgggtgtgcgcacatacacactgcccactagcaaaaggaaataaaaatctcagttgcttatttattatggctgatacattccacaccatcagcaatcaccagtcatatcttgtcttctcctatatcaaacccgaggaaagaggctcgtcaaatcatctgaaatagcatattattcagtatactttcatattttaagtggactcaggaatctgctaaattttcagtcatttgcaaaataaatctggaatatcatgatcaagagtagtgctttgaaccctttctcaagctcatgtgttagaaaacctttttttttttcttgtgtgtgtaactctgttggagccaattattgtattaattaatgttacattgatcacataaccttttttctcccgtccctcctgccctcctccactaatgcacaccttgacaattttaagggatggtggaagagagaaaaaccgtagagcaatatatatgtacatatagatatatatacattcttatcacagggaggttaactggttttcccagttcttggaggaagctcattgtatgtgagcgagtatctgtatttatatggagaaaagaggattctctctaggtgccagaaagacctggccagttcacaaattagaggatgaaataaagggatctgaaaaacatccttactgcagccaaaagaagaagcgctctaattcaaaagcagactaacagcatcattaatcttttctttcatttctagaatcaaattcatcccaagtcactaggaggatcaatacagtacgctcatcggctgcagttgcatattttaatgtttctgatatcacacacacatacacacctacacctttccatgcacccttcaatatatatatatatcttcataaagaacatgaaatctctgagagaaattttagaagtgcttattatttcacccctggcttttgcaaagtctctcaataccaatgcacagccaaaattctctctggctttcccgcccagtctctaagctccatctctaataccagtgcagtttcttggagctcggggtctactgcacaaattaacgatgggcacagtgtggggctgatgaggtagggaaggaaatatatggagagatattttattgctttgatatctagcctgtctcttattttctttcttttgctaatacatcactgcattcagcctttaagttactaccccagttccaccatctcttcttgccatctatttaaaaggcttcatgcaaaacaaccaagatctacactcctccaccctcccaccacccatctttccctgtgtatttgtggcagatcctggctcagttacaatggggaaagatatccttcttcagcttgcctcgccccatcccctccccccaacccaaattgagcttctttacctgcccggttattcccctcagctcgagccagagcctgaagcatgcatcggtcaaagcgaatttcctgaggtctatggataaggcgactgctgctgccttttcagaggcgtcaggcttgagcgtctatctccaggagtgcgggaggggagaacaggcaacggaggggagcaggaggaggaggaggaggagaaggaggaggagggggaggagagggaaagagctgggaaggaaaaggcggtggtggagcctgagaaggctgggttacgtgacgccgggtgctgtccttctgaaagagaagggcggagctgagctctccgcagtaccatggagagcggcgggcccgtcctttggctggggaatgggtgggctcggcccgtggtcgcagcccctccaggtctggatgctgcggagcgaggtgcttttacctttgcatcgtccccttgcagggggagcctgatcctgggggcggggaccttccgcaagcgcttctaacttgtcaccaccctctcttccccatcggaaagaaagaaagagagagagagagagagagagagagagagagagagagagagaacgaacgaacacgaaccagagaaccacgtagcctactgagcatgcccaggcccctgctagacccatggaaagctgtatggagattccacttctccggggtttggtagtgattgggcggggatacctgagagggtgccaggaaagggtccagcagtcaaagagaaggggccaaggagtcgataattatgatgagctctggctttacttgtgcaccttggtctcctgctcggaacccttgaaaagaagctgcagcttttcgaggaatgcaggggcaagcaagactcacacaggcactggcattcttctagatccgatgtcccttgccccaccccttactgtggctctgccttgggtaatcacaacaaatcttcatgacttgcctaggctgtgccaaaaagatgtaaaaggaacccaccagggtaagatgccaacttgcagacgacgatcaactgtgtctgacaaggtgctttttactgcagcctgtcgtcattctccagccttctgtgctctgtcttgaaccaagttttctacctgtttaactcttccctccgtctcctcctcccttttgcagctggtaaaacctggtgaaagtaaaactgggtgtgaggctctaaccatgcaactgggcatgcccaataggcattgctgggtttggtgagaaaggggttaaatctaagggagcttacagattaggtggtagaggagttcggggtctgtggctttaaattatggtttgcaccctatggacatttaaattcctattcctgtatattcctagcctgggttagttttggagcagatacagacatttttattgcaacgccacagacctaatagtctgaacctcaaatactgtaaggcaagactatttttggcctccaggccctatagagcaagaatttaagaactagataaatttgggaacatcaaaataatatatattacaattacaatatgtatattcttccaaaaaactagaactcattcctatgataagccgatttatactttcactacttttgtaaaagggtctaaataacctgaaggcgggtatcacaggttttaatatgtttatcgcccttagagaggcagttttgtcaagtggttacatgtttgggaaatagattgtctgagcttcaattcaatctctgccatttattagttgtaacctcagcaagatacttaatcttatgctgcctcagtcacctcatctgtaaaatggatataataatagctccctcttcatgtgtttgatgttgtgaagatgaaatgaataaataaacataacatatttggaattgtggattccaaattgtggaattttggctatatttatcaactacaacccactctgtgttctgtttgactcaatggaaggaatttctctgaaactcgaattctttgactataaaatagaggtattagtcattgtcagcttattccataagattgctttgggaatgtaatgaaataatagctgttaacatgattcttaaaacaaaaatttaattttaaatgatgtaaaactaagactcagaaaattacttatctaaattattcattcagtgaacttgaaacaaaaaaacagtctagttaattcagggcctttttcaatttttcctaccattaggttataggacaaatagtacagaaggtacaccgcgatgtgtttagtatagagctaaagcttattgcaaaagtaagtggaatggacagcccactttcaaaaatcaagtctaacttggttccatgatgctcttaagatctggtgtgaacatgcatcagtgaacattatggtagtgctagaggcactcttaagagtcaaagcactgccttttacctggattcataaaaactcattatttaccaccagtgcatgtgatctgaacaatttcctactttatttcatttcgtctttgtgaatttttattttatctttaattgggctacacagtgtttccactgaatcaaggttttccttgagatgtcttctgtggtgttttgatttaaaaaaaatgttgacattcttatgctgcatgtgtgaattttcagattaaaaagaccagtgttcccacatctcttcaccactgcctccctgacacacacacacaaactatataaactgaaggaatagatgatgtattggagtaatcccctttgcaatcaggtttaaggtacttactgtatgtagtccaaggaagtggacagccccaggatcttttttttttcagtaaatatgcatagagaaaagtatcagtttgtagcttagaatgcaaatatcacaacataatttaatgataaaagttgttaatttattttaaagtatgagtttttctgttgtttctccataaattacttcaactctctaagtggcagttttgtcatcagtaaaataaagataatggcatctccatttatatgacttggtggagataatgtcaacattgaatgttaattttgtgcctactcctcgccaaacagtgctccaagtgctttacttacattaacttattctaacctcacagcaactctaagaggtaggttctaggatttcactcattttaccaatgagaaaaagtgaagcatagagagattagtccagatagtcaaagtctagtaagcaagcaacagtgtgaggaaaaatccaaactcaattctgtaatcttaacccccttgctacactgactttgaacggatcatcagatatacgtagcaaagtgcttggcagaatgcagatgcccgtaattgttcattccttttcctttctaagactttcatcaagaggagtctaggaaactaaacagtcaactccagaattttgccataacattccttaatgactaatactgtatgaaatatatgatattcatgtactttgttacatattataggtgacgtgttttcaatgttactaccttttttgtttgtttctgggcaagatgtgaggtgattcctgtagatctgaatttgaagcaatctaacatttgtaagaacaatctagtatttttctagaaggtgggaagtaggattaattcctcctgaatcaccttagggaatctactaattttaggctacagaaatatgttaaggatttcaactcctgcccctagctaccactcagaacaaatgaggtaactgcgaaatcaaggtgcttgtttatgattatgtctgattgggagaatttgtggcaacccaaatatggaaacataaataatatctcatgccataaactggtaaacattttgcatcaatgaaaatggaaatgcatgctcacctaaagcaagtatatttccataggttattaatattaatgagaattctaacatggagactaatgctacactaaaaataaatgaaactaagtagtaagattttttttgactgagaaacgaatgcagcagagatgctctgtgtttattgctgcaatcagaccctgtgctttaacattaggaaatcaatgtaaacacctactttctcaattaacattaaggtaaagtggaagctttgagatacctatgaattccaatattgatatcagttatgaagggtgctttactgatataaggggtagaagaagaaacacatggtaacaatgaggaaaaataccagttgatatacattaaatgcattttcacttaagatgagaaacaactcaaaaaaaacagtaagatttatcgctgaggggattttctatttactgtcctatagatgatcaaaatgaagccacttttactaaaataatcacagtatcaggaaaatattacgtgctaattcaactaaatttcagattgctatcaaatttctctaaccaattacattatcagtgctgcacaattggaattctattgtttagctcatgactttattttaataatataatccattttttgtttgcagttaaatgtctctagttttctttatatgaaccaattagagttttctggttacaaaagtttaagaatagatattgaacatgctgccatataaaatttattttacaactagatgaatttaaaaatgcaaggaaatgtaatcaagtctagggtttgagactcagctataaaatggaataaacagactaggatttacatgtacaaaaagacacataatttcctattaagcttactaagtaactttcaggagaaataagcaaactcagtatgttaaatactttcttactacttgaaaaaatcttaaacatagtaaaattaggctacttttccttgagtatgtaaattttctgtaatcagaaggtagaatgtgatttaaaatggctgcaaatcattaatgtaatgataattattaaggtatcaagcagcagtagagaaagcacgtagataggtccttgagaacagtagttaagttttgaacgatgcacctgctagaaaggcttcaatgtggaaaccctgcagcgtgtttgatgggcagtgtttttaaatctagggcagcacttacacctgagtgtgttcctctgtgtttacttccacccctccttcccccacaatgaggaaaaatctttctgaggaagaatagctgtcgctagatgaagtctgtgaaaagtccctgccagagggtttatgtttcctcgatcagtgatttagttgcacacttcagcctgtcattattaccccctctaatgacttatttctcttcttgtgaacagaactttcttccccacaacctaactctacactcaagcctgccattctcaactgctaggctccagaaaaggaattatctcattcatcacaatgtggcttccaatttatttttattgggtgcctgcaactagttaatctgtttaatttagccagtgctatttaatattccttactatgacttttaagaaaagagcaagggatttgtgatgagttatggatgtcagtgaaattcaagagtcttattataatatctttgcttctttttagcctatttctgccccctagaaatctgtggaatcaattttctgtgatggcatctcgaaacattttgtggtttgcttttaaaacacatcctatttgattttatgttgggcttatggatttttaaaaatattcaattcttaccagttttccagctactgccctcctcctacttaatatagctttaaacctcatttttttttcagagttttcttctcatttttgtttgcctttctcatccatttgtcctacttacattttttcatttaatactacagacacccacagagatagatatcttaagaatacagaaagttgtagatattttattgtaacttcacaaattagagcaataatacccgcattttatgtaaaaaaaaaaaaatcttaggtttttgaagagactcgtgaagcagaatagggaagagttttattttgataagagtttttctcttgctgaggaaagaagatcagtgaaataggaataaactacatccttaagtatatgcttgatgtacacatcccattgaatgaagttatagtacagtagaggcactttaattttctctagaacaaggagagcagactgcaatgcttaacagtgtctggtgtttgacatacatgagtgaggtaggcaaactgggaaaacaatgaggattggcagacagtgtggacacctaaaatgttcatacttctctaaaaatggcgttcactctgcggccgcaacagcttgtgaccatgtgagtctggtgttgccagatcctacgattttacaagagcagctggaaatctgaaatgttatgtaaaatcttctgattttaaaatcttggcttattaaaaaataatcaccactactaccacaatactgtgcaggacaaaatagacttctctgctggttggaaatggcacacagcctaccagtttgttcccttcacagctttgtatacacgtacacatgcaaactcataatcatgggtggttattctctctagtaaacatttcaaaagattgatttacatgttctaaattcagccaagcacataggatagataaaacagtacagttgctattaaaagttgacctttagaacatgaagataattgttttgagtagtttggtatgttacaagaagcactgaattctgagttatatgtgtttctagctgcagccttattacttgctttgtatggcaacagagacaaatctcttagcttctcctatagtagtacctgcatgatatatgttgggagttgaattgtccccctaaaagatatgttgaagtcttcaccttatctatgaatgtgactatttggaaatagggtctttgcaggtgtaatcaaattaagataaggtcatactggattagggtgtgccctaaatccagtgacaggcatctttaaaaggagagacacatttgaaaacacagaggagatataagaaagagaatcatgaagacaaagacaaattgcagtgatataactatatagccaagaaatgccaggtaatgccagcaaccagcagactactcaaagagaggcatggaacagatttttcctagggaaagaaccaacctggctgacaccttgattttagccttctagcctccagaattccgagagaataaatgttttattgttataaaaaccacccagttatattttaaaccacccaatttgtgatagtttatgataaacctgggaaactagtacaggatgcatgatagaggatggaaaaatatagttatgcataatactattataagagaccatttggcagatgattttacatatatatttctttatccattacaaccttgaaaattagacattctctctctctctctcacacacacacacacacacacacacacacacacacacacacacaggcttgctctcactttcattctctttgtctttcaaccaactatggcttggagatgctacccatcttgccttcaaacttgtagaccgctcctgatagagtgaggaccaaatctttctgaaactaaagtccatattcttgttcactgtaccattctattgtggtacttttcaaatgtagaaaactataaatataagatacagacattattctagagtctactttttgagaaattgaatataagaagagaaatcacaatagagacagcaagaatacgtcaccctaaacagatacatctcgatacattttaggtagaaataaatcttggatagtgcgggacaattctccaggaagcttttaatgcactgagttccccctgcctttttcttctagttctcaagaataatgacagaatttgctgagaatgcaatatcttgaaatagagaggaatgcgtgaaatagcccaggccttggctcctgttccccctaggaaatataacatcttcagttatgaattaactgcctgggacagcccaggctttgctcctctctctccaggaagtaggacgtccttcaaattgttgcccagtgagttccatggccctttagatatataacccagggcggactgccttttaaggtctgtcagctgtggggcaagtgggccactcacagccaaggctccatccattctaggcagttttcttggggcttgggggacctgtttacaatggatcccaggcatctgttgtcccttgcttccgatttgtaaataataaatctccatcatgtaacttgttgtttatgagtgtgctctgtctcatcaaactcagacaagttggtaaccagtgcaaagtgaacctgctttccaaataggatgttaggataagaaaaaaggaatattctagatttctagtgatttaatactggcagtatgtttaaataaacgtatttattataaaataacataatacaagacagaaaacgtaagtcttgatcttgatgaatttcaaaagatgaacatacccttatgactttcaccaagataaaatattagaatattaaactcctattccttctagtcattttctattctctcctccataaatttaattaataacttgatttcaaactaccaaaactaattttgcttgtttttgctatctagataagtggtataattcagtatgttctactctgtgtccgccttcttttgttcaactttatgtttgtgaaatccatccatgttgcatgcagcagtgattttgttcattgtcaatgttgaattcagttttataaatttaccaatatttatctagtcaattgttgataaacatttgtattgttttcagtattggactcttacaaataatgtcttataaacattgtacatgttatttgttgcaaatatgtacacaattccactgggttcatgcctaggaatggaattgctgggtcatgggttaattttagtagttgttgacaaagagatttccaaagttgtcactatttatacactgaaaaacagtgtgtgagaatttctctctttctggccaaaaaaatttatcaatcattttaattttagatattctagttggtttcactgctatctcattaacattttattttttaatttccagatgaccaattatgttaggtacctaattcatgtatttataggccgttaggatatcctcttttaaaaagggtctattcaagtcttttgcccatttttaaataatttgattacttgtcttttaaaatcaattgtagggactctttacattttccgggtatgattgcttgtgcagttatatgtattaaaatatttcccccatctgtaattaacctttgttccttcttcatttttttgataaacagaaaacttaaatgttaatgtaattcaatttgttaatattttcctttgtagttattgtttcatgtgtcctgtttaagaaaatcttcctatcttgatatatattctcctgtgttacattgcaaaaagtttttaattttaatccttctcacttagattaatatttcctcagggagtattttttacccataggaatatccaattaatacagaattatatattgaaaaggctatagtgtattcattattctacagtgtcaactttatcaaaatctatttgatagattttatattttatatcattattcatttatatttttgtctcaatgagcttttataatgaatcataatattttgtagcttttaataattcagcattatgcacgtttattatacttcatatatatatactttattagattaagtaaattcctttctaatcccaatctgctaatattggtgaaatccttcaaatactgtttcaacatttattgaaataatcatataatttgtcttatttctttggttaatgtgatgaattacactggttatttttgaaattttgaccattcttaaattcctggcatatgcatttcttgttcatcatatattactcttttattaattttctttggtaatattgtatataggatttctgccaaaatccagaaagaaagtagcctacaatttgggagcaggtttacactatctttataaaacaagatggaaagtattgtgggtttcttttctattctgtggaagagtttacgtaataacgttattgtttttctcatcacattcttagtagaatattcactagtgagatcacataagctaagattttattttttcctattcatagaagatttctacagatgctccatttcctctggtattaagtaatttttttattctctctttttacctttattaatgttactagggagttattaattttaattatgtttcctaagaatcaatgattgtttacttttttttctttcttttttttttttttttttttgagacggagtctccctctgtcgcccaggctggagtgcagtggcacgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaacactttacattttaaggagcaaatgttttatgtctgccagatcaagtttatttaccatatactttatatattctaaatacttcacattctgtaaaagtttctttacatattttgttataaatacataaccttcatgtattttttctttatatatttgtttaatttgtttaatgaaaaattagatggttatatattcctggtagatgaatgttttaaacattctgttgtattccttttcatctgtagtgatacagcttgccttaaagttaattttatcagatattaatattgctaacccagatatattttggtcagtttccataaggtatatcttttttatgttttgccttaatctttctgtatgttttaatttattatacttcttttataaattgcatttggttgactttttaaattccatatgaaagtctttgtcttttacttggagttctttgtctatttacatttaaagtcattactgatacatttgagtatgtatgtagcatcttactatttatgttcttatcatctcctttcttttattacatttgttacttaatattttctcctgtaggagcatttagtggtttcctaggagtataggatgagtgatcaatttatcagagtcaaacataaattaatacttccaggacaatgcaagaacttttaaatttttaaaattcttttgcccttttctgatttttgtgctattgttgtttttattatatttctacattataatccatagctcactacaatgattacttcataggtcaatatttatttatagttattcatatatatatcttttcctttgctcttcattccttcttttacttacttgctttcattgaacttattttttttttgtatgaaaaattccctttgttatttcatttagtttgtgtacctgtggagtgtattttacaaaacactcattttggcattcattttgaaaagaaaactatactggatagaatattctagtttggacattatttctttaagcatttaaaaaatatcccaatattttctggcttccacttagtatgttgaaatgtcagctctgcagttttatcattgctcctttaagctaatgtgtctttccaaggccttttcccaggtcctcctctcccagccccatggtggtttttaagaccataattttaggcgtttttactgtgagcatttaagtgatggttttctttgtgtttttcctgcttatggtctttctaaatatttaagcttatatttttctttggttttggaaaattcatagccagtatctagttttatattgcttgatcccaactaattatctcctctttttgtttggactacaattgcatgtacgctggataacttcaccacgttctatatgtctcaagtacacatgctttttcttcttcttttctatattttttttttctttttttgcttcagtcttgatattttctattaaccatttatctaacttactaattttctgttctattgattctaacctagtcaatttattcagttatttaaaccagtggttgtattttttccagttataggatttctatttgattacttttaatgattccggtcccattatttgataatatttttcctcatattatctattttttaaacatgttaattataattatttggtattttatatctgataactgcaatgtctgaatgacttattttatttttgcctccttttttaaaactttccttttctcaatcatttggtttcatgtgtcaaatacctggtaatctttgattgaatgccaccttcattttgttttgagttctcgacctttaacctaacttaaatgtcatgagcataacagcattgcagactgtcaggctaatcacaatatactgtagatatctttgcctagcaactcttggttgtctgagttgctctcggagcaaccaaactaaaatattttaagatttttctaagactttaagattatttaagattagaggctggcacagtttttttttttcaagattaatctagttcttgatcagagaattggtctacataagccattctatcttcactagaaatagagattcaaatactatctattatctgtgttattaaagaaagttcgtggcatgtcaggggatggatttggaaatgacttttggaagacattaaggcctgtgaaggccttgctctatattctaccttctgtaactactaaataaagagcacaacctataaagtcctttcattctgacagaagttagaatgttttcctcatggcataggtagctttgtgcagattttcttccaatagcaaattaatctatgtgcaaacagttgtgctttttatttcttttgtaaattttcaatcatttttaaaatgtgcaaatcaggcattgctgcccaatgtgtaaattattaatgtgtacctaggttaaggtacatagaactatttcctctaaactataaactgtgaatacatttgacttcaatataaaaacagttcagttatgacactatcatgtttataagcactgacttttgttttaaaaccatccatcatcaattgagtaagagtgagcatgccttttcctgctttccattgctgtgctccccagagtaatccaggggattctcaccataaaaactgaaattattctgtaaatactatctgcaggatagatggattctagaataatcatgtcccgagttgtggacacgatattgtgaaatgttctagttgctggtgatttcttttaaggcaactggggaaaaactgtttgcttcttgaggaaagtcactatgtgtagcttgtttgcttgtttcctcagaatctcacactgtgcctaccatgtggtaagtatgcactcaatagttgtttaacgaatgtacaaaaagcagaatttctagataatgcttaaaatgtagactaatagttattaaagttttggccaaatgtgagtaaaaataatatgtaaatcagagtccattgtttcttattaaattaccaaaaagacatgaggcaaaagtaagaatctcatatcctcaaataatacaggatttctagaactttgttatttcttttgctgaaatgagctgtatttgttgatataagatgtctacttttagaaattaggatgagtttgtttagtatttctaatgttttatatttcatagaaattcatgatggaaccagtaaaactattgagaactttctgtaatacttttactttttgagaaagcatttgaaataatagaattatgaagcttgaaattacctaaagtagacattctgtgcatttttcctgcactgcgtaggacaataccataaatacttaatatagaagtatcaattttaatttttaatgtttctgaaaaggggagatccattattatataaaattaatgcaatccagggcattataatccttataaagcaaaaaatttttgcttaggtttcaacccaaaaatctttctgctggcattaagatattaatatttttgatagtaagaactattatagtattttatatgttttgaaagtcaaaacaatctgataatagaaaaatcaaacaacacatattttacaggatattaaaagcacccagatcagatttctagacgtaatcgctatcaatgtgatgatgagcatcttcattgctaattatactcacccactcattttttgttatttaaattattaagctaaactatgaggagccttttccttagcaacatggttaattttactcaattgtcagtcattgtaaaacatggttctggcattcagatagtttcaaagtgattatagccatttttatttgtcaacaagcatttcagatgtgtttgtaagtaagtgtaaatctctagaaaaatatctattatgatttatttttgtcactagccattttataagaatatatgta

SEQ ID NO: 2472 - DNA, 23678 bp, Homo sapiens
ggtcaaattcatactgttatgattttaaacatctaatagtgataaaagttgtgtgtctgtattagatttaatgttgacagacatcctatttttaaatcaagtaatgttatttttatttaccaaagattataaatccacataaactttagaagcatttgagcttatttttttatttataaatgctcatttatcactaagtcaattcagtaccatgtagacagaatacaaacccaaagatatacacacgcatacataaaaatataggcagaccaaaataaagaatttatagctctgattttataattttaatcatgaggcaagtaaaactcactagtttaaaaggataattggagcctggcgctttggctcatgtctgtaatcccaacactttgggaggctgaggtgggagaaatgcttgagccttgggaagttgaagctatagtgagccgtgatcgcaccatggcactccaacctcggcaacaaagcaagaccctgtcttgaaaaccaaacaaaaaaatgaaaacacacacacaaacaaaaaaacaaaataaaaggacaattggatacaaactgtgtctttgtaaatggagcaagttaaagactgtctatctcacatggacaaagcccttattgaattttagaaaagacaaggtaggaaatttacatatcatcagcacagagaaagaacataagtttttccaagaaggtgtttgggtttgtcaggtggaacaaagaggaagatttaaaatatatgtcaatgtaatataaaataatagcaatccattacaggattttataagaaagtatacaaatgagagcctataagaaaagtttagaagcctgttttaaataactgattgaatataagaaggttgtagttcaaagaccaattttgttagatagatggtttttcaattcattttttgtttcttaactggattttgatttcaaggcagagcccggtaacaaataggaccaacaaagaatttgtggcttctggggcctaatacttatacatgtaaaagacaggtgtaactggaaggcaaagtactaagatctttaaaaattaaggacctaagcatgcaaagaaacaaaacaaatctgaatttgcccgctgcataatgaccagtactgtaattgctgccaattatctttaaaattgctggtcttgctggtgactcatgagttaataaacacccaaaggtcgagtgtcctcttacagtacaaagtagcccttggtactcctaaaaacccaaaagatcacacagctgactgtaaaacagtgcagagcttcagacctcagtggatgtagtccaggactctcggggctccatgaggaaggctgaggagcccaaaaatgcgttgtgtggtgccttttctgtgttccttaaggggtgtctggattgctaaaggcctatttttgatgtttttatgtaataaccagaagtgtgatgttttctattggtaattttttatccactgaccaccaaatggaggaggtagaagctttaagaaaaatatatcaagggaaccagatggaaggttgaggccatcagaaagaagtggaggcatcagtaaatgaaagaacaaatcatagaagagtcagcttgggagtttttcagaaaggcctatggagttttacactatccctggcaaaaatcatgtccacaagaaagaaagacagaggaaacagtgcatatggttaacaaggattcagaaagaggaagtttcagtccactgtgaagttttcatgggagaaacaggatcctatagagagattagaaagacctaaaaatgtggctgtttttaataaaacagttttttactttaaactgaactgaattggggaaggaaaagtctcagtcaggaatccagacatccaaatgatcttctggtcaaaaggattttacttttgttttaggtcagatttttgcttttcattttattagaagaatttctaaggcttgttgtgacactattatgtgtttttctttcaattcaatcttcccataaatgccaattgtgtaattgcataatatgagagttgtctaattttttttttcaaatatagaagactttccaacttaaagaatatattgtctggttatcgacaattaggatctccgatggtacatttattccaacagagactcaatccaatgaacccctttatggaatgactagatgctaaatctccaagttcagaataaactctttaagcaggaggtttccaaaaagggtgcagaagatgcagttgccattgcccccaaattttcatccacagaaacagactaagacggcaaaaagatatctgctaccacaggtggttaaagatggtgcttacaaatagtgtctctagtctccacccaaaatatggggtgctgctagtcacagacctgtcaatctatgacattgggtaggcacttctggtattagactttctcaacactaaccaggcaaccgaagttgaaataacaaaaggcccttagggatgggacttcttattaagagaaactcccctgagagctttgtacattcagacaaagagagtgctgctgaataacaatttgtgtcttgggtttccagtcttctcagactggccacttggcaggacccaaaaattgggctcccagctagcaaagaccaaaggaggaagattcccacctggtcacaaagccaggctgtcaggatataagatgaaaagagaactttatacaccaaagttctttttatgatgaatgacacaaaaagacagggacagagcaaaatgaagaccaattctgggaggaaaaggatgagacgacatgaatattcatactagatataaaccagagttgtaaagaccagtccatacaaatgtttttctcctattaatctaaatttgaaaaggaaggaaagacaggaagtgatgtttaccactcactcaactggattttgtagacagaaattaaggaggctgactggtaaaggtctcttacctttttgccagcttgtcagtcctaggttttctcaactgtagtttcaagtggatcacgatgattgtggtatactgccaactatgccggatttgcaggggtgaaaaacaaaacaaaacaaaacaccttctacctcaccctctgaagtttgctgaaataaacggataacataatgattaatacaagaaaggacatacatatttatttatgtggacaagcttaggagccgtacaaaacacgagacttcatgaatgactaggtggctgaagcttaaataactccctccttatagggatgagggagataaaaaaaaaacctaggcaattctgaagcgtagtaaatgttttttatgagaaatgaatgggcaaagagcagataacagattttaaatgatattctttggaaatgaaatgggaccatagtacagataatagcttggaccaaggaaggtgaggtacagaactctgctataaacaaaggttgccatattatacaaaaaaagtcttccctccctaaaggggtccaatttttgggtcctgccaagtggccagtctgaaaagactggaaactgaacacacaaattgttattcagtagcactctgtttgtccaaatgtataaagcagaggttttctttttttttcattatactttaagttttagggtacatgtgcataacgtgcaggtttgttacatatatatacatgtgccatgttggtgtgctgcacccattgactcgtcatttaacattaggtatatctcctaatgctatccctcccccctccccccaccccacaacagtctccggtgtgtgatgttccccttcctgtgtccatgtgctctcattgctcagttcccgcctatgagtgagaacacgcagtgtttggttttttgtccttgcgatagtttgctgagaatgatggtttccagcttcatccatgtccctgcaaaggacatgaactcatcattttttatggctgcatagtattccatggtatatatgtgccacattttcttaatccagtctatcattgttagacatttgggttggttccaagtctttgctattgtgaatagtgccgcaataaacatactggtgtgtgtgtctttacagcagcatgatttataatcctttgggtatatacccagtaatgggatggctgggtcaaatggtatttctagttctagttccctgaggaatcgccacactgatttccacagtggttgaagtagtttacagtcccaccaacagtgtaaaagtgttcctatttctccacatcctctctagcacctgttgtttcctgactttttaatgatggccattttaactggtgtgagatggtatctcattgtggttttgatttgcatttctctgatggccagtgatgatgagcattttttcatgtgtcttttggctgcataaatgtcttttgagaagtgtctgttcatatccttcgcccacttgttgatggggttgtttgttttttccttgtaaatttgtttgagttctttgtagattctagatattagccctttgtcagatgagtagattgcaaaaattttctcccatttttgtaggttgcctgttcactctgatggtactttcttttgctgcgcagaagctctttagtttaattagatcccatttgtcaattttggcttttgttgccattgcttttggtgttttagacatgaagtccttgcccatacctatgtccagaatggtattccctaggttttcttctagggtttttatggttttaggtctaacatttaagtctttaatccatcttgaattaatttttgtataaggtgtaaggaagggatccagtttcagctttgtacatgtggctagccagttttcccatcaccgtttattaaatagggaatcatttccccatttcctgtttttgtcaggcttgtcaaagatcagatagttgtagatatgcggcattatttctgagggttctgttctgttccattggtctatatctctgttttggtaccagtaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaattctgtgaagaaagtcattggtgggaatggccctgaatctacaaattaccttgggcagtgtggccattttcatgatattgattcttcctacccatgagcatgaagtgttcttccatttgtttgtatcctcttttatttcattcagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgcacattgattttgtatcctgagactttgctgaagttgcttatcagcttaaggagattttgggctgagacgatggcattttctagataaacaatcatgtcatctgcaaagagggacaatttgatttcctcttttcctaatcgaataccctttatttctttctcctgcctgattgccctggccagaacttccaacactatgttgaataggagtggtgagagagggcatccctgtcttataaggagttcttctataagggccttttgttattttaacctcagttgcctggttagtgttgagaaagtctaatgccaggagctggcctcaaaaaatagataaaaagtctgaatgtgtgtggtgataatttttagtcttttctcctctctggtggttcatctctgctgattagtgagattcctagggagagggttttaatacaattgcaattttctttagaaaaaatttcctcagtcagataagggaacttcagagagagcccttctctgccattggaggttgcggaaaaaacaagaaaaagttaaaaagtccttagttctgaggcagcttctgagaccttcctgttccctttatttcaaagtgctccaaataccaaagtgccatactttgggatatttttcactgaggtccaacaaaaccaaaggttatggttgctcatttgaaaataaacattcaggtatggtgaatagtgaggtgaaatgtcatgaataatgtcaaaagaagagcagatggtcttatggattatattcacagaagagctgtaacataatctatctgagacttggggtagtcatggaggaaaaaagttagatgggcttagagagaaaaggaagaggactattcttgctgagtgccttatgttttctcagtttcattcaatcacactgtaactttgagaggtaaattttatacccacctttacataaagaaagttcttggacttttaaaaactttgacaagcattgcttagctagaaagttctagaaccctctctctcccattccaacctgaacagtaaaaacacattctttaactttattcaataacgagtcaaggtaggtctcttgtcagggagacaaatgaaaggctcatattttatatgtctccagtgcacttggcataatcaagagtgtagtataattaaaattgtagacaaaggaatgaagaggattaatgtgttacaagtttgttgactaggctggagaaaagaaaaagagacagctgactagtgtggagtgtaatatcacagaataatgatatggtaaactgggccttgtaagggcaaagggaattgtttccttcccctctgaagttttgagtttgcaggaggaaatagacaatagattaactggagaaaaggaatacaaatttttaacatacaaatatgtgtaattgcctgatgggtttttcgtgctcactgtacagacaaaaccaattcactgagaccatgacattgtattaaagagtttaattgatgtgcgggcaacccacatggggaaactggagtcatctctcaaatctgtttccccaaaggcttggaaggttaggtttttgtagacattttggtgggcaggggtgagggaatgggtgatgccgattggttggagatgaaatcacaggggtgtggaaagtggttttcttcccctgagtctgcctctgtgtggggccatagaatcagttgagttatgagtcacaagtcttgctggcgtcagtctgaaaaacatcttaaaaaaaaaacttagaatttgcaatagagatgttatctacaggaacattgggaaggtcacaaatcttatgacctctgtccacattactcctgagcagtaaaggattataggaagtatgtccacaatttcagcagagttctgtcctctctcatattcataatcttgtagcctttcattatttttacaaagggagattagtctggggaagggctattatcagccttgttttaaggttaaactgtcaattaaattcctcccaaatttagcttggcctatgccaggaatgactaaggacagcttagaagtcagaagcaagatggagtcaactctatcagatttctcttactgttataattttgtgaagatggtttcatgtgcactggaaacatacaaaggataagactcaaaagaaagtgtcagatagctgagactcaaatattctctttatgggttggggagcggggtaggaaaatgggatatgtaggcagttttgaggagtaatcagtgattttcagggaaattgaatgtgcccaaataatataccatactctgaaacaaagcacctctgagctctggagttgtggcaacaagttgtgggaaggtaaagggtagaacttcactgtgaataaagattgtactattattcaaacaaagtcccagtaatctcttggaaataccctaagaagaacagataaagtccaggctcacaggtataatcccaagctgtttgggagcctgagatgggacgaccccttgagaccaagagttcaagatcatccagggcaacatagtgataatctgtctctaccaaaaacaaacaaacaactatatatatacacatacatatatatatgtatacatgtatatatatatatatatatgcgtgtgcgtgtgtatatatgtacacacacactatatgtatatacacatatatatatacatatatatatatagacacacacacatatatatatatatattaggtgggaagggtggtgtgcacctgtagtcccacctactcaggaggctaagatgggaagactgcttcagtccattgcagttccaggctgcagtgagctatgactgtgccactgcactccagtttaggtgacacggtgagaccctgtctcacacacacacaaaaagaatccataaaaagtctgtctggtgtgtctcacacacacacaaaaagaatccataaaaagtctgtctggttatttaaataaaacttctatggaggagttttaagacacttgcatttcttccaaaagaagtttgcccagtcagacaggggagcttacagagacaacccctccctgagttgggtggagtactcagaaacaagacatggttagaaagtcattggttctgaagctgctactaagtctctttcattttctttagttcaaagcaataggcaagccaaagtaccatactttggggtatgattttctgagccccaacatttgcctctctgaaatttccttagaagttttacacattaagagctgagttggtggctatggagagaaaaatgttagtaatggaatggcaaagaatctcattaaacaagccttccatttctgggactaggttggtccaattaaacaattgtgtcttatttcaggaagtggtgtttacagagctcccatcacagttaaggtgaacgagtctttaatatgtggcatttctaaatcagaagaaaaacaaaggttgaagtctgcggcaatctatacactagtttctctggattctggagggcagtcagttgagataatttctagatttgagtatgaagcatcttcagttggagcagaagcagtcagtagagatctgacagatttttctggattgtagtttgcgtgttatgagagaatgtctataaataagctgttgtggtgatttccctgaaggttatatcaagctgaccagttttgtcttgtagggcttcagaaaactgataattttaattttagttatctcaagtcagaaaattgggagaaaattggaaatgctgtaatagtttggagactcataaccaggtaccggaggagaccacaaggaatgaatatccagtccaaattacaagcaaaggataaaatctcaaacacgataagcagggttagaaccgaaaaatgggtatattatagttttcttctgaaacatgtgttttctctcttcagtcactctaatttttaccaaagataatcacaggaagtccaatttgtttgcaaaaatgagtttaaccatctaggttcttcttaagactgtgttgctgaaactttgtatgaagaatctcaaattaggcttttaaaaggcctcttacaggtgtgcagccaagccagagacacaacctcaaattctgcccataatacctgtagatttgggttaatcctgctcttctcagtaaagttctcaaactatctccaagttcttgggtttgtcagagagtgacattctttacttaccagcatggcagccccgtgaaccgtgtattcatagtactagaccagtttccagggggctttttattggcttcataaagtcaaattcatttccttaaaatggtcagattatatctgaaagttagactattcagccaaagctttggtaatataacagtgtttccaattgtgccttattagaagaagaataaattcgtattgaacttaggtaactacattgccataaaatgagaatactcaggaataattcacaaattttggagggatcaatcagggagaaaaaaggtaaatgtttcaattctgttcacaaaagtacacattatgaaattgaagcaagctatagaaagtttaaaagaaaaacaaagtcttgctaaatacggaagacaaaatataaaaagaatcagcaatgtttcaaacagaaagttgtaaaaaatcatggtttttcatgagttcagtcccaaataattaattcttgttctgcttaatgttgggttggcaattgtatcagtttagtattctttttcatttgagtcttggaaattatcaaagttttcagaaacctgtacttgtcaaagttctttttatttttcctatatacttccttgaagaaacaacaccttaggattataattgcctacaaaaagctttcagaaaaggcatcaacataaagcagttagttgtggacaacgagacaagacttaaaatggcaatggttaaagatctgagagagttcattataataaaaaagcaattgaaaagaaaatttgattatttctgcagtgtttatacaataattaaatgtaataaccgaaggttataaatgatagcattatcttaagacatatcagagatctagacattgcatacaatctttggacacatattaataacatacccatatgaatgtaacttaaagaaagttaaatattatttcttatttgacaatgttttcatataatttaacatattggataagcctcattggtttaatatctttttagggggaattttagagactttccttaattgtccaaaagttagtttgggggtcgaagtacttttattttgattcttagggggtttgtcaaatatcaaaggtttaaaacatttgatcaaaataaaatcacaggtcaccataatatgatattcatgtagccagagtgacaataaaaagatttcaaaagcaaaaacaggaagttacatagttgtagagaaacttttactctttggtaaagaggagactcagttttcctaagtaatcaaaagacctaacatgacagtataagatacaaagaacgtgtttctctctctcctctctcttttgagagtttttctcagtccattttgtgttgctatatcacaaaatatctaaggctagataatttataaagaatagaggcttatttaactcgcacttctgcaggctgggaagtttagccctggcttctggtgaaagctttcctgctgcatcgtaacatggtagagaatgtaaaagggaaagcagatatgtgcgaagaggccaaacctgtgagcagtctggctttatactaaccggttcttgttgaaactaatctatccccatgagaactcattcagttgtaccagaacaagaacccataaattattgacagaatggctccaagccaccacaagggcagagccctcatggtccaagcaccacccattagtccccacctcccaatgcaaacacattgaagatcgaatttcaaaaagagttttgattaagagaaataaaccatatgcagaccatagcaatttcacccctgccccccaaaactcatgtccttctcaaacaaaaaatgcaatcatatcatcccaatatttccaaaagttttaacttggtccagcaccaactcaaaagtccaaagtctaaagtctcacctgagactgaaggcaagtttcttccagttgtgagcctgtaaaatttaaaaaaaaaaagttatttatttccaagatacactgctggaacagacatttggtagacatcctccttccaaaaaagagaaataggccaaaagagaggaatgataggccccatgtaagtccaaaacctaggtcaggtgcagtggctcacccttgtaatcccaacactgtgggaggccgaggcaggaggatcagttcaggacaggaatttaagaccagcctgggcaacataattaacattatttaaaagttagctggatgtgatgatgtgcacttgtagttccagctcctcaggaggctaaggcaggaggatctcttgggcccagaagttggaggttacagtgagccatgatagcaccacttcactgcagcacgggtgacagagtgagaccctgcctcaaaacaaacaaacaaacaaaaatgtctaaaatccagcagagcagatgtaaatggtaaaacacaagaataatcttctttgatttcatgtctcacatgctgggcaaactggcatgactgttgggctcccaagcccttggaaacccctgaatccatggcttctctggatgcaacctacatggctaccagtctctgtacttggaagtggggagaagcaggaaaatgttacaaagttatcagttcggtgactgcttgtaagaccttttaattttctttgcttaagtgctcagcatgagaaagtgccaggtttagggtattagtttctgagctccagtggcatgaactagcttaatacacgtgggagaagaaagtagacaatgattgtgaaaaacatttcagtgttacagagtcctttgtatggaaagcaatccagtccttagactttaagccatagaacattttgtagaacgttccatggagtagtgttggaatgcacttttcttctaaggtattctaactatatcagaatattcatttttcatcacctctgtgatgggctaggcagtgcttcctagagcttctgaggcctagtttcctctcactcatattttcctctattactgtgacccaaataaaaactcagtggaaacaaatccaacatcacagcaagctcattatcagttgtgtggaggtggagacctgctgtcattagtatgggggaggaattacacagcaacttggagaagcagtttagaattaaatagaaatggaaagaagtgcttatgaaaatctcagctttcataaataaaataatgttgtgggtgggttaaagaggtagatataactctttcatatgtctgtctttatattttcatagtatccattatttttcaaaaaagttttaatcttggctgccaaatttgctcatcacaactaattggaatagagaagaagagaaaataaggacagagttgaagtgacattgccacaatgctgctaaatctctcatgatctcattttcttcccatattcagcaaaattatccgttcctctattattcccacccttctttccctccctcttgcttacatttacccaaagcaccaatcagcttgaactagttactaaaactgagaaataacaaaaagaaaaattccaagttgtttgaacttgcagttttctgaaaattacttaccataagacaagttacaaacatgtgaatctaatgctgttttttaatcaacagttggcaagaccagtgaggtgagattctaaaatgtgctgcagatattttgctatcataataaagtgttgaagtttgtgaatggtttactttaaaaaaataaactaaggtgtacttaagatgatcccagtggtattcctaaaataccacactcacttgcttacttaaattccaagacgttttctgggcagcagaaaaaaagcatgatttgagagtgagcaaaagggtaactgcataacactgcagcactggagaggtaactgtcagtgatgaaataagactagtattcgttcaaggtcattagcaacattgagttgtgactgttatggcttactctggtttattttttattttaactatagatagagatttagtctgaagaaaagcaagatagataaagtaaaatagtgcaccttttttcaaatgagtaagaacacaatgaacataccagttagcaacagcccagcacttagaacttctaaatgaaatgcaagagggtgatgcagatgacaattttaatagtgctatctaattcataacgtgttagaatatataaattctattgattgcaatttaaaaaatcaactaccaatgcttctttttcaatggcacctgcttgctctcctaattaacattaggtaaaatggagagctaggggaaaagaccaagacctgtttttagtagctaaaaatatgtttattaaagaacaaattttgaagttgtttgattaccgattttactactcagatgcttatagataactttgcatacagtattattaaaatccagtactgaccaggcatggtggctcacacctgtaatcccagcactttgtgaggctgaggtgggaggatcacctgaggtcaagagttcgagaccatcctggccaacatggtgaaacctcgtctctattaaaaatacaaaaaaaaaaaaaaaaaatagctgggcatggtcatggtggtgcgtgcctgtagtcccagctactcaggatgctctggtaggagaacccttgaaccccagagggagaggttgcagtgagccaagatcatgccactgcactccagcctgggtgacagagggagactccatctcaaaaaataaataattaattaaatccagtactgtaagataataaatttgtgttttctgagccactatgtttatggtaatttagtacagtggcaataggaaactaatagagacaccaaagcttgaatggtttattaactgcctggtcctgaggcagccccctctcatgacggggcatctggagaaagactagctaaggcgttctccagtagtgtttactatttatcttctttcctacctcttcttcactgcagagcgtgacagagtctgggagactgagggggcgggggcacaagccctctttgttgagtggctaacagctcagtgcagacaacaaatttaccaggaaacctctttcccctcctccaccagggcagaaggacacgtctgagagcactaggcgggcagattgagcagaagaaagctgggaaactgctccacatggggtgattcccctgaggttttatttccaaaattaaatttgtgttgctttccagggtgcgctcctatgatcctatgatccctgtctattgacacacgttttgtgcttatggttgcctacctgactgatatttctatttaatatgacactttagcagctaattcacaacaagcattgcagacatagctctttgtggccgtcaacttagatgattaaaaaggtgaatatgtaagtgtgtatgtgtttacatatacacccacacaaatgtagacatatacacatgtagtgtgtctccttgacaattttttttttttttgagacggagtcttgctctgtcacccaggctggagtgcagtggcacgaactccgctcatttcaagctccgcctcccaggttcacgccattcttctgcctcagcctcccgagtagctgggactactacaggcacctgccaccacgcccggctaatttttttggtattttttagtggagacggggtttcactgtgttagccaggatggtctcgatctcctgacctagtgagccgcccgcgtcggcctccctgataatttttacccacaatagtactcatactatctccacaatttttcagtgtacaagtcttatctttattttgttaaaacgcattttaattttttaaattacctctgataatgttataaattattttcttaattttttcaggttggtcattgctaatacatataagaaaacagaattttcaaatagatttttacttattccttttaatttagattaattttatttcatttcttgcttaattgctctggcttaaacctccagtataatgttgaataaaagtgacaaccgagggcatcctcgttttgtttctaaacttagggaaaaaactttctgtctctcactattaagtatgttgttagttatgggcattttgtagatgctgtttatcaatttgaggaagttgagaaacttttaaagaaatgttctaataataaaccttagtttgctaattactaaaactgtataattattatattaaatttagaaaatgcagacatgtagaaagaagagtatttttaaccaaccctaaatagactaccaaaataaaaccatcagtaacatccaatttggcacataaccgaaggaagatatccgagttcatggtttatctactatttttcattttggacataatattgtatttaacatatttgtatttgtaatttttccaatattatattttatgtctccccaaatttctagaaatagtgttatagaatcacaggatataaacattgtgtgtacatgagtgcatatgtgtgtgtgcatgtgtgtgtcaagctgtttcttatctattatctatgtataattctctctatatgtctatgtatataaatacatatataacattaatatttattttcaagaattcttgttaaattgatgcccttcccagaggtgtgtgttcttgccaatttttggcatctttaaaaaatgtttgtgaacttaactagtagagattgtgtagaagtgttgctttgattggacatgtctggcttaaaatatagtcatgtcactcacaacggaaatacattctgagaaatgtgtcattaggcaatttcattgttgcgtgaacatcatagagtgtactttcacaaaacctggatagcacagcctactacacgcctaggctgtacgatgtagcctgttgttcctagactatacacctgtacagcctggtacagtgctaaatactatagacaattgcaacataatggtgtttgcatatctaaacctaggaaaggtagaataaaaaatgttgtattataattttatgagaccaccatcacatatgccatctgtcttggaccaaaacgtcattatgtagtgcatgactgtattagtttgagcttcttattttcccgtttgtgtaagttatttaattttcttcctttgtgaactgatgttcacatccctcatgtttgttagttttccagtgctttcttttacattgcttgagtcccgtatatagtaaaagcactaactctttgtctaacacacctataagaagactgattctttcaacataatagaaactatacttccaattcagtggcatttccttcaacatagtcacagtgggaaattacacttacttcaatgatggtcccacttattaaaacactgtaagatatttttactctgaaatagtctttagagctctcatgcaaaccataggatcagctcagcccttttttaaatcattgggagcctaatgcagtgtagccatcttgctcattcatctattccctagacttggttttgaaatgacttctggctatttcttttttttttttttttttttttttttttgagacagagtctaactatgtcgcccaggctggagtgcaacggcgcgatcttggctcacttcaacctctgcctcctgggttcaagcgattctcctgcctcagccttccaagtagctaggattacaggcacccacaaccatgcccagctaatttttgtatttttagtagaggcagttttcaccattttgaccaggatggtcttgatctcttaacctcgtgatccgcccgcctttgcctcccaaagtactgggattacaggcgtgagccaccattcccggccgacttctggctatttctaaactcaaattcttcttgaaagatgaaaatttgctgccagtaatagtatgaaaaatatgagacctttgttccaaagtaaatttgttagaaagagagactcttctaagcaagcttagtgttattaggaaaattggatctccttccagctatgactgcttggaatgctaaaatattcattatattttctgatgcatttaaatacatatgtatataaatttaaagtaatttgtgtaaatgcagatggtttgtggcttgttttttttttttaatccttcattttccatggtcagttcttacgccttcacattcgtactattaattctttacacttcttcaataaatttactcaaatataaataacttcagaaaaatttaaaatctacccccgcaaaagcttcaatatctgaagtttatgtggagaatgacttgaggatttttttttaagaatagaaggtataaaatatttttattaggttattttatctataatttctaaatcaaattaacagaaatttattggagatatagtatatgtaaggttatatattttgctaaccaaaaataaatgattaagactaaaattcttggacccagaatgtacatatcatgaagtctttgtgcatcctgagatagtaactcagttaccttatggccctctctttaaagccttttttttcggcatgttgcctcatatttaaaaaatacaggcaagccaagcttttgtgtgtttcctcaaagaggctcctgccctgcacatcattagaaatgtttccctttaaactttctatttttccaaagaacttcgatttacactggcttacactcttctgtatcattctctgatatcaccttatctgtacacgacagatagtgtctttgatagttacatttctctagagaagagaacaagttttgaacatcaaaccaagaaactcattcttttggggaactgggagatgggtttgcagaaatgttgtagaaaagaggcttccagaaaccaaagatattctttgcattctttaacactttgcagacccctgagagtgacctgatttcagggttgatttccttcagggcagccactttctttcatgccaatgccagagttaaagtacggagagaaggccagtcttagagcagtgcttctcattctgtgactatacatcctggctccactggctgtctatcatttgttcagttcaccttctctggcaggaagaccagccagcctggcagtgttcttgttggcataatagaactgtcatgggttcatctgtagccatggacaaggagagctaatggaagctggaaagagtggattccagttggcatattgaagaagcttaactgaatagttttcaaaacaagaagttgtggaataagagttacagggagatagtagcacaaaaggaacgaggaagcagaaagactacaaagagaagcagaagggcaatcatggagaataagaaagaaatgtttccctacatctattgagtgacctggccaagtttagttaaaagacctggggcattgtataacaattggtagtgtcgaagaatattttacttgggaataaaaggagatcagccgccactcattcacacattaatcaaatgtctaccatattacttataacttaatttctgtaattacattactgaagcaaaaatgctgaatacacaacactaagagctggtagttacatggaggagtaaaaaggtaaacaatttaacatattaacataaattatggagctggaagaaacacagaggaaggacttgaacttaattggcagtaggggaaggattccaagaataggtgacagctgagctataatagtggcgtgaagctatttctttagagaaaatttctggggaacacgaatgaccagtgcacttttgcttttgggtacacaaacaggacaggcacacaagataattatctgctacaatgaccttgcctcatttcatcaaatccatctaaaataaacattatttggaagattcgtttttctatgacacattaagttgtatactggtcatcatgttgaccaagtaattttgaagggaataagaagaaaattaatatgaagtgtttattacatgtccagttccaccttacctgtcggaagtctcaatcacactaccgttttataggtgaatattacaaccatttcacacacatagaacagagcctcaagtgagttaagtagtttatggagggcacataaagaaggtgagtgttgggccatcctgtgaaagacaaaacagtgcctggacgcagagaaataccaagtctagatgaagagttttcagagtcctcggtgtctgaacatctgccactttctagctgtgcaattttctggaagttacatgacatttctcagcttctgaagtctgctttggaaagaaaaaacatcatccaaaagtactgtaaatacaaaggaccagagaatgttttgcctcattttttttagcatctgtagtaaaacctgtggtttaataagcacaattctgaatagaagtttagcttccagggcctgaacacaggcaaaactgttctgctcatgagacaggtaaaaataatttggtgttgcttcagactgtgcctagaaacagcaagataactggaagctgaaaatccatgaattgaccccttcttacaatcccatgcatctgtggtaaagttactgaactcataaaatgcttggataaagatgttttgttttcacaatgaagtagtgatgctttgggcctctgtcaaggtgaagcagaactagagaaagatgcacaggctcagatctcaaagagaaaacaattagttctggacccttgacagggccacagaactgggtgagccacattgagcgaggtctccagggaaaggagagccccagctgacatcttgtggaatgacacaaagatcacagtagacaaaggaagcacattttcaatgtaagcgaattcttctatgaatcaatacaatgagcttgaacgagaactccttgctctcagggacttctgaaaatccagcttcagtctttgatccccttgtttcaaatttctcactaaaacaacaaaaacagaccaaaaaaaaaaaaaaaaaaaaaaagatgaaggccattacagcaccataagaagagagtgtgacatttaatctaatggcccaaaactggagattttttttctttgtttttttttcttcagattattaggctggaggagctaaagcatgaagtgaaattctagaatcacacatgctctgcaaacagcaaggttgtctgcctggaagtagcatgctcttgggtcagacaggcaatgcatattttacacagaaaactataagcctgtcccatttcaggtctgctctcaggcaggcggagtgagaatttgtattatcctctctccgtgcatctccatgatacagtgcctcaaattcttatacgaattttctcacttctagagcactatagaacagaagcagtgatatctgtacaagctttaaacaagagaaagaatccagaagtggaacattccatcaggaattaacagtctacaacagttaaaagtgtagacagtactggagacaagaaggtgcataacaaggtttctgggtattgtagtttttcatgggctccattttaattgtgtcacagagagagtcagtgaggacaggtcagatcacatttcagttgaagggagttcatgcatttgataaatgtgctgtagcctggacatttgtccaagagttataagtgacagtatgccacctgtcaggcagatgaaaattatctacttcctgagcaaaaataatgaaccataaaaacttaacaggattccagaagacttgactatgatgaaaccagatacaagtatataaaaagaaaataaagagaaagagacgctatgttgttgagaattaaagaacaaaaacaaaaaacatggattaaattccaaatgaatgaaaagacattaaaatgaccaggtaaaaattattgtctgctttgtttgaggcagtaaaagacacaaataacactgcggatgtttttaaaaaggtgaattaaaacaaacaaaaaaaatctttgagaatctagttcagagcacaagagaactagagagacagtgatttgggatctttagtaatgtctactgacaaatctccaaaaacaacgaaaaacacactttgccaaaggaaaattaaatgtattggacctgccataataaagagaaccttactttgtcagtcctggtagtgtctagaaggcaggggcagatatttttagtagttagggcccaaagtgtattattttaaagctaatcttgccagatgggaaattggctgggactggacagagtttttgacctaagatctttggattgatggccacagaaaatcaggaatcttgacgtgagtctctatgagtaagctgccagtcttgagcaaaagctatttgagccagttctcagttttatcttatgaaacacgtatttcctggggcaaggtctaagccactcttgcttattctgagtattgtttaacacagggacaaaacatgatcttagtttcagctctcaataggtaatctagttttcatttctgactagatttttttatttttctaatttaaaaatatgaccagattttttatatgtagagttttcgtcaataattttgcaagtatatagcccggtttttgataagcataatcagatcaatcttcagtttaggaggtcactcccattgagtctcagagatgactcttgaaccatgagcttggtcttctgtagaaatagctattcttaaatcaggtccatggtctccatgtcccatatcaataatatttttccttttcatttaaaaaaattttctaatactctatttataatataatatatttaatatttctaattacatatgctttgtataagaaatgaatgatactttcaaaaattaaatatagatatttaagtagatgtctacaaaaaataattaggggataaatgttccacagtgtttattaagtatatttttctgcaaaatggaccaagtaggtggattttaaaagtctgcttttttcatttttcacatttctttaaggaacagaaataatgtttgccattggtagaaatctcattttaattttacagaaatacaataaaactagcttttagatcctcttttcttaccctaaactttcacaagggtttgatcagtgtgtgagggatggtgttgtggaatggagcagagctggtcaatgtgttagcaaacagcctcccaagcagcaggcaccctaccctcccactgaaccaacttttccatgtcagccctgtatgctgcatgatttgtctttggtagaaatcctgggaaaatcaagtgactttcctttacttcattttgcaggtgagcccagaggttcaactttcatcacctttttgggaagtaagattctcctacttctactttcaggagtgagctcaaagtcccagcaggcaaaaagcctgcaacattgtgtgggttttacagccaggatccattattatttttttctgagttaagggatctaaacatagaaaggaaagttggacatttgtaatttgcatttactgaaaatgataaaaagtcatggatattgaagaggaaggaggccatttctatggttagaaagactgaccctgtgagctctgcttagcctttggaatatctagtgtctaaaagaatagaggcaatgctaagatgttgtaacacgtctgcaaatgaaatggaaatgattctacttttctcatatattttataaatctgtgagtgttaagagtaggtaagaaaaacaatgcttacagataaaatatagttaaaaacattttcctctttctaagccttggtagtcatatagtttgaccaaatgacagaataaagattgtcccatgatttgaaaactgtcttcagtacaaatcttataaaaatatgataaaattataacaaatattttagaaggtataaaaataaaagataatatcctgcttctactaaaatatggacatactcaattatcttaacactttactttagaaatatgctttgacagatgtggatccatagaacctcaacatcttttttttttttttttatactttaggttttagggtacatgtgcacattgtgcaggttagttacatatgtatacatgtgccatgctggtgcgctgcacccactaaatcgtcatctagcattaggtatatctcccaatgctat

SEQ ID NO: 2473 - DNA, 17780 bp, Homo sapiens
cctcagtcagataagggaacttcagagagagcccttctctgccattggaggttgcggaaaaaacaagaaaaagttaaaaagtccttagttctgaggcagcttctgagaccttcctgttccctttatttcaaagtgctccaaataccaaagtgccatactttgggatatttttcactgaggtccaacaaaaccaaaggttatggttgctcatttgaaaataaacattcaggtatggtgaatagtgaggtgaaatgtcatgaataatgtcaaaagaagagcagatggtcttatggattatattcacagaagagctgtaacataatctatctgagacttggggtagtcatggaggaaaaaagttagatgggcttagagagaaaaggaagaggactattcttgctgagtgccttatgttttctcagtttcattcaatcacactgtaactttgagaggtaaattttatacccacctttacataaagaaagttcttggacttttaaaaactttgacaagcattgcttagctagaaagttctagaaccctctctctcccattccaacctgaacagtaaaaacacattctttaactttattcaataacgagtcaaggtaggtctcttgtcagggagacaaatgaaaggctcatattttatatgtctccagtgcacttggcataatcaagagtgtagtataattaaaattgtagacaaaggaatgaagaggattaatgtgttacaagtttgttgactaggctggagaaaagaaaaagagacagctgactagtgtggagtgtaatatcacagaataatgatatggtaaactgggccttgtaagggcaaagggaattgtttccttcccctctgaagttttgagtttgcaggaggaaatagacaatagattaactggagaaaaggaatacaaatttttaacatacaaatatgtgtaattgcctgatgggtttttcgtgctcactgtacagacaaaaccaattcactgagaccatgacattgtattaaagagtttaattgatgtgcgggcaacccacatggggaaactggagtcatctctcaaatctgtttccccaaaggcttggaaggttaggtttttgtagacattttggtgggcaggggtgagggaatgggtgatgccgattggttggagatgaaatcacaggggtgtggaaagtggttttcttcccctgagtctgcctctgtgtggggccatagaatcagttgagttatgagtcacaagtcttgctggcgtcagtctgaaaaacatcttaaaaaaaaaacttagaatttgcaatagagatgttatctacaggaacattgggaaggtcacaaatcttatgacctctgtccacattactcctgagcagtaaaggattataggaagtatgtccacaatttcagcagagttctgtcctctctcatattcataatcttgtagcctttcattatttttacaaagggagattagtctggggaagggctattatcagccttgttttaaggttaaactgtcaattaaattcctcccaaatttagcttggcctatgccaggaatgactaaggacagcttagaagtcagaagcaagatggagtcaactctatcagatttctcttactgttataattttgtgaagatggtttcatgtgcactggaaacatacaaaggataagactcaaaagaaagtgtcagatagctgagactcaaatattctctttatgggttggggagcggggtaggaaaatgggatatgtaggcagttttgaggagtaatcagtgattttcagggaaattgaatgtgcccaaataatataccatactctgaaacaaagcacctctgagctctggagttgtggcaacaagttgtgggaaggtaaagggtagaacttcactgtgaataaagattgtactattattcaaacaaagtcccagtaatctcttggaaataccctaagaagaacagataaagtccaggctcacaggtataatcccaagctgtttgggagcctgagatgggacgaccccttgagaccaagagttcaagatcatccagggcaacatagtgataatctgtctctaccaaaaacaaacaaacaactatatatatacacatacatatatatatgtatacatgtatatatatatatatatatgcgtgtgcgtgtgtatatatgtacacacacactatatgtatatacacatatatatatacatatatatatatagacacacacacatatatatatatatattaggtgggaagggtggtgtgcacctgtagtcccacctactcaggaggctaagatgggaagactgcttcagtccattgcagttccaggctgcagtgagctatgactgtgccactgcactccagtttaggtgacacggtgagaccctgtctcacacacacacaaaaagaatccataaaaagtctgtctggtgtgtctcacacacacacaaaaagaatccataaaaagtctgtctggttatttaaataaaacttctatggaggagttttaagacacttgcatttcttccaaaagaagtttgcccagtcagacaggggagcttacagagacaacccctccctgagttgggtggagtactcagaaacaagacatggttagaaagtcattggttctgaagctgctactaagtctctttcattttctttagttcaaagcaataggcaagccaaagtaccatactttggggtatgattttctgagccccaacatttgcctctctgaaatttccttagaagttttacacattaagagctgagttggtggctatggagagaaaaatgttagtaatggaatggcaaagaatctcattaaacaagccttccatttctgggactaggttggtccaattaaacaattgtgtcttatttcaggaagtggtgtttacagagctcccatcacagttaaggtgaacgagtctttaatatgtggcatttctaaatcagaagaaaaacaaaggttgaagtctgcggcaatctatacactagtttctctggattctggagggcagtcagttgagataatttctagatttgagtatgaagcatcttcagttggagcagaagcagtcagtagagatctgacagatttttctggattgtagtttgcgtgttatgagagaatgtctataaataagctgttgtggtgatttccctgaaggttatatcaagctgaccagttttgtcttgtagggcttcagaaaactgataattttaattttagttatctcaagtcagaaaattgggagaaaattggaaatgctgtaatagtttggagactcataaccaggtaccggaggagaccacaaggaatgaatatccagtccaaattacaagcaaaggataaaatctcaaacacgataagcagggttagaaccgaaaaatgggtatattatagttttcttctgaaacatgtgttttctctcttcagtcactctaatttttaccaaagataatcacaggaagtccaatttgtttgcaaaaatgagtttaaccatctaggttcttcttaagactgtgttgctgaaactttgtatgaagaatctcaaattaggcttttaaaaggcctcttacaggtgtgcagccaagccagagacacaacctcaaattctgcccataatacctgtagatttgggttaatcctgctcttctcagtaaagttctcaaactatctccaagttcttgggtttgtcagagagtgacattctttacttaccagcatggcagccccgtgaaccgtgtattcatagtactagaccagtttccagggggctttttattggcttcataaagtcaaattcatttccttaaaatggtcagattatatctgaaagttagactattcagccaaagctttggtaatataacagtgtttccaattgtgccttattagaagaagaataaattcgtattgaacttaggtaactacattgccataaaatgagaatactcaggaataattcacaaattttggagggatcaatcagggagaaaaaaggtaaatgtttcaattctgttcacaaaagtacacattatgaaattgaagcaagctatagaaagtttaaaagaaaaacaaagtcttgctaaatacggaagacaaaatataaaaagaatcagcaatgtttcaaacagaaagttgtaaaaaatcatggtttttcatgagttcagtcccaaataattaattcttgttctgcttaatgttgggttggcaattgtatcagtttagtattctttttcatttgagtcttggaaattatcaaagttttcagaaacctgtacttgtcaaagttctttttatttttcctatatacttccttgaagaaacaacaccttaggattataattgcctacaaaaagctttcagaaaaggcatcaacataaagcagttagttgtggacaacgagacaagacttaaaatggcaatggttaaagatctgagagagttcattataataaaaaagcaattgaaaagaaaatttgattatttctgcagtgtttatacaataattaaatgtaataaccgaaggttataaatgatagcattatcttaagacatatcagagatctagacattgcatacaatctttggacacatattaataacatacccatatgaatgtaacttaaagaaagttaaatattatttcttatttgacaatgttttcatataatttaacatattggataagcctcattggtttaatatctttttagggggaattttagagactttccttaattgtccaaaagttagtttgggggtcgaagtacttttattttgattcttagggggtttgtcaaatatcaaaggtttaaaacatttgatcaaaataaaatcacaggtcaccataatatgatattcatgtagccagagtgacaataaaaagatttcaaaagcaaaaacaggaagttacatagttgtagagaaacttttactctttggtaaagaggagactcagttttcctaagtaatcaaaagacctaacatgacagtataagatacaaagaacgtgtttctctctctcctctctcttttgagagtttttctcagtccattttgtgttgctatatcacaaaatatctaaggctagataatttataaagaatagaggcttatttaactcgcacttctgcaggctgggaagtttagccctggcttctggtgaaagctttcctgctgcatcgtaacatggtagagaatgtaaaagggaaagcagatatgtgcgaagaggccaaacctgtgagcagtctggctttatactaaccggttcttgttgaaactaatctatccccatgagaactcattcagttgtaccagaacaagaacccataaattattgacagaatggctccaagccaccacaagggcagagccctcatggtccaagcaccacccattagtccccacctcccaatgcaaacacattgaagatcgaatttcaaaaagagttttgattaagagaaataaaccatatgcagaccatagcaatttcacccctgccccccaaaactcatgtccttctcaaacaaaaaatgcaatcatatcatcccaatatttccaaaagttttaacttggtccagcaccaactcaaaagtccaaagtctaaagtctcacctgagactgaaggcaagtttcttccagttgtgagcctgtaaaatttaaaaaaaaaaagttatttatttccaagatacactgctggaacagacatttggtagacatcctccttccaaaaaagagaaataggccaaaagagaggaatgataggccccatgtaagtccaaaacctaggtcaggtgcagtggctcacccttgtaatcccaacactgtgggaggccgaggcaggaggatcagttcaggacaggaatttaagaccagcctgggcaacataattaacattatttaaaagttagctggatgtgatgatgtgcacttgtagttccagctcctcaggaggctaaggcaggaggatctcttgggcccagaagttggaggttacagtgagccatgatagcaccacttcactgcagcacgggtgacagagtgagaccctgcctcaaaacaaacaaacaaacaaaaatgtctaaaatccagcagagcagatgtaaatggtaaaacacaagaataatcttctttgatttcatgtctcacatgctgggcaaactggcatgactgttgggctcccaagcccttggaaacccctgaatccatggcttctctggatgcaacctacatggctaccagtctctgtacttggaagtggggagaagcaggaaaatgttacaaagttatcagttcggtgactgcttgtaagaccttttaattttctttgcttaagtgctcagcatgagaaagtgccaggtttagggtattagtttctgagctccagtggcatgaactagcttaatacacgtgggagaagaaagtagacaatgattgtgaaaaacatttcagtgttacagagtcctttgtatggaaagcaatccagtccttagactttaagccatagaacattttgtagaacgttccatggagtagtgttggaatgcacttttcttctaaggtattctaactatatcagaatattcatttttcatcacctctgtgatgggctaggcagtgcttcctagagcttctgaggcctagtttcctctcactcatattttcctctattactgtgacccaaataaaaactcagtggaaacaaatccaacatcacagcaagctcattatcagttgtgtggaggtggagacctgctgtcattagtatgggggaggaattacacagcaacttggagaagcagtttagaattaaatagaaatggaaagaagtgcttatgaaaatctcagctttcataaataaaataatgttgtgggtgggttaaagaggtagatataactctttcatatgtctgtctttatattttcatagtatccattatttttcaaaaaagttttaatcttggctgccaaatttgctcatcacaactaattggaatagagaagaagagaaaataaggacagagttgaagtgacattgccacaatgctgctaaatctctcatgatctcattttcttcccatattcagcaaaattatccgttcctctattattcccacccttctttccctccctcttgcttacatttacccaaagcaccaatcagcttgaactagttactaaaactgagaaataacaaaaagaaaaattccaagttgtttgaacttgcagttttctgaaaattacttaccataagacaagttacaaacatgtgaatctaatgctgttttttaatcaacagttggcaagaccagtgaggtgagattctaaaatgtgctgcagatattttgctatcataataaagtgttgaagtttgtgaatggtttactttaaaaaaataaactaaggtgtacttaagatgatcccagtggtattcctaaaataccacactcacttgcttacttaaattccaagacgttttctgggcagcagaaaaaaagcatgatttgagagtgagcaaaagggtaactgcataacactgcagcactggagaggtaactgtcagtgatgaaataagactagtattcgttcaaggtcattagcaacattgagttgtgactgttatggcttactctggtttattttttattttaactatagatagagatttagtctgaagaaaagcaagatagataaagtaaaatagtgcaccttttttcaaatgagtaagaacacaatgaacataccagttagcaacagcccagcacttagaacttctaaatgaaatgcaagagggtgatgcagatgacaattttaatagtgctatctaattcataacgtgttagaatatataaattctattgattgcaatttaaaaaatcaactaccaatgcttctttttcaatggcacctgcttgctctcctaattaacattaggtaaaatggagagctaggggaaaagaccaagacctgtttttagtagctaaaaatatgtttattaaagaacaaattttgaagttgtttgattaccgattttactactcagatgcttatagataactttgcatacagtattattaaaatccagtactgaccaggcatggtggctcacacctgtaatcccagcactttgtgaggctgaggtgggaggatcacctgaggtcaagagttcgagaccatcctggccaacatggtgaaacctcgtctctattaaaaatacaaaaaaaaaaaaaaaaaatagctgggcatggtcatggtggtgcgtgcctgtagtcccagctactcaggatgctctggtaggagaacccttgaaccccagagggagaggttgcagtgagccaagatcatgccactgcactccagcctgggtgacagagggagactccatctcaaaaaataaataattaattaaatccagtactgtaagataataaatttgtgttttctgagccactatgtttatggtaatttagtacagtggcaataggaaactaatagagacaccaaagcttgaatggtttattaactgcctggtcctgaggcagccccctctcatgacggggcatctggagaaagactagctaaggcgttctccagtagtgtttactatttatcttctttcctacctcttcttcactgcagagcgtgacagagtctgggagactgagggggcgggggcacaagccctctttgttgagtggctaacagctcagtgcagacaacaaatttaccaggaaacctctttcccctcctccaccagggcagaaggacacgtctgagagcactaggcgggcagattgagcagaagaaagctgggaaactgctccacatggggtgattcccctgaggttttatttccaaaattaaatttgtgttgctttccagggtgcgctcctatgatcctatgatccctgtctattgacacacgttttgtgcttatggttgcctacctgactgatatttctatttaatatgacactttagcagctaattcacaacaagcattgcagacatagctctttgtggccgtcaacttagatgattaaaaaggtgaatatgtaagtgtgtatgtgtttacatatacacccacacaaatgtagacatatacacatgtagtgtgtctccttgacaattttttttttttttgagacggagtcttgctctgtcacccaggctggagtgcagtggcacgaactccgctcatttcaagctccgcctcccaggttcacgccattcttctgcctcagcctcccgagtagctgggactactacaggcacctgccaccacgcccggctaatttttttggtattttttagtggagacggggtttcactgtgttagccaggatggtctcgatctcctgacctagtgagccgcccgcgtcggcctccctgataatttttacccacaatagtactcatactatctccacaatttttcagtgtacaagtcttatctttattttgttaaaacgcattttaattttttaaattacctctgataatgttataaattattttcttaattttttcaggttggtcattgctaatacatataagaaaacagaattttcaaatagatttttacttattccttttaatttagattaattttatttcatttcttgcttaattgctctggcttaaacctccagtataatgttgaataaaagtgacaaccgagggcatcctcgttttgtttctaaacttagggaaaaaactttctgtctctcactattaagtatgttgttagttatgggcattttgtagatgctgtttatcaatttgaggaagttgagaaacttttaaagaaatgttctaataataaaccttagtttgctaattactaaaactgtataattattatattaaatttagaaaatgcagacatgtagaaagaagagtatttttaaccaaccctaaatagactaccaaaataaaaccatcagtaacatccaatttggcacataaccgaaggaagatatccgagttcatggtttatctactatttttcattttggacataatattgtatttaacatatttgtatttgtaatttttccaatattatattttatgtctccccaaatttctagaaatagtgttatagaatcacaggatataaacattgtgtgtacatgagtgcatatgtgtgtgtgcatgtgtgtgtcaagctgtttcttatctattatctatgtataattctctctatatgtctatgtatataaatacatatataacattaatatttattttcaagaattcttgttaaattgatgcccttcccagaggtgtgtgttcttgccaatttttggcatctttaaaaaatgtttgtgaacttaactagtagagattgtgtagaagtgttgctttgattggacatgtctggcttaaaatatagtcatgtcactcacaacggaaatacattctgagaaatgtgtcattaggcaatttcattgttgcgtgaacatcatagagtgtactttcacaaaacctggatagcacagcctactacacgcctaggctgtacgatgtagcctgttgttcctagactatacacctgtacagcctggtacagtgctaaatactatagacaattgcaacataatggtgtttgcatatctaaacctaggaaaggtagaataaaaaatgttgtattataattttatgagaccaccatcacatatgccatctgtcttggaccaaaacgtcattatgtagtgcatgactgtattagtttgagcttcttattttcccgtttgtgtaagttatttaattttcttcctttgtgaactgatgttcacatccctcatgtttgttagttttccagtgctttcttttacattgcttgagtcccgtatatagtaaaagcactaactctttgtctaacacacctataagaagactgattctttcaacataatagaaactatacttccaattcagtggcatttccttcaacatagtcacagtgggaaattacacttacttcaatgatggtcccacttattaaaacactgtaagatatttttactctgaaatagtctttagagctctcatgcaaaccataggatcagctcagcccttttttaaatcattgggagcctaatgcagtgtagccatcttgctcattcatctattccctagacttggttttgaaatgacttctggctatttcttttttttttttttttttttttttttttgagacagagtctaactatgtcgcccaggctggagtgcaacggcgcgatcttggctcacttcaacctctgcctcctgggttcaagcgattctcctgcctcagccttccaagtagctaggattacaggcacccacaaccatgcccagctaatttttgtatttttagtagaggcagttttcaccattttgaccaggatggtcttgatctcttaacctcgtgatccgcccgcctttgcctcccaaagtactgggattacaggcgtgagccaccattcccggccgacttctggctatttctaaactcaaattcttcttgaaagatgaaaatttgctgccagtaatagtatgaaaaatatgagacctttgttccaaagtaaatttgttagaaagagagactcttctaagcaagcttagtgttattaggaaaattggatctccttccagctatgactgcttggaatgctaaaatattcattatattttctgatgcatttaaatacatatgtatataaatttaaagtaatttgtgtaaatgcagatggtttgtggcttgttttttttttttaatccttcattttccatggtcagttcttacgccttcacattcgtactattaattctttacacttcttcaataaatttactcaaatataaataacttcagaaaaatttaaaatctacccccgcaaaagcttcaatatctgaagtttatgtggagaatgacttgaggatttttttttaagaatagaaggtataaaatatttttattaggttattttatctataatttctaaatcaaattaacagaaatttattggagatatagtatatgtaaggttatatattttgctaaccaaaaataaatgattaagactaaaattcttggacccagaatgtacatatcatgaagtctttgtgcatcctgagatagtaactcagttaccttatggccctctctttaaagccttttttttcggcatgttgcctcatatttaaaaaatacaggcaagccaagcttttgtgtgtttcctcaaagaggctcctgccctgcacatcattagaaatgtttccctttaaactttctatttttccaaagaacttcgatttacactggcttacactcttctgtatcattctctgatatcaccttatctgtacacgacagatagtgtctttgatagttacatttctctagagaagagaacaagttttgaacatcaaaccaagaaactcattcttttggggaactgggagatgggtttgcagaaatgttgtagaaaagaggcttccagaaaccaaagatattctttgcattctttaacactttgcagacccctgagagtgacctgatttcagggttgatttccttcagggcagccactttctttcatgccaatgccagagttaaagtacggagagaaggccagtcttagagcagtgcttctcattctgtgactatacatcctggctccactggctgtctatcatttgttcagttcaccttctctggcaggaagaccagccagcctggcagtgttcttgttggcataatagaactgtcatgggttcatctgtagccatggacaaggagagctaatggaagctggaaagagtggattccagttggcatattgaagaagcttaactgaatagttttcaaaacaagaagttgtggaataagagttacagggagatagtagcacaaaaggaacgaggaagcagaaagactacaaagagaagcagaagggcaatcatggagaataagaaagaaatgtttccctacatctattgagtgacctggccaagtttagttaaaagacctggggcattgtataacaattggtagtgtcgaagaatattttacttgggaataaaaggagatcagccgccactcattcacacattaatcaaatgtctaccatattacttataacttaatttctgtaattacattactgaagcaaaaatgctgaatacacaacactaagagctggtagttacatggaggagtaaaaaggtaaacaatttaacatattaacataaattatggagctggaagaaacacagaggaaggacttgaacttaattggcagtaggggaaggattccaagaataggtgacagctgagctataatagtggcgtgaagctatttctttagagaaaatttctggggaacacgaatgaccagtgcacttttgcttttgggtacacaaacaggacaggcacacaagataattatctgctacaatgaccttgcctcatttcatcaaatccatctaaaataaacattatttggaagattcgtttttctatgacacattaagttgtatactggtcatcatgttgaccaagtaattttgaagggaataagaagaaaattaatatgaagtgtttattacatgtccagttccaccttacctgtcggaagtctcaatcacactaccgttttataggtgaatattacaaccatttcacacacatagaacagagcctcaagtgagttaagtagtttatggagggcacataaagaaggtgagtgttgggccatcctgtgaaagacaaaacagtgcctggacgcagagaaataccaagtctagatgaagagttttcagagtcctcggtgtctgaacatctgccactttctagctgtgcaattttctggaagttacatgacatttctcagcttctgaagtctgctttggaaagaaaaaacatcatccaaaagtactgtaaatacaaaggaccagagaatgttttgcctcattttttttagcatctgtagtaaaacctgtggtttaataagcacaattctgaatagaagtttagcttccagggcctgaacacaggcaaaactgttctgctcatgagacaggtaaaaataatttggtgttgcttcagactgtgcctagaaacagcaagataactggaagctgaaaatccatgaattgaccccttcttacaatcccatgcatctgtggtaaagttactgaactcataaaatgcttggataaagatgttttgttttcacaatgaagtagtgatgctttgggcctctgtcaaggtgaagcagaactagagaaagatgcacaggctcagatctcaaagagaaaacaattagttctggacccttgacagggccacagaactgggtgagccacattgagcgaggtctccagggaaaggagagccccagctgacatcttgtggaatgacacaaagatcacagtagacaaaggaagcacattttcaatgtaagcgaattcttctatgaatcaatacaatgagcttgaacgagaactccttgctctcagggacttctgaaaatccagcttcagtctttgatccccttgtttcaaatttctcactaaaacaacaaaaacagaccaaaaaaaaaaaaaaaaaaaaaaagatgaaggccattacagcaccataagaagagagtgtgacatttaatctaatggcccaaaactggagattttttttctttgtttttttttcttcagattattaggctggaggagctaaagcatgaagtgaaattctagaatcacacatgctctgcaaacagcaaggttgtctgcctggaagtagcatgctcttgggtcagacaggcaatgcatattttacacagaaaactataagcctgtcccatttcaggtctgctctcaggcaggcggagtgagaatttgtattatcctctctccgtgcatctccatgatacagtgcctcaaattcttatacgaattttctcacttctagagcactatagaacagaagcagtgatatctgtacaagctttaaacaagagaaagaatccagaagtggaacattccatcaggaattaacagtctacaacagttaaaagtgtagacagtactggagacaagaaggtgcataacaaggtttctgggtattgtagtttttcatgggctccattttaattgtgtcacagagagagtcagtgaggacaggtcagatcacatttcagttgaagggagttcatgcatttgataaatgtgctgtagcctggacatttgtccaagagttataagtgacagtatgccacctgtcaggcagatgaaaattatctacttcctgagcaaaaataatgaaccataaaaacttaacaggattccagaagacttgactatgatgaaaccagatacaagtatataaaaagaaaataaagagaaagagacgctatgttgttgagaattaaagaacaaaaacaaaaaacatggattaaattccaaatgaatgaaaagacattaaaatgaccaggtaaaaattattgtctgctttgtttgaggcagtaaaagacacaaataacactgcggatgtttttaaaaaggtgaattaaaacaaacaaaaaaaatctttgagaatctagttcagagcacaagagaactagagagacagtgatttgggatctttagtaatgtctactgacaaatctccaaaaacaacgaaaaacacactttgccaaaggaaaattaaatgtattggacctgccataataaagagaaccttactttgtcagtcctggtagtgtctagaaggcaggggcagatatttttagtagttagggcccaaagtgtattattttaaagctaatcttgccagatgggaaattggctgggactggacagagtttttgacctaagatctttggattgatggccacagaaaatcaggaatcttgacgtgagtctctatgagtaagctgccagtcttgagcaaaagctatttgagccagttctcagttttatcttatgaaacacgtatttcctggggcaaggtctaagccactcttgcttattctgagtattgtttaacacagggacaaaacatgatcttagtttcagctctcaataggtaatctagttttcatttctgactagatttttttatttttctaatttaaaaatatgaccagattttttatatgtagagttttcgtcaataattttgcaagtatatagcccggtttttgataagcataatcagatcaatcttcagtttaggaggtcactcccattgagtctcagagatgactcttgaaccatgagcttggtcttctgtagaaatagctattcttaaatcaggtccatggtctccatgtcccatatcaataatatttttccttttcatttaaaaaaattttctaatactctatttataatataatatatttaatatttctaattacatatgctttgtataagaaatgaatgatactttcaaaaattaaatatagatatttaagtagatgtctacaaaaaataattaggggataaatgttccacagtgtttattaagtatatttttctgcaaaatggaccaagtaggtggattttaaaagtctgcttttttcatttttcacatttctttaaggaacagaaataatgtttgccattggtagaaatctcattttaattttacagaaatacaataaaactagcttttagatcctcttttcttaccctaaactttcacaagggtttgatcagtgtgtgagggatggtgttgtggaatggagcagagctggtcaatgtgttagcaaacagcctcccaagcagcaggcaccctaccctcccactgaaccaacttttccatgtcagccctgtatgctgcatgatttgtctttggtagaaatcctgggaaaatcaagtgactttcctttacttcattttgcaggtgagcccagaggttcaactttcatcacctttttgggaagtaagattctcctacttctactttcaggagtgagctcaaagtcccagcaggcaaaaagcctgcaacattgtgtgggttttacagccaggatccattattatttttttctgagttaagggatctaaacatagaaaggaaagttggacatttgtaatttgcatttactgaaaatgataaaaagtcatggatattgaagaggaaggaggccatttctatggttagaaagactgaccctgtgagctctgcttagcctttggaatatctagtgtctaaaagaatagaggcaatgctaagatgttgtaacacgtctgcaaatgaaatggaaatgattctacttttctcatatattttataaatctgtgagtgttaagagtaggtaagaaaaacaatgcttacagataaaatatagttaaaaacattttcctctttctaagccttggtagtcatatagtttgaccaaatgacagaataaagattgtcccatgatttgaaaactgtcttcagtacaaatcttataaaaatatgataaaattataacaaatattttagaaggtataaaaataaaagataatatcctgcttctactaaaatatggacatactcaattatcttaacactttactttagaaatatgctttgacagatgtggatccatagaacctcaacatcttttttttttttttttatactttaggttttagggtacatgtgcacattgtgcaggttagttacatatgtatacatgtgccatgctggtgcgctgcacccactaaatcgtcatctagcattaggtatatctcccaatgctat

SEQ ID NO: 2474 - DNA, 10249 bp, Homo sapiens
atgatttgagagtgagcaaaagggtaactgcataacactgcagcactggagaggtaactgtcagtgatgaaataagactagtattcgttcaaggtcattagcaacattgagttgtgactgttatggcttactctggtttattttttattttaactatagatagagatttagtctgaagaaaagcaagatagataaagtaaaatagtgcaccttttttcaaatgagtaagaacacaatgaacataccagttagcaacagcccagcacttagaacttctaaatgaaatgcaagagggtgatgcagatgacaattttaatagtgctatctaattcataacgtgttagaatatataaattctattgattgcaatttaaaaaatcaactaccaatgcttctttttcaatggcacctgcttgctctcctaattaacattaggtaaaatggagagctaggggaaaagaccaagacctgtttttagtagctaaaaatatgtttattaaagaacaaattttgaagttgtttgattaccgattttactactcagatgcttatagataactttgcatacagtattattaaaatccagtactgaccaggcatggtggctcacacctgtaatcccagcactttgtgaggctgaggtgggaggatcacctgaggtcaagagttcgagaccatcctggccaacatggtgaaacctcgtctctattaaaaatacaaaaaaaaaaaaaaaaaatagctgggcatggtcatggtggtgcgtgcctgtagtcccagctactcaggatgctctggtaggagaacccttgaaccccagagggagaggttgcagtgagccaagatcatgccactgcactccagcctgggtgacagagggagactccatctcaaaaaataaataattaattaaatccagtactgtaagataataaatttgtgttttctgagccactatgtttatggtaatttagtacagtggcaataggaaactaatagagacaccaaagcttgaatggtttattaactgcctggtcctgaggcagccccctctcatgacggggcatctggagaaagactagctaaggcgttctccagtagtgtttactatttatcttctttcctacctcttcttcactgcagagcgtgacagagtctgggagactgagggggcgggggcacaagccctctttgttgagtggctaacagctcagtgcagacaacaaatttaccaggaaacctctttcccctcctccaccagggcagaaggacacgtctgagagcactaggcgggcagattgagcagaagaaagctgggaaactgctccacatggggtgattcccctgaggttttatttccaaaattaaatttgtgttgctttccagggtgcgctcctatgatcctatgatccctgtctattgacacacgttttgtgcttatggttgcctacctgactgatatttctatttaatatgacactttagcagctaattcacaacaagcattgcagacatagctctttgtggccgtcaacttagatgattaaaaaggtgaatatgtaagtgtgtatgtgtttacatatacacccacacaaatgtagacatatacacatgtagtgtgtctccttgacaattttttttttttttgagacggagtcttgctctgtcacccaggctggagtgcagtggcacgaactccgctcatttcaagctccgcctcccaggttcacgccattcttctgcctcagcctcccgagtagctgggactactacaggcacctgccaccacgcccggctaatttttttggtattttttagtggagacggggtttcactgtgttagccaggatggtctcgatctcctgacctagtgagccgcccgcgtcggcctccctgataatttttacccacaatagtactcatactatctccacaatttttcagtgtacaagtcttatctttattttgttaaaacgcattttaattttttaaattacctctgataatgttataaattattttcttaattttttcaggttggtcattgctaatacatataagaaaacagaattttcaaatagatttttacttattccttttaatttagattaattttatttcatttcttgcttaattgctctggcttaaacctccagtataatgttgaataaaagtgacaaccgagggcatcctcgttttgtttctaaacttagggaaaaaactttctgtctctcactattaagtatgttgttagttatgggcattttgtagatgctgtttatcaatttgaggaagttgagaaacttttaaagaaatgttctaataataaaccttagtttgctaattactaaaactgtataattattatattaaatttagaaaatgcagacatgtagaaagaagagtatttttaaccaaccctaaatagactaccaaaataaaaccatcagtaacatccaatttggcacataaccgaaggaagatatccgagttcatggtttatctactatttttcattttggacataatattgtatttaacatatttgtatttgtaatttttccaatattatattttatgtctccccaaatttctagaaatagtgttatagaatcacaggatataaacattgtgtgtacatgagtgcatatgtgtgtgtgcatgtgtgtgtcaagctgtttcttatctattatctatgtataattctctctatatgtctatgtatataaatacatatataacattaatatttattttcaagaattcttgttaaattgatgcccttcccagaggtgtgtgttcttgccaatttttggcatctttaaaaaatgtttgtgaacttaactagtagagattgtgtagaagtgttgctttgattggacatgtctggcttaaaatatagtcatgtcactcacaacggaaatacattctgagaaatgtgtcattaggcaatttcattgttgcgtgaacatcatagagtgtactttcacaaaacctggatagcacagcctactacacgcctaggctgtacgatgtagcctgttgttcctagactatacacctgtacagcctggtacagtgctaaatactatagacaattgcaacataatggtgtttgcatatctaaacctaggaaaggtagaataaaaaatgttgtattataattttatgagaccaccatcacatatgccatctgtcttggaccaaaacgtcattatgtagtgcatgactgtattagtttgagcttcttattttcccgtttgtgtaagttatttaattttcttcctttgtgaactgatgttcacatccctcatgtttgttagttttccagtgctttcttttacattgcttgagtcccgtatatagtaaaagcactaactctttgtctaacacacctataagaagactgattctttcaacataatagaaactatacttccaattcagtggcatttccttcaacatagtcacagtgggaaattacacttacttcaatgatggtcccacttattaaaacactgtaagatatttttactctgaaatagtctttagagctctcatgcaaaccataggatcagctcagcccttttttaaatcattgggagcctaatgcagtgtagccatcttgctcattcatctattccctagacttggttttgaaatgacttctggctatttcttttttttttttttttttttttttttttgagacagagtctaactatgtcgcccaggctggagtgcaacggcgcgatcttggctcacttcaacctctgcctcctgggttcaagcgattctcctgcctcagccttccaagtagctaggattacaggcacccacaaccatgcccagctaatttttgtatttttagtagaggcagttttcaccattttgaccaggatggtcttgatctcttaacctcgtgatccgcccgcctttgcctcccaaagtactgggattacaggcgtgagccaccattcccggccgacttctggctatttctaaactcaaattcttcttgaaagatgaaaatttgctgccagtaatagtatgaaaaatatgagacctttgttccaaagtaaatttgttagaaagagagactcttctaagcaagcttagtgttattaggaaaattggatctccttccagctatgactgcttggaatgctaaaatattcattatattttctgatgcatttaaatacatatgtatataaatttaaagtaatttgtgtaaatgcagatggtttgtggcttgttttttttttttaatccttcattttccatggtcagttcttacgccttcacattcgtactattaattctttacacttcttcaataaatttactcaaatataaataacttcagaaaaatttaaaatctacccccgcaaaagcttcaatatctgaagtttatgtggagaatgacttgaggatttttttttaagaatagaaggtataaaatatttttattaggttattttatctataatttctaaatcaaattaacagaaatttattggagatatagtatatgtaaggttatatattttgctaaccaaaaataaatgattaagactaaaattcttggacccagaatgtacatatcatgaagtctttgtgcatcctgagatagtaactcagttaccttatggccctctctttaaagccttttttttcggcatgttgcctcatatttaaaaaatacaggcaagccaagcttttgtgtgtttcctcaaagaggctcctgccctgcacatcattagaaatgtttccctttaaactttctatttttccaaagaacttcgatttacactggcttacactcttctgtatcattctctgatatcaccttatctgtacacgacagatagtgtctttgatagttacatttctctagagaagagaacaagttttgaacatcaaaccaagaaactcattcttttggggaactgggagatgggtttgcagaaatgttgtagaaaagaggcttccagaaaccaaagatattctttgcattctttaacactttgcagacccctgagagtgacctgatttcagggttgatttccttcagggcagccactttctttcatgccaatgccagagttaaagtacggagagaaggccagtcttagagcagtgcttctcattctgtgactatacatcctggctccactggctgtctatcatttgttcagttcaccttctctggcaggaagaccagccagcctggcagtgttcttgttggcataatagaactgtcatgggttcatctgtagccatggacaaggagagctaatggaagctggaaagagtggattccagttggcatattgaagaagcttaactgaatagttttcaaaacaagaagttgtggaataagagttacagggagatagtagcacaaaaggaacgaggaagcagaaagactacaaagagaagcagaagggcaatcatggagaataagaaagaaatgtttccctacatctattgagtgacctggccaagtttagttaaaagacctggggcattgtataacaattggtagtgtcgaagaatattttacttgggaataaaaggagatcagccgccactcattcacacattaatcaaatgtctaccatattacttataacttaatttctgtaattacattactgaagcaaaaatgctgaatacacaacactaagagctggtagttacatggaggagtaaaaaggtaaacaatttaacatattaacataaattatggagctggaagaaacacagaggaaggacttgaacttaattggcagtaggggaaggattccaagaataggtgacagctgagctataatagtggcgtgaagctatttctttagagaaaatttctggggaacacgaatgaccagtgcacttttgcttttgggtacacaaacaggacaggcacacaagataattatctgctacaatgaccttgcctcatttcatcaaatccatctaaaataaacattatttggaagattcgtttttctatgacacattaagttgtatactggtcatcatgttgaccaagtaattttgaagggaataagaagaaaattaatatgaagtgtttattacatgtccagttccaccttacctgtcggaagtctcaatcacactaccgttttataggtgaatattacaaccatttcacacacatagaacagagcctcaagtgagttaagtagtttatggagggcacataaagaaggtgagtgttgggccatcctgtgaaagacaaaacagtgcctggacgcagagaaataccaagtctagatgaagagttttcagagtcctcggtgtctgaacatctgccactttctagctgtgcaattttctggaagttacatgacatttctcagcttctgaagtctgctttggaaagaaaaaacatcatccaaaagtactgtaaatacaaaggaccagagaatgttttgcctcattttttttagcatctgtagtaaaacctgtggtttaataagcacaattctgaatagaagtttagcttccagggcctgaacacaggcaaaactgttctgctcatgagacaggtaaaaataatttggtgttgcttcagactgtgcctagaaacagcaagataactggaagctgaaaatccatgaattgaccccttcttacaatcccatgcatctgtggtaaagttactgaactcataaaatgcttggataaagatgttttgttttcacaatgaagtagtgatgctttgggcctctgtcaaggtgaagcagaactagagaaagatgcacaggctcagatctcaaagagaaaacaattagttctggacccttgacagggccacagaactgggtgagccacattgagcgaggtctccagggaaaggagagccccagctgacatcttgtggaatgacacaaagatcacagtagacaaaggaagcacattttcaatgtaagcgaattcttctatgaatcaatacaatgagcttgaacgagaactccttgctctcagggacttctgaaaatccagcttcagtctttgatccccttgtttcaaatttctcactaaaacaacaaaaacagaccaaaaaaaaaaaaaaaaaaaaaaagatgaaggccattacagcaccataagaagagagtgtgacatttaatctaatggcccaaaactggagattttttttctttgtttttttttcttcagattattaggctggaggagctaaagcatgaagtgaaattctagaatcacacatgctctgcaaacagcaaggttgtctgcctggaagtagcatgctcttgggtcagacaggcaatgcatattttacacagaaaactataagcctgtcccatttcaggtctgctctcaggcaggcggagtgagaatttgtattatcctctctccgtgcatctccatgatacagtgcctcaaattcttatacgaattttctcacttctagagcactatagaacagaagcagtgatatctgtacaagctttaaacaagagaaagaatccagaagtggaacattccatcaggaattaacagtctacaacagttaaaagtgtagacagtactggagacaagaaggtgcataacaaggtttctgggtattgtagtttttcatgggctccattttaattgtgtcacagagagagtcagtgaggacaggtcagatcacatttcagttgaagggagttcatgcatttgataaatgtgctgtagcctggacatttgtccaagagttataagtgacagtatgccacctgtcaggcagatgaaaattatctacttcctgagcaaaaataatgaaccataaaaacttaacaggattccagaagacttgactatgatgaaaccagatacaagtatataaaaagaaaataaagagaaagagacgctatgttgttgagaattaaagaacaaaaacaaaaaacatggattaaattccaaatgaatgaaaagacattaaaatgaccaggtaaaaattattgtctgctttgtttgaggcagtaaaagacacaaataacactgcggatgtttttaaaaaggtgaattaaaacaaacaaaaaaaatctttgagaatctagttcagagcacaagagaactagagagacagtgatttgggatctttagtaatgtctactgacaaatctccaaaaacaacgaaaaacacactttgccaaaggaaaattaaatgtattggacctgccataataaagagaaccttactttgtcagtcctggtagtgtctagaaggcaggggcagatatttttagtagttagggcccaaagtgtattattttaaagctaatcttgccagatgggaaattggctgggactggacagagtttttgacctaagatctttggattgatggccacagaaaatcaggaatcttgacgtgagtctctatgagtaagctgccagtcttgagcaaaagctatttgagccagttctcagttttatcttatgaaacacgtatttcctggggcaaggtctaagccactcttgcttattctgagtattgtttaacacagggacaaaacatgatcttagtttcagctctcaataggtaatctagttttcatttctgactagatttttttatttttctaatttaaaaatatgaccagattttttatatgtagagttttcgtcaataattttgcaagtatatagcccggtttttgataagcataatcagatcaatcttcagtttaggaggtcactcccattgagtctcagagatgactcttgaaccatgagcttggtcttctgtagaaatagctattcttaaatcaggtccatggtctccatgtcccatatcaataatatttttccttttcatttaaaaaaattttctaatactctatttataatataatatatttaatatttctaattacatatgctttgtataagaaatgaatgatactttcaaaaattaaatatagatatttaagtagatgtctacaaaaaataattaggggataaatgttccacagtgtttattaagtatatttttctgcaaaatggaccaagtaggtggattttaaaagtctgcttttttcatttttcacatttctttaaggaacagaaataatgtttgccattggtagaaatctcattttaattttacagaaatacaataaaactagcttttagatcctcttttcttaccctaaactttcacaagggtttgatcagtgtgtgagggatggtgttgtggaatggagcagagctggtcaatgtgttagcaaacagcctcccaagcagcaggcaccctaccctcccactgaaccaacttttccatgtcagccctgtatgctgcatgatttgtctttggtagaaatcctgggaaaatcaagtgactttcctttacttcattttgcaggtgagcccagaggttcaactttcatcacctttttgggaagtaagattctcctacttctactttcaggagtgagctcaaagtcccagcaggcaaaaagcctgcaacattgtgtgggttttacagccaggatccattattatttttttctgagttaagggatctaaacatagaaaggaaagttggacatttgtaatttgcatttactgaaaatgataaaaagtcatggatattgaagaggaaggaggccatttctatggttagaaagactgaccctgtgagctctgcttagcctttggaatatctagtgtctaaaagaatagaggcaatgctaagatgttgtaacacgtctgcaaatgaaatggaaatgattctacttttctcatatattttataaatctgtgagtgttaagagtaggtaagaaaaacaatgcttacagataaaatatagttaaaaacattttcctctttctaagccttggtagtcatatagtttgaccaaatgacagaataaagattgtcccatgatttgaaaactgtcttcagtacaaatcttataaaaatatgataaaattataacaaatattttagaaggtataaaaataaaagataatatcctgcttctactaaaatatggacatactcaattatcttaacactttactttagaaatatgctttgacagatgtggatccatagaacctcaacatcttttttttttttttttatactttaggttttagggtacatgtgcacattgtgcaggttagttacatatgtatacatgtgccatgctggtgcgctgcacccactaaatcgtcatctagcattaggtatatctcccaatgctat

SEQ ID NO: 2475 - DNA, 19521 bp, Homo sapiens
caatcagttggccttatgtcaatgattttctgtgaacctctaggcagccaagggctcccgctagtccccatactaccataacccacagggttacgaacatgaaaatagcatatataaacataaatggtaatcagaacagtgtttgggatatactaagccttataggaaggcttgccaacatggttattattattcccattacatccctctagtccaataacattaatatggtatgattatcattccctattagtcctaggcacctaccctagactagtctactaatattgtttgtttgaatctaaaaacaacaacaaaaaataccttctacctggtctccctgcccctcctatgtcccactattagcccacaaagcagaaggatttgtctttataaatgagaagttacatcattgcttcttcccagtttaaaattctctaaatggcttccttttacatttatatcattttcagagtctttattgtgaccatggcctatatggcttaaccaggtctggcccttgtctacctctgtgaactcatcttcttccattttttaaatcttgtaccttgtgtcccaggacagacttcttatttctgttccttggacttgccaagctttccagcatcttcaggtggcctttcacctttgcagctgcctcctcttgcaatgttcttcctctgatcttcacactgctgtctcctttttattttttatattacacacaaatggctgatgtcagaggtcttctcaagtaaatacctctcctacccctagctcacattctctctgctactacctcaataaacttttcttatttacaggcatatagttgcctgtttgcttatttattatttcatttaagtatatgcttcctgtgtctgcccactggggtggggaccaaaaaaactgatctaatccctgtgcaaagaacacgtttggcccatagaagatatttaatatatttactattattaaatattatattatttatatataaatatattaataatatattaataaatatattattaatatatttaatattaatatatatctatcgactaccagttctacaggtaattgtgatgcacagccaggtttgtctattttgaactacctaattttaaataggaattaatgattaacaaaatgcttatgcacagcactgtaattgtcatcatttcatggaaaggtataattgagtagaaaaagctgttattcaccttaacacatttaattgccatatttttctgcacaaaataaatcattcctagaagcggccaagttctttcaaccttgaggctatctagctaagtcatcagcacatgcttttaggcttaggactctcaggtggtggcgggcctgttctccccctggctagaagctgagtatcagagatgccatgggagttgggagtgagccaagggaacatccagcttcacttttagtcaggtgtgcagttggtccctgagtggagagaagggccacgtgggagtgtcaggagtggggcctgcagacaaacaaatcatgtctttcaaggaacatgccatgagcaaatctggggcctgagtggggcaaatgcccaggagtagggaacagggaagactccagatgaagccagtggatcctggagggcaggtctgggaagatcccttgaatcagtggcttctggtggggtggcagaaaggagtgatcctttcgtagaagggacctgagacatggcagtgctgttgagaatggtgagctttgttctaagtcaaataaacagtctctgaaacagcagccttgaaaacccaaacttttaaaatacatagaaaatgctacagtcaggcactgagaagttacataaaatgtgcaagtggcatccagattgtccatgtgtgccctatgacaccaatatacaccaagtgatttctcctccaggcaccaggaccctaaacacaaattacaattgaagcccaggggaagcagtggctgggtagtgagggtaaacggtctactcttcaccatgaaaagctggcaacagctgaaaccaacgtactcagtagagaaaatcaggctaaaaagagaaagagagagagtgtgtataattataatttttataattttgactgttggccctggaggcgtttttaggaaggtaaaggtcttaattagcacaatattttgctgagcaggcggatgatatggaatgagcccatgacatggcatgcagagacctagacagctctgcaaattaaaagacagaacttggctgtgggagaaggtgtctgagggagaggagagtaagtgggacagagctggccacgttctaaggcgggatctgggaactgaggagaaaggctactgcgaaacgccctgcaaccaaaggactgggaggaaacagaactatcaaaagacagagttgaaggcccttagcctccagaatattctgccatgaccccatatccttcctagggttggattttggaaaaatcaagtaaagggggctctgtttcataagaggttggtgcgtggagaagaaagaggaattgattgacgaatgtgagtcggaacttaccccagaaatggtcacaagagggaataaataatacaggggtggcagctggagggtgatttgcttagacaatattaacttaattttcaaagtcaggggctcctcaagttgtttttgaatattactgtcacagtaatcaagaacgtaatatagaagtcatctctgcatttcattttccacaccttcttagaacctgttaggggagcaggaattaaagaagactgctgtccaccaccctgaaaatcattcctttctgtgatccacaacaccaggggccaagagattagggcatacaaatatggtcatttcaaaaatacgctgatggggtgctggtggtatattggtgagcctagctgccttccaaaaatatgctaatagaaaaattctttgtttttttaaaatcttgttgtatatcaaatttttccaaagtaatttttgacacattataattaattcccctgcaatcttccaggggagcatttcattaaagcataaaaatccacatggggtctgtgaccagctctgactgcagtctgtcaaaatcagttctctattttcctacaataatgtttaacccatgcaaagatcctagacactgagaatatggagcaaatattttaaaataaaaaaaattaagtagcatataaaattcatatgaaaattgaattacatgtatgacaaaatgacatctatatataagaagatatatttatatatatttacaaacatatatttgtatttcttattttacatactttattataaaatgaaataatcttcttattacctgttcaagtagaagatagtaagatgtgaaggcaaggagaaagttcatttaatattgaacaaagaattttaggaaacaagcagtgacactatgactataggaaaattaaaaaataaaatagttttatgaattaaaatagtgggtcttaatggcacttacagatatcatctattgcattcaactaatgctggaatcaagagttgttgcctgaagtgtaaagaactctgtggaaggaaaaaagatactgcttctcttttactcactacagtttaagaaacattcgctgccaaatacattttttaaagacctcttagcttaatgaaataaaatgtacttttcaatgttgtctctaacaacaacatgaactaagattaattttctctgtagtcataaacaaaaactaacaatttaagtacactgttctctgggagtaagaaatgataatatcagctctttcctattgtgaatctagttaattcaacctcaagataaagttatgagtttcttaaaactcaaataggaacctcagtttcccttgagaaagctttcctatcttttatagtgactatctttaaaaaatgacgaaagaatgagaacccttggggagacaagggtgattcctagctctttgcccagagggagttgctagcgattcctttagttgatatttgttctgctctgtgtttgaagctacttgcttacctgtctgccttcggtcacacctgtgtggagtagcccaactctttcattcacagtccttatattgttaatcactgtgcccaggtaagtaggaacaaaattaaggaaaaggagcaggtttggtgtggatgaatgaaagagactatgcaccaggcatcattttaaaaataattacacacgtaatcctcgttacttccctgtaaggctaattactattactatccccatgctttcagctgagggaacagaggcatggggagcctaagtaactttgatggtttcaaatctagaaagtagtcgaacagggattcaaatcaaaccccaagaattgagcttcaaagtgcataatctcaccattctgctttattatcaccgaggaaattagtgtaaaatggatatgctcattatagacaatgtggtagatctgaggtagaattgcagaaagcaagcatagaaaacaaggcccctccaggtctttttgtttttttgtttgtttgtttgtttgtttttttgagtctgtcacccaggctggagtgcagtggcgcaatcttggctcactgcaagctccgcctcccaggttcacgccattctcctgcctcagcctcctgagtaactgggactacaggcacgtgccaccacgcctggctaatttttttgtatttttagtagagacggggtttcaccttgttagccaggatggtctccatctcctgacctcgtgatccgcctgcctcggcctcctaaagttctgggattacaggcgtgagccaccgtgcccagcctccagctcttcttcctttatgctagtagagttttcaggattctgtagactctatggtagaactgcgtttttagatgttgggtgaaggccctttataagcttatcgaaaggacgtaagtgaactcatagaaaaaaaaaatctttgctgagtctttaagcatgtgacatttcaatcaagaactagtaactagaatggtctttgatgactgctataaaaattcatgaattaacacttgaaataatgtcgaatgccacgaagtaacagacgggtgttatcatatcccggtctggaggtctctggaggatgtcagtgctccaaaaatctccttaagtctccttagccagtttcagctcactgttagatgctttacacatttaattcctgcacgttttttttaaagatatgactatactgcttataaaatctctgtgtgtgtgtgtccaatcatctttacatactattaaatattttgcttagtcattcattcattcattcattttaccagttactggggaaaacaaagtaaaatatcacatagcctcttcccccaaggagcttgcaattttaggaactaatccagtttgagggctgaatttaagttaaaatcaattactgccctatgtactccttttaaaacaacattaggtcaagaccctttcagtgctaactttttgctcattgtagacaaatctcagcaggaaatcgtagatcatattagtctgggagaactcaaaagggaagatttatactcactcaaaaccagtgccaataaaagaagcagaatactgttatttttcttgaagagtgtaaaaattgcttcatttcttacctctagagctttcaatctctctaatagcaatttggtcttttcttttccctcatctgtactgctgctttcactcctcgaatcctcatcaaccaccatgtgaagatcttccaaagcttccttatgttttctctcttcctctgacagcttttcctgaagcaagaaagaattactgttttcaataatctccagtgaaaaataagcatgagtgtgaggctgaaaaggctggaatcattctcctgcgtgtgcattcttccggggctgggagtttgctaaacaaattctgagaggggtttattttaaaaaatgaagtagatatttttactgacccctggaaggacaaggccattgggttgccatctctcaatgcagttgtcctttgcacagttggagaagtgactaagccagcaaagccataggtggagtcatgtggttaatccaattttatctgcacaatgaaactcagctatactgcaaactgtggaaaaatacatcaattttgataccttcatttgtgaaaggcatagctcctcaagatagggtcattaaagtcactggacatgcagccatttaattaaaagaatataaaatatcacaaaatactgaaataagagtgatttcagaattcaaagctcacacctattagttctttcagctcaataatgacacaacttttaaggatccctcagtccctttctgtaacactgttcagcattcgtactatggccttgaggcagacataaaaagttattttgtcttgactcactgttggaagcccctcactcaaccttgtctctggaagctttttgaaagttgagaagtactaagttaagcctcatgaatagctcttgttttcaagggaaaaagaagtatcaagagattaccatattaaaaaaaaaaggatccattttgtgcatggagactcttgctccccacaatcaggtgacatccttccattacactatttaattctaaacacaatgctgcagaaatctttgctttaatgtagctggttgtcaaccatctgaacaaaactggattatcagtggtaaaagacttctctatattttaatactaaactaagatctatttgcaaatacagaagcacaaaacgtatcattcttaccctcaaggagctcatacaatctacttagaaaagaagaacataagaagaaaaaaaaaaccacggcgttttcaaactgtgctcatcaaggtactttgaaggttccaaaaatatttaagttactttttgaaaacaaattatgaattatgtaaaaatatgtcttaatgtatatgtatacatttatacatatatatgtatcagtgtatacgtgtgtgtatatataaatcactttagaccacaaagtcagtgaattcatccatgtgaacctgttatgtacagatttcaggatctaatttctcctgtcatctctgtatatataaatgcatagttgattagaaaggttgtagttctttatgaaatcaggcccaagcatgtgtaactgtataccatgtgcaggtgtgagttcagctcagataaatgccaggcaagtttaagatgtacatccacaggccaggaaacaagtccaggtcatggtagcatttttatagctttgattttttagggtttggtcacctgtcagacttacatttccaagataaggaatatgaagtttgtagatactgttcctaaacaaagaagtacctttacttctcttttgtggtttgggatgactgtaagtaaacactaacttaggttgatgaagcaagctgttttaaaattatcttcattttacttttctgtatatagtttttcattcatcactcagcatatgccacttatattttatacatatacatatgtatatatgcacacatacatatatccacacatacacatacacatatacacagtcacacattccttaggagatttcatcattgtgtaaacatcatagagtgtatttacacaaacctagatggtacagcctactacacacccaggctatatggtacctaggttagaatcctatataccatgttactgtactgaatactgtaggcaactgtaacacaatggcaagtatttgtgtatctaaacatatctaaacataaaaaaggtacagtaaaaacatggtataatcttacgagaccaccatcacacatctttataaggtacatgactctttgtgtgtgtgtgtgtgtgtgtgtgtgtgtgtgtgtgtgtatctgtagaagtatcctgtaataatcagagcccaatagctaattaaaacaaagaaaagccattggggtggtaaatgaaaagccaaaagactttggaatgtgacagccagatttcaggtctaacatttatttagcagtttggcaaatgatcttacacaaacttcctttatttttggaaatggagactcgctctgttacccaggctggagtgcagtggtgcgatctcagctcactgcaacctccacctcccaggttcaagcaattctcctgcctcagcctcctgagtagctgggattacaggcacctaccaccatggccagctaatttttgtatttttagtagaggcagggtttcaccaggttagccaggctggtctcgaactcctgacctcaggtgatccaccctcctcagcctccgaaagtgctgggattacaggcctaagccaccacacctagccttggacaaactttttaatttcaataagtcttgatgtctttgtctcctaaactcctaaatgaggctaatgtcaacatatatacactcacataccatatagtgaattcgtgtcattcacaatggttatgttctctaaaattttcatgaacagtacaccaacttaggaaatgtgaaattattgttcctaggggacatacagagttaggttcctgtgagcctctggtcacattttcattaaccagccattatataatcttgttttatgtgtatttctatttaaagacaccttacatttaacatatactgttgattcattcacactgacctaacagccaacagcactgtaactcatcctgaaggaagcttatccgacacacatgtattttatctgtagggcgcatcacagcctgcatgtggttaggaacaccagacagcacttaagcactacactcagggccatgtcaaacagtgaaatcaccaacaaaaagcacaaaatacaaaaagcatatcactaaatagaccacaaacaggatactagtttattgcatgaaagctaaaacaacaaggcacagtcagtgctgccttgctccatctcagctagtaacgtgaaccttgggtgactaatttttcaccattccatgtatgttcacgaatgaccacaaaagtgacacaagtatggatttttgggttgcaaatacatttttgtgagtagaaaatttgcaaatgcagaatctgcaaataatgaggagccactgccctatcgtacacacacacacacacacacacacacacacacacacacatacacacacacatacacacactcttaaagtacctagatacagtgcccaagtattatgatgtagaaataattaaagacaatatggattatgtatcagtatttagattacataaaacgtcagggtcactttacataatttgaagaaagggcaatcaatgaaagctgtgagacatgattctatggaaactgaatgtgactcatactctaacacagtgatacaacttaaatagttagagaggcatagggtcggtgtttggtgaaagagaaaattttaaaaggctcctagtcaagagtaagttttgtccttacaggtttataaggaaatcagtttgattataatagagaaaagctttttgagagaatagttgaataataggattggggagaaaaggagggggagaggatgcttggaaatgagacaaaaattcagatacaattcactcatttgttcatccaacaaatgttttgttaaacatggattactggccatttgctgatctagctaatggagtatggaaaacaagacaaagttcctatattccatgaaattatattctaatgttggtaaacatgacaaactccaaatcaaatctgtaagtaatataaggtattagtagctggtggtaaatgctatgaagaaaataatatcatctgatagagagtggtgtggttaggggcaatgttagatgtgctaacaacagagtgaggctgagtgaggaggtggccattacagcaaaggccaaatgatgaggaggaagtagctgtgcagtggtttggggaagagcattcccagcagaaggactagcaaggcaaatactcgtggcagggccaggcctgccttgctggccagctgagggagggtctgtggtggagcatagtgtctaaaagaggaaggctagcaggaaatgagatcagaaagagagctggaccatagagggtctttctaggcataggaagaagtttggattttattctaagtgcactaaagaggaactgaagtctagacgtaggggagtggtaggttctgatttacattttagaaacatcatcctgactgctgcaatggagaatgggctgtggaaggaaggagctaggagactagttggaaagtctttatacagaaggaaataaaaatcaggaatattttgaagggattgaatcaggacttaccaaaagcagtttttacggtggttcagaaactaccacagatgatgggtcagatgccctgaattcagtgcttagattttacaactttggaactttctgggaaaatcattccaactttttaggcctcagtttcccccagagataaggtgaggagttggactcaatgtctcttccagtgttaaagttctaagaattcaattaagatacagttttcagaaagaaaacgttgtcaaggcactcagtggtagcagaaatgacaagagaacagaaaaaagcacctctacattttgtaataagaaggttgttagtgggaacttgagagctgtttgactaaagtgtgacaatggtacccaaattgtcagtggttaagcaaaaagtaaaaagggagaaaatagaggcaattttctcagatgctcatttgaaagtttggcagggaaggaaatctaaagaactgtagctgaagggcattgtggaggcaagtggaaacctttttcaagatagaaaaaaatgaggttgtctgaagaactaaaaagaagagggagcaccagagagagtagcaaaggtgggaatgtacgaagagatttctaaagccaagaaggcaggggatgaagggcactgatagaggagccaaggtttggaaaatgcagctccctgtaaaatatcactgacttatttacttatttattttgagatggagtctccctctgttgcccaggctggggtgcagtggtgcaatctcggctcactgcaacctccgcctcctgggtacaggcgattctcctgtctcagcctcccgagtagctgggattacaggcaggtgccaccacaccaggctgatttttgtgtttttagtagagatggggtttcattatgttagccaggctggtctgtaactcctgacctcaggtaatccacccacctcagcctcccaaagtgctggattacaggcatgatccatactgcgcccatccccctgtaaaatatcacttacagtttaatttctcagttagcatttctaaatcattagtgtctagcctgaattcttagagaacaaggaattgagtacaagcagctcatttgggagatgcaggaaacaccagtagggaggtagggaagtgactcaaggaaaggaagaattatctgaccccagggtgagagagctgaggtgttggtgtcccaaccctggaggagtcattagttgaggccagctcttgaggcattcatttcctggctcttctagcctgctggaggcagtgaggctctgtgtagttctcaagtaaaagtgctctctgacacagatccttgcagctggaagtcgcagggccactttgaatggtcctggggtgcaggtactgctgatgtgctcgtgacaaagagagtttaaagctgctctgatgtaacgccacccaggaccaaaagccacatccgcatgctgctcacagactagtcactgacctaaaggcatacttgcctgtgctctacatgacaaaatgccctgatgcaaatccagaaggtggggttctctcttgtttcttaatcatttaagattaatcttttgtttcttaatcatttaccagtgagagcattagaatataaggtaacattgagaaagagagaaaatggaagggacgtatttagagtaagtgaatgagcaaaagaaacaaataggtggagacagaggtagaggaaagacctgagagagcggagagaaacgtggctataccctatccacagatcaccatagtccattttagatagactagcagttggatttatcctacactcataaaaacacgacagtattttttaaaaaatcaagtgtatgggttctatccaaaaataaataacttattttaatcagaaaaaatatcacaaattttaggtcctttgccaattaagaatctgagatatacacagcaaaaaggatatcagacagagaggtcaaaaatgtgtagtgctaaatactgtgtatttgtcttacgaacctccaaaaaggaaataagaaaaattagccaggcccactcatgaggatgtcaaagttgaagagaataagttgattctagaggtgacctgttttcatttttatggagtttaatcaagagtgaattctataaaagtgaagctaccatacaaacaactttcactccccacatatttcatatatgattgagaccataagcttgtttacctcaacaaataccagctagaactcagaaagctaaagatttaggagctcagtttgcatcgaagggtttatattaaatttcaccttgtcgctacataaagcaatccttagagctgtaagtttccctaagtggtatctagggtaatgattcacctttggcagagcactcaccttttgttctcaagcagtcaacatcatcaggcctatgtaaaataacatcaatcaacacaaagttctggaacgcatcaagtgaactcagatgacagcccaggaagcttggttagtcctaagagaggacagcatggctcttcatggatggccagctgctgctcagtctatacccttccccaaaatgtgtaaatgtgacttctccatcttctagtcactggctttccccattccaggacacaggaggactcaatcaatattccataaggttattttgtaattcattaatcaagctattcaattaatatttgctgagcagttcctacatgctaggcgctgaggaatatgccaggcatacaaaagtgaaaaatacacgtgtggcccctgttctcatggagcttacagtcttgcagaagaagatagctattaatcaaaatgtcaggagcaaacataaaatagcactgtagtgtgtcctgtgaggaagagtttcaaggtgctttgagaacagataatagagcgatataaatgagaggttgggagaggtttcccagaatgaggtgagatccgagggcacagtgagaccaggaaataaccacgatgtgagaagaggggagggcaactgagaagtccaaaagtaggccagggtctctggggagggagatgaggctggatgggcagatggggctaggccacttgtcaaggagttttgtctttaccctcagggaaatgagaagtcactgaatggaatgccactgactattttcaagtatggcagcagtgagggtaacacagtcagatttgagttctgaaatctctctctgatatggtgtggatgggttgggggaagttaacacagatgtcagaaaaacaagatgctgctgcaataggctatgcgggagttgaaggaaccattattaaaacaacagtctcacaaaatgagaacccacagtttgtaaggcgttccataattctgattcttcagtatgtacttcctctaacagtgacaagcaacatttccttatttcaatgtttctcagagagtgggccatcagccaccagcatcagagttgacaggggctgggggaggagaagaagtacggcttgtttaaaacgcagattcctcggtgcactctggccctagtgactcacaatacctgggagtggggacaggaatctttcattttagagaacactacaggtaattctaatccaagactaagtgcgtctggacaaacacacttgagcatagaacataaatcacttttactttagataagcttttgaggttgcacatttgatttaatttctattattaacaagtaaaatgaacagataattaatcatccaaagcaacattccctggagagtaagagtgggtgtggccattaatagtatactggaacagtaggtgtaaccaaacaagctgatacacatttacctatagcttgctaaccctacttcagtaatagatgtcctatgcaaactactctaccttcaagtgatgagagacccctcaaaatttatatttgagttctgagactctggggctcactatcttatgattgttccttttcatagaagcagatggtattaacagcctgtaactactttcagtggcttctagagcaaagggcattgaggctccaagagacaggttctatgtttgcaacaatgaagggaaacatgtctacaactctcttgcttagaaagccttagtaatttaggctgggcgcggtggctcacacctgtaatcccagcactttggaaggctgaggcaggtggatcatgaggttaagagattgagaccatcctggccaccatggtgaaacaccatctctactaaaaaaaatacaaaaattggccaggcatggtggctcacacctgtaatcccagcactttgggaggctgaggcgagtggatcatgaggtcaagagatcgagatcatcttggccaacatggtgaaaccccgtctctactaaaaaaaatacaaaaattagttgggtgtggtggcatgcacctgcagtcccagctactttggaggctgaggcaggagaatcacttggacccaggaagcagaggttgcagtgagccaatattacaccactacactccagcctagcaacacagtgagactccatctccaaaaaaaaaaaaaaagctttagtaatttaaaaacaatgcctgcttgccccttgttttaattaaataaagagagaaatctgcccatcagtgtcccaaatgaggtagaaaagtggcaacttgttgtcacaataggctcacaatttctctcctaagaaaaataagaagaaaagttggaacattttcatcccaactccaatactcagttccactgggtggatataattgcctagttttgtgtacaaaggcttaacctcaacacggtggcccttctgccttctacaccgtcactggggagtgactctaggtctgtctgagtctaggactgtgaagataactaaagaatcccaaattatggcagaggggataggcagtatatatcacactcggacacaccttggtatttcatttgacagtcaaccttcttgcggatcatcaagcaccgtctcactaggatctaaaagtctattcttctccagggtagagacatctagccccattttcagtaagccttagaacaagtagaagaaagaaatctgcattccctcctagctctgccactagccagctgtgtaattttagttatcacataaattctctgtccctcaatttcttcatccataaaataaaatgcacaaacatagactcactcaaaggtctcttctcactttaaatttatacaactttgatcatctgtaaaaactcaaccttgagaaataaatacttaaaacactgctgaagttcaggggtttttaatacataatttcattaagattagacctgcctagaagattccctgcataataaaactttcgtgcttcttttccagaagtgtatttctatcttcccatttcctcaccttcttggaaaaaaaaaaacacaaaaaaacaaaaaagaaaaccttctctttttgctgtgtacttttcttgggccctaaggttaaagctacctgtaagaaacaaaaggccagtgagagtttagtgaaagatactcctaacactttccaaaaatcatgcctaatataagccctttctaatggcatttgcttatgggaaaatagtcccaagtagctcttggttgcaaggccttaaaaaaataaagacaattcactcatctatttttattattactaactctggtggtggacacaaagcatccatgtagtaacactgcacctatcctgacggtaataacagctaccctctgtttccaactcactcattattttctgatggggactatccttaaatcttagcactgtagggggaaaaactctaaagtacttagttttttaacttgatggcaaaatgaaattacagggatatgaagaaacatccaactttaggaactagtcatttgtagaagttaaaacagaacttgttcattttgaaaatgtaaccatgtgtcaaatccacctactaattcatagcaacaatataaaaagctataatttaggactgttcacatgaggcagagatcagggtggtgttaaaatgaaatatgctctttccagaacacaaaagacataataaataacgattcatatttgtataacatctcagggttaaaccaagtgagttcagacatacaattttacatatggcaagggcgatatagggcaaatattctggactccctttacagacaaggaaacagcctctaatgggttgttaggtgacccgtttaatagtaagtggcagagccagaatttaaatacagttccgattttggacgtcatgctctttccacagactcggtgacctcttttggactttgacatgcatgtacagatctatccctaacggtagtaattctatctgagaatctgtgatctttagccaagcgtgaaccatgctactggcagcgtttctcccaaggctcccaggccattcctctacggagttggtgtttgtatcagaaatgtcagatctggcctcaggtgactactagcagaatagttttaacaaaccaccaccacttccatagttaatgatgacacaattagttcaaaacataaacacataccataataggagctaaatggaaatgcagagaggccagccgtctggctgacagctgctccagcgtgccctggttgtttcagcttctgtgatttatttactcatttgttttctggtggtgaggagggtgtgcaaaatatattgtcactttagatagcacttcagcaaataccataacaacattcccagggattgctagcagcttttgttcagcacaagcatactaaattttaaagagggaaaaatagcgtcagataaatcacaggattttaaaagaacatcccaatttgttcacagtttaacagtactactgtcaggcaaaacatataaaactcttctttttcatctctggatttgacttacaaagagaactaagcacatggtaaaatccccaagattaaatgtgtatgatggataagagaacaaagtgttttctttatgtctgtaatatgaacccacgaccactgacatatcaatccacatctcctccacattactcttcactcaaaaccctcctcaacattgccgattgtcttccatattgaacagatcctgtggagttacactaataaattttcagatgatgcttttattgcctgctccatctatcggcaacacttatttccctaaaaaaatagcctcaattctaaaaccactttacataaagggaaactctactgtggaatagaatggtgtgaaaagttcccctagaatttcattaaaggtatgctccaggtggctggacatctaagaaaactaataacagaaattatgtccttgtagcccacgggtagttgtttgagtataagctgggcagatagaaaccaaaaacagaaagtaagaatgccatgtagatagggaatttcagtgggtaatagttaaacttacatgcttaagagtcagagaaaaaaaaaaaaacctcataacttaaggttgaaatttgcaattcaaattcaatccccctttatcctgttttctaaaggaattcacagggtagggaagctgagctcatggacttagcaagggccatcccagaaggaactgacaaccccgtcactgagttgtaaatggtaggtgggtggctagagtattgctgtctattgtactcacttacagcagccatgtgtctgagattccctggcagaattttaatcaaaataaatttaagccaatataaaattttctacccattttgtcacaaatggatgaacctggaggacattatgttaagtgaaataagccaggtacagaaagacaaatatcacatgatctcaactacctatggaatctaaagaagatgaactcagaatcagagagtagactagcacttagtaagggtttgggtggaagcagcggttgaggagatactggtcaagggatacaaaatttcattcagataggagaccagatgcagtagctcacatctgtaatcccagcactttgggaggccaaggcgggtggatcatgaggtcaggagttcaagaccagcttggccaacatggtgaaaccccatctctactgaaaatacagaaaattagccgggcatggtggcacacacctgtaatcccagctactcgggaggctgaagcaggagaattgcttgaacctgggagtcggaggttgcagtgagctgagatggcgccactgcactccagcctgggtgacagagcgagactccatctcaaaaaaaaaaaaaaaaaaaagaagaagaaagagtaagtatacttaacaatgtatacttgaaaattgccaaaggcatagattttaagtgttctcaccacaagaaatgataagtatgtgaggtaatgcatatgttaattagcttgatctagccattcacaatgtgtgtataattaaagcatcatgttatatataatatatatacaattttattttttcaagtaaaaattctaaaacaaaataaaaaaaattctatctctgttctctagatgaccgaggtgctcaaatttttgtttcagaaaacacggtcaatatcatatcatttttgtgtgtgtgtggcaattgctggcaaataaatagttatatatcttctaagcttattaaaatgaactgattaaaaagcaactgcttctataaagaaagaattctttcagtgtttaaatgaaataacaatgataataataatacatagctcctatggagaagggaacttctcagtccaagttcagtaagtagatactgtatgcaattcaacaggtcacaattataatgtaagactctcaggggcaggaataatgttttctatatcacatccctatcaccacacactgcacaacacagaaggcattcagcaaatgtccaatgctggtgaatatgctgatgctttacctctgatgacactgggagtgagagtactgctgaactacttaactattcttaagtactttcaacagaaaacattttttaaacaagtattttggcaccatagacataaagcaaaaaaccaataggatatttgcacagaagataaaagcaccactaaattgattttctctcttagaaaatgagattttgcacgcttatcctttaactgacaccccctgccacatgcatcttctcacataggagcaaatcaacttttaagccataaatagttgtcttccctaagacaccctgggaatttctggtgactcaaagactaactcccaatcaaggtactctattcctcccaccttcttccaa

SEQ ID NO: 2476 - DNA, 10109 bp, Homo sapiens
ggtcagtcatactctccatgttttatatatttaaactggccatttcaagttgtcttcagatgtgtaacctacttcctgtacagaattaattactgtatgttgatacaacattttaatcaccacccactctggacttttagaggtagaagaggagagaggtgtagacaaccgtttccaaggtatacagcttggaggccctgaaggctttttctttgatgtgaactttctgtttcactgactcattcttggagaaaacattccgaagttgtcgaagagggcagctgggatctctgcagctgtaagcatgaatatgtagctttacgatgcttgcacagatactgaggcacaaagaaccaggataatctgcttgaggagtggcctttttgatggcagaacaaggtttttgtttatttgtaggaggcatattttatttgtagcaatcatacctatacttcagaagcaaatccttcttcataataccatcatcaaagatgggcaaagcaatgatgctgataaagaagtaaggaaaaacacaacttcttttatcactaaaataagaaacaaacaataagttttacttggattgaggaaaggaatcaaatccatttacatgagtataaaggttcaagaactgaagggtggttactgatttataactttgtaaaattgcccatggaagagagggtcccatttagaagaaataaatttgtttctctctgaaatagacacattcaccaaacacatggatccgataaataccaaatcatggaattgatcattatatcattccttaacctttgcttcaacagccacaaatcaggtcaataatcacctagcctagtgttgtcctttgtcacagcaagagcacattaaactttgaagaggaaacatcatagagtttacaatagaactgcaggactcatactaccaaattatctgtatcatgcaaccaacttagcatcattatagtttcatgagataaaataaaaattgctcattcattattaataatctgtttccagcacacagaattaaaaaacaaatacctgagaaaagcagaaatgctgataccctaaacatttatttaagtcaaaaagactcagttgagtttaaaatattgcatttcccgtctcctggtagcacggatcactgaagtgctttgagaaccccttccttcctccatgccacccaaatgctcccagtgcctgttgttgctattaagccagagataaactcaacatcagggttatctatcctgagcactgatggactcggctccaaatacaagcctgtcaagtagcttgtttacagcaagtcttttaaataatgaaactgttccctctaaatacctggccgtcagggtagcatgctcatttcactactctaatactcctgcaagactatgagctccatgggctccacaggaaatgataatgattttgctcatcaatatagtcttagaacccgacacagtgcctggcatatagaagacaatcataactattcatggtgaatggattatatgttaagaatttctccactttatgcatctgcacaatatcctatgaaatggggatattattgttcttttatttctacatttctggggattcaagttgcttcttttgtagtattttaaacactgctgtgatgaatatctttatttttgtgatctctccatatgttagattcccaaaaggagaattaatgggtcaaagaatcagaacatttttatagctcttgacatataatgcaaaatgacttctggaaaggatggaaaacagcatagcaccagcaaaacacagaaaacagttttgaccactttcccaggcataccagctattagctttttaaaagagatgataactaaagggaacaatgaaatattacctaaatatctgttataaatttgtatgactttaatgtggtaaattggacattttctctgtttatttaactagttagattttctgttttgcatatcaaccaaggaatgatttgatgtggcttctgctgtgtgaatgggaaacctttcatagatacttggagaaactttgacactacaacttctctgccaatttgataccttttactttgaatattcctcaagagaatgacaggaactttgaaaactggagtttaggtgatacttccactgttccagggatctctttattctatgtatgaattccaagagaccaggagcctcttagatagattacttacatgtgtgttgataaatatcttcagaggttttcacatgggaagaattagtgagttattttgcagagttgggccagttttacaggccaataaataatgagctaaataaatcacagtcagggaccagcctacacagagaaattgtatacctacaaaagttttagcagtaatgaaattgaaagctgtcaccaaatcctgttatctgtctggatagaaaagtgctcaacaaaaacactgatagcgtaggagatagagaattgaattaaggccaaagaaacctttcagtgaatggcagattgaagacaataactgagtaatagaataaaactttctcaggaacccaagtcttaataaattgctctgtaagtactttgggactacagatctatctaacttctttaagttcccagggctcaaggacgtttggttttgggaggaggcacctttaggatgtacaggaaacctgggcaactcataatagggcccaaggtggaatccagttcgtgtagtccagttaagtttggtattattgtgtaaatacttatacatgatttccagaacaaagcattctctcattgttccagacactcattgcttaaatacttggaatcaaaaaaaaattctaagaatgcttataaaaatattctagaataagtatttaaaaattctcaaggataatccaagatatgtttagtgagcccagtgtttacctcttccttcctttctattttgccaggtgatgcttgatagcaacataaaggttacttatctttaaaaacgctccttttcaagaaggattagtatagagagagctaaatgttaactacaggtaaacaaataactgcattctataaataatttcaaggaaagttttcttttcatgtctccctggagatcgtacttgagtcagggagaaaaagtaaagcagtaaagtcaagaacataggctgaagccagagggcctggtcaaatcccagttctatctttactcgttatataatttgggatgaaccattaaactctatattcctcagtttcctcatctgcagaatggggtttatagtgacaatatctatctcatagtgttgttgtaaaaatgaagtgagttaaatatgtgaaaacactttacaatagtgccaggcacatggcaaagtgtattttccattctgatattatgaacatcttaagagtagtttataaaactgtactgcccagtacccaacatcattccagcacatagtaggtgattagtgaacaattgctgaatgaatggttgactataaaggattttccaccaatattttttttaaaggaccacatttctttgtatcttcaaagcatgacttaattcaatacaggactgacaggtaactttcagaaacaattccagggttcagagtatgcacacctgtacgtatcagcagaatgaataatgagagagcaatgaacaatattagataaaagctaggagaactatagaagacaagtaagagtcttaacccaaatccaaaagactttgaattaatgcaagtattatttccttggcaaagccctggcctgcccttctaatcttcactgataaggccatgactattacaccatctgggataggtcaagattaagtgaagattctgatctcatcactaactactcttatattcaagtgggggttggagagtgggtgggaatgtttcagggagagatcttctaatgacagattcactcatgtaatgctcaggaggtgatttaggcctacttaatctccaggacatctgaaacaacacaatttctggaacaacttcttatcctggaaaatcccagacgagtttaattatttttttaatccctgtgtttagtagtcatatcactcaccactgaaatgcagttcttgttgctggagtaaaagagagcaatgtttttaataggtaccaaagataataggatgactaggcacacagctcacgtcactgaaaacggagacagactggctctaccaggttggaacgaagccagtctctccagggctcactgtactctaggtatggcatcatcagctcccctaccggacagtgatgaggtgagagagtaggcaagagaaagagggagagagtgagtgattaaatgaacaaatacagcaaagttagagaaggtgctggcctacaaaggttttagttaaaaaaagcagggaattttgcattaatgaaatccactgaataatcggtttaatttgagatatccacatgtggctagtggctggcatattggacagggaaggctgggtgagttcacttgatatctctgttctttttctatctccttcatggtgttctcttctctcacctgccacttccatgtcggggttcctttttggttccctgcttttgtgactctgctcactttccatggctgaccttgagtcacctcacattctacgcgatcaaaactgaatttttcgtcttcctttataaaatagttactcttcatgaatttgttagttcagtttgaggcattatcattcacccagaccctcaagcagggaactatccttgacagctcatgcccctccatcccatacatgcaattaattttcaattcttgctatatttaccatccccccactccccaaatctatccatgtagcccaactacaagtatcttctccaaactgtcatcctctcttgcctgcattccacctaacattcttctagtgcaaggattctcagttctggctgcctgttagaatcaggtaacggggagtttaaaatatggccagaacctggatccacctccagagatgcggttttattcgggatggaatagagaccaggcatcaccattttttaaagctctccagatgactttttcagagtcagactgggactcacacatctagctcatcttcctggctctagtttttttgcacctatggccacaccataaagaagcaccacagggctctttacagaacattcacttgtccactctgcctaaaccctttcaatgacggaccacaatctagaaaatgaaatccaaattctttgacattccctggcctttctagtcatgtactgacattctcggcctcacagctagttccccacctgcaggtgccttttcctacctgtgcttgtgacctcttctttgctcagatccccactcttcacctggggaacctctactcatcctgagagactcggcttcggcgtcgcccttctaggaaatctgttctcacttgcttatgagaacagattctctgtacattgaacatcctgtgcataattatatgtatgatacatcacgtgtatgttaacatgggtgcctacacctggatgccccgttgcctatgagcccgttttctcagagcatgtatggtttatacctgctgtctcctttaattattaatggtgctcccttgagtctcaagggtatctgtgctaccatagatgataaattgcagattaccctccttgtaagattgttgaggtcagtaacattgtcgtatttttcattgggatctcagtgcctaacacttcttctaaaacttggtgttaatttatgtgctcaaaaaaattaatgaaggtgctgggcacggtgactcactcccgtaatcccagcactttgggacgtcgaggcgggcggatcacgagatcagaagatcaagagcatcctggctaacatggtgaaaccccgtctctactagaaatacaaaaaattagccaggcgtggtggcaggcgcctgtaatcccaactactcaggaggctgaggcaggagaatcgcttgaacccgagaggcagaggttgcagtgagccgagatcgtgccattgcactccagcctgggtgacagtgcgagactctgtctcaaaaaaaaaaaaagaaggaaagaatgaagtatttacctgggaaactatccttttacctccagaagcacatggtaactgttagaaaggctggcgtaaaaaactgaacaaagaaacaaatggacacatagccacttgtaaaaaaacgtgattttagagagtaaactaaagccttctttctcagctgaatattactttttgtacttttgtgtttttcccgaggccctactgatgttggggaagttccacatagtcatcaggtaggtatagatgattcctaaagcagccccagccagcgtcagttctcagaagggcagctctgctttttatggccaaggatttagaatctgatgtcagacttcttgcatgtgaattttgctcctccactgggaggacatttgacttcagttaagttatttaaactctccaagcctgctttataaataaggatgttaaaagtgcctaccacatacagttcttttgagaattaaataaggaaatctatgcagagagtttagcatggtgcctgtcatagagaaagctctgaatagagtagcccttattattttatctattttacttgttgaacttacaaatatttcatttgaagaagggatttgcctgcatttaaaaatactttgaaaaatcactgttccagaatattgggattgtagagattccaacccagttcccccttgggatttttgtaacttgagttgctaatggagccagtgttatttctttcctctgcaattcagcaacctaagtccataccttgcctgttcactagtacccattagtggaaaagaaaataccaacccaggactcatatttcagtgtgagccacaggtgttgttgggtgccagcttctggcagcatggcatacaaacaaatgaatgctcttgccaatgttgggaatattactgcagtatgcctattacaaatatttacttttttagctggaatatcaggggacactagggtttctgtttgaacagtgctttgaggcagaactcattgaaacaacatggaaagctttgcataaataaattcttttatgattatacttgtaacacatcgtatcatcagactgcaaaataaaacttgagaggataaataatcccagttatttgcacataatgctagttactaatacagagctgtagataacttcgcataaagtataataagagatatttcatttttggtaaaaggctcctatcaactagcattgaaaaagcaatataatttgtgagttacaggctgggggttatagacaatgcctttggagtcaaagacacataggtttgagaaaataatgcacttaagagtgtctggcacctaaaacaaatgcaacaaattgtaactcagagtaagaatattaataataactagtattaatatattattctctagggatatttgatatagttctaccaaacagaaatgattagattatattttgttctatcctatgttattttttactgctgcttttgtctgtaattttaaatcaaccccaaaatattcacataaacttaaaacctgacttcaataatttcaattttctctgagaagttggtggatcaacacagaagtgtggaaatgaaattgaggtgtctgcattttcatgaccagcaggcatgataacttgtcctaaaactgtttgatcttgttacaatttctgctgaatactttgagtcatgcaagaatatagaatgccttttattcaaaagcttccaaaagagagatagcatccacagaaattcagagtgagctgctgaaaggcaatattaatcctgatctcgggatattacgctaaatatttgacaggaatccaaattttcctgtagccttccactaagaagataatctttcataattttaactgtgaaaggggaggatttgatcctttgaaatggaaagggtgagcctaattgaatttccttctttggtttcttattaaagatgggaccagattgaatcatattcaattaatgattgtacttggatatattgctcttttcagaagctgaaataagattaacaaagcttgaaaaagatgtcgggggcaacagtgccaattcaacacttaaagggctaggcatacaaaagagcaaagccctatttcaatgccgtttatttacatgatccttgagcaggctgggccattgttcttgaccaattcaaggactgagtagaaggttgtgtgaccttgaacatcagctatggaggcaaagtaaacatacaaatgtacatatgaatatacatacatggaaataataattaagacataccattctgacctgccctctcttctgactacacaccaaatacaccatgatccttgtcaatgatgagtcagtatacccctataatgtctcatctaggcctacccaaccacttttctgtctgccttcattgctcaggttaaagaatgtcttcttctctaaggttttatgcaagtctagtaaccatggaaccatgttttatggactaataattgtgatacaaaatataacaagtaaattagcacaattactctgaagattttaatactgggactgtccaggagcacaatgcctacataattagtctccataaaattctcccttttgtaagcgttcctcgggtatgttgtttctatgttaaacattaggatttaccacaatagacctcacattatttgctaactgtctcatgtttctgtttgtatgatatactgcttcactggtgactgtgtaaattgactagccctttatttcttcagtgtctgcatagcacaaaacacatagtaggagcttgattggtacttctccaaatgcagttggtgtgtgtgtttgggaggtgatacaagtttggaagataaatctgaaattagtatcctagctctgacccttgacatctgtgggagcctgagtacgtttccacatttgtagtataggcataaaaatacaaatagtacatgcactgtgatgatattgtaggacatttgtgcagggactggtatgcagtaggagctccatccacagtcattctgttgttgaatgaaaacactggcttaagaatgattttagaaggccaggcccagtggctcacacctgtaatcccagcactttgggaggccgaggagggtggatcacagggtcaggagatcgagaccatcctggctaacacggtgaaactccatctttactaaaaatacaaaaaattagccaggcgtgatggcgggcacctgaactcccagctactctggaggctgaggcaggggaatggtgtgaacccaggaggcggagcttgcagtgagcagagatggcgccactgcactccagcctgggcgacagagtgagactctgtctcaaaaaaaaaaaaaaaaaaaaaaaaaaggaaagattttagaatatgagaggcaatggagtatggtgctcattggcttggggatcctccatcagactgcctacatttaaaccccaattctaagccttccagttgcaagggttaaatgactgaatacatataaatcccctttgagcgcctgacacagacaaagatttagcttcagtattattaaggatgaaactacttgagacacacaaatgaacttggtcaattttcaaggtcttttaaaactcttaatctatattcctgtgaagaaataatacatgttcttgcctttaaagctccacatattagaaaacacaggattattctgagacagctctcacaccctacagacacacacactcacacacacacacacacacacacacacagagcagcagcagcattgtctaggtctaattttttccttcctctgtcaccctcatatgtgtgctaattgtagtaactgtgagtccaatcaatatatgttctgtcataaggagagaagaagctggactaggaagatggagttgacgctatacctgacattcagtttgaaacactgaatattagaatgttagtcttttccagagggtctgaataaatgacttgtctaaaatagattcctgaggaaaagatctagactca

SEQ ID NO: 2477 - DNA, 69573 bp, Homo sapiens
atatctggatcatctagatttattatggatccaatttcatcaaattctctatttgttgtcaattgtttattaaaaatctttttgaatcaagtgtaagacattacatattaaaaagtacagagataatttaagaatctggaggatgatattttattccagaaagaatgtgtttcttttccattttttgcaggccctttaggttaggagcagatcaccttaatccgagtagagatgatgtttattcaataccgggtttctgcctttgtgagggatggtatatttctggtttgctcttctgtttaaggcatagtccttcaggatcccaactgaatgcctcagggcccctttaccttggtagaatataaacggcaattttgtttctcaagccctgtgaggctgccatcaactctgataagcttctcagcctatcacctatagcttttaattaatttttattgattgattcagacagtcaatcaataacagctgtaataatagctcaccgtaatcttgtgaactctttcacttaagtgatcctcccacctgaacctcttgaataggttggactacagctgtaagccaccacaaccaactaatttattttttatgttttgtaaagatggggtcttactatgttgcccaggctgattctgaactcctgggctcaagcgatcctcccaccttgacctcccaaagtgttggtattacaggcatgagccacttcaaccagcgtactcatagcttttcaatgcagaatgcctcaggagaagaagcaagaccaaactgtgagctcatctgtccaggattccattctcttcaaaatcttggctcacatgttttctatgtgttgttagctcttgagtgccctagatggaaggtaggtagttgtgtgtgtgtgtgtgtgtgtgtgtgtgtgtgtgtgtgtgcgcgctctctggcagaaagttaatctgaagctagtcagccattgcctgaaacgttttgcttgatggaaaaaaatgacagaatacaaaatatttttagaggactattaatcaccttattgcatatatttaggaaacaaaaaatatatatgtatatgtatacttatatatgtaattaaatatttaaaaggtataaaaatcaaaataaccccaaagaaaatgtactaaaaaatttaataaagataaaagccaaaaacgaaatgatgaggcagcaaactaaaaatgaagcagatttgatcaataaaactgaaaagctgttcccttaaaaagaaacagtagtaacattgaaaatatttgacaattatagccaaaaagagcgaaaagaaattatactggagataagaaaatggctacaagtaagaaatgtcttacaaaaagtatttgcataaaactccattaataactcagaaaacatagataatattaattatttttaggaaaatttaagcctagaaaattaactcaagaaattgaaattttctcaatagaaaaaatttgaaaaataataaaatatctgtacctgaaagagcataaggaacattttttatagatgcatattaccaaaccttcaaagaccaagcactctccatgttatataaggtcttacacgtagaaatatgaaaaacaggcagggcatggtggctcacatctctaatcccaacactttggatggcgaaggcaggtggatcacttgaggtcaggagtttgagaccagcttggctaacatggtaaaaccctgtctcttgtaaaatacaaaagttagccgggcgtggtggcgcatgcctataatcccattacttgagaggctgaggcagaaccgctagaacctgggaggcagaggttgcagtgagtcaagatcacaccactgcactccagcccgggcaacagagcaagactctgtctcaagaaaaaagaaatatggaaaacatcccaatttatttatgagaattgaataaccagaaaacaaaatcaagcaaggatagcaccaaaaaggaaactaactgcaggctgatcatgatgatggtaggatttcaaaatacaatattagtaaccaaatcttgttgaccaagtgaaatacttatattcagagtgcaagtatctctaacaggatgaaatttgttttggtatatcctaactaagacacaataaagaagaaaaatcaagtgatcatctcattcattgtttaggaaaaaaaattgataaaattgaatacctgattttagagaatagtggaccacaatagaaatagattatcataggaaaaaatgacttatgtaaacaaattttaaaaccataaaatttaaaacctctttgtgactaaagatactacaaagaacataaaaaaaggattggcagatgaaaaaaatatatttgcaaggagggaaaatataagacagcacctcgaaatgcataagaaatatgccaatagataactaaaaaaaatttaaaggcaaataattaaaattttgaataagcttatagaaaaaaaagtttaactttactaagagtcagggaattgcagcctaaattgggacaccattctcacctatcatgttgataaatattaaaaagtaaaaagattaatcatgttccgttttaaaagaatgctggtgaaaggcattcttattcaagatgatgtctaggtgaaaggcaaagttatagcagcacaatttgtaattgcaaaaatgtggaaccaaaccaaatgcccattaatcaacgagtgggtaaagaaactgtggtatatatatacaatggaatactactaagccataaaaatgaatgaattaatggcatttgcagcaacctggatgagattggagactattattccaagtgaagtaactcccgaatggaaaaccagacatcgtatgttctcactcataagtgggagctaagatatgaggatgcagaggcataaaaatgacacaatggactttggggactcaaggggaaagggtgggaaggggctaaggcataaaagactacaaatcaggtgcagtgtatgctgcctgggtgatgggtacaccaacacctcacaaatcaccgctaaagaacttactcatgtaaccaaacaccacctgttccccaataacctatggaaataataattaaaaaaaaaaaaacctagatgatggattgttagttgcagcaaaccaccgtgacacatgtttacctatgtaacaaacatgcacatccttcacatgtaccctggaacttaaaataatttttaaaaaaacaaaaacaaagggtgaagttacttggtctcgtggcatataaaataatagtctgtattctccaagtctttcatttattctttcaataaatagcactttctctttgccaaactgaattaaaggtcctggggaccctgcaagccataaagaggcaaaattagagtttctgtcctcatagagtttgccttctaaggagaatccttgctggtttcactcgattgcagttggtctggtctccccgttgttctttgtcctctgttactctgtcatgcttgcctggattttgttgttgttgtcaatttgctttggtttgttttctagctggtatcaagctgctcccactgccaaagttggtaagccctttcttttgttttacttctgaggtcccttctttctccagcctcttggtcctgacctcaggttggagcttttagtgcatctgtaattgttctcacgggcacagcaacgcaaacacagtaacacaagccatttacagactgtcttagtcctaggcatagaccctgcctctgcccttgcttccctgcctgccacttcccccaccacccccccacccccacgcccccacgcccccacgcccccaacaccactccaccagaagcttaggatcaggcaacagatttctctcagcatactgtctcacctctaacccctcttgggatgggggtcaggactaccaattcgcttttcagggattctggcaggcgttttcactctaatagggattctgcgaagtctctgtggttgaggtgctcctttccttttttgcttcttagaagttgccattgaggtgaaaacttctttgaaaaagttggtctaagaggtattggagaatgtagtgcctgagtaagcagaaagattcaacctgggtctcggggggtcttaagtcaggtctctttatccccttctacataggatttaattgctgcagcctacaataatatgctcattacttgtcacattttctaattgcattttgtaatttatctgtgcctgatgatcacacctgtgcattatggagatataccacacatgcttatgcataggtgtgaacggttacacatactttcttctttctcctgccattcttttgaagagtttctcttatttcacaaaatgcactaggagaagagcatctgggggaagtaaaatgagaggggtggtttcagatacaccttgttctgtacttgtctgtacttaatatggataattagatactctttactaggtactttgccacagggttttcatggattgcatttaattgttgccacattcttatgcagtggctaccctttttaatctctacaggtgagacagaagcaccaagtagtgaaatgacttgtgcaggactgagcttgtgaatgacgggcacagatatgaccaaagtggtatctgccaagcccatatgtttcaacttgagcgatactgtctcttgctgttctgctacttttatgttctgcttctgcactcaaagttataggctttcattttgttagacattataaagatgtaaaagaaatttaagccatagtccaaaaattgagaatgccatatgatatatccaaatgtcataatattacatgactactaaaaagattgtttatgaagagtttatagtaacttgagaaaccaatttttggataaaggtaaaaacctggatccacaattggatgaaagtttctgcaactgctgatggagtagggtttcacctgccatcatctgtagaacaagaaactcaaactaataggaatagtatattttgggtacaataatactattttttattgtcagaaaatttgcatggctttggattagtaccctagtagcacctgttagcttagagtcaattgcagagactgtgtcctgtgagaaacacatgctacaggcccaacaacaggaagaggataaagggatagtggcctcactggagtcatcaggacagccccgtggtaaatgatgtgatagaaaaattctccccatctacttgtgctgagcctttcctttcttggagttgtagtttctcttttgctgagacacctgttgtcctcaagttcttctccaggcctctctcaaaattccatttcaaatacctaaggctaagtgtaaatattcaaatgaaactgtcaaaatttactaagagatataaataaaaccttgcaatagtgagacatactttcttttctgaggtggaagtcttactagttttaaattttttgttcgtcccaaattaatatagatataatatacaatcttatcaaattcccaataggatcttctggaggaagagaagaaatatttaaagttcacataaaagatttagggtccttcagatgatttctaagaattaaaatataaattggaaaaattacaaagaagtaatacctaaagcttacaatggaaaaattaaaaataacacatttatatgtaaataaggttgtcccatgaacaatgtggatttgaattgcaggggcccattaatatgagaggggtttttttcccaataaatacaggggtctctctgtatctgatgtttccacatctgcaaccaagagtgcagagggaaagagcagtattcacagaatatgaaacacctgatattgatggctgacttcttgtatcgaagatttgctttgggctaatggtgggactcaagtatgtgcaaattgtggtattcacagcagccctggaatcaagctcctttgaataccaagaaacaaaaataatttcattaaaagtgccattcaaaataaattggggaaaatttatgtggtaattgtcaccaaaatttaataaacttccttaaaactgcattccaatcttaaaaatactaaaacttaaaaatgtgtaagcacattagtaagaaattctaagaaaaaaaaaccacaaatgcctaattataaaagaaatgcaagcctaagaaaaaaggagtttcttataaaattcacaaagtatataatgtgttacttcagagaaaatatgaattgaaatgggcttatgctttaaattttggtgagataatacaacttggaacaaactttctagaaaatgattagtaatgcatttcagcagcctttcaaaattcttttatttgacctagtaattctatttctaacaatctcttctaagaaaaacaaatcagaaatcttaacaaaaagtcatgcttatgcagcgtgggtttatttaactaaattgtggaaaaataggaagacacttcaatttattaaagtaaatctctataacaaaatgttaggaagtcattaaacagatgctttcaaagaataatgccatggaaaagccttcatgatatgttaaaaaaaataataagatacgatattgtatatttaatttgacctatgtatgacctatatatatatatacaaacacatatatatgtatataaacataacatatgtattaaagagtctgaaggaaaatacattaaatactaagagggatattttgagtactatgattagaagtgtttttagtttttatacatttctggttttgcatattttaagtcttcgagtatgcatttatattcagaaatagtttgctttaatatattttcctaagaaaagtaacagcaatatctaaacaaaacagcaatatcattgaaaatgtatagaaaaatatcatcctttcacttaattgttttaaaggcttcatctaaaggaataacttaattaaaattccagaccttagacggcaggtttagggaattagtttgtcatccaaagaggcttcttaaggctcccagaatcacactacatggcaattgacagtactgccgatataagttttaaggtcaggtcaggatacggttactgaagtctcacttacggacaatgtggggaaatgcagttcaccaatacataggcatttacccaagtttctcaaatgtagtggcagttttagaacacagcaatgataatgggctaggtggaggagactcaatttactcatttttttgagcctgcaaattttggaaaataatgacatggggaaagaaagggatgaacagaagatggaaaaagaaaagagagcaatcttagagcagcaagcaccttgaattgtagtcttgaaggcagcacagaagaattgagatagctgggggaattgtattgtgtatctgaagtacaccagctctgtttcataggccttgtgccatcacatcatctgggttacattacaaaaacactctactcctcacatagcataagtctctggtaattttggtgcaggaaggatgagtaatttttactatatttaattatcattgtggtaagtgttctctgaaagccttgatgtagctgaagcctctgcggtaatttaccaagaagtctttggagtccgcttagaatcttgccatcctgggcccttcgatgaccctgactttttgtgattttgcttaagatatcctatcaggtatctgcctgatgtcatgggagcataaaggcatgtgttgatggcaagaagaccatggagtcttattctctgataatgtttattccacatctgtgatttgtgtcctacaaggctcttgggacttaaaccacatgtgctatatttgcattaatgggaatttaagaaggagaggccataacactattaaaatgtttagctttcgctcccatcacacagacacatgctagtaactactcccagatcttgtatcatggtgctgcaggatgcaacgtggagtgcactcattgtttcaatacaagggacttgaaaacaaatagctgccatctctgtctctgatagtttgccaggcttttaacttctttggtttttccctctccagatcatggtgaggtatctcagatgtattccaaacagcacattgccccatctttgtttcttcttttataaaggaactcttgctttaaggtatatttagaaaacctagagtctaagccaaattctgaagaaccacatgataattctactttcaaatggcaggaaaggacttagtgcagaatcacccacacagggttattgatcacccaggcctaatagtcacaaacgtgacaaatatgctggaagtttttcctaggtttaaatatccaactgttaaattacatatgaagatattttgaagcatcttataaacagagaggcagggagggtgcagggtgggaagagaaaagaaggggaagggaaggagggacaaagggactgggagagaaagagggaggaaaagagaaagagagcacatcaaggaacagggcatgaagatcacatcttcattactccctaggccagagtttttcaaattgcaaattctgtgatcctttagtgggtcacagaatcaatttagtgagttgggaccagcatttttaaatgaaatcaattaaagaaaaaaagaaaccaggatagaagatatattacatcacatatagtaaagggaggtattattaaataaaacttttgtttcaattatatgatatatatacatatataaatgaacatatgcacatggtgtatatatatatatatatatatatatatatatatatgtgtgtgtttcattattatacattgaataatagatgaatttatgtgtagaaagatacctagatgacagaaagagagagagtgtgagagaaagagaaagggggggagagagagcaagaaagaggtactgattggcaatgattacttcttaacatgtttcatgaacaaaaatgtttgaaagccatcaccagattatacctccaggacagtggcttctttaaatttggaatacgttcttcccttagtgcctcctccacctgcattcaggtaaattaacaagctgcatataagtctcatctaattaagccacaaacttttaaagaaaatgttgtggatgaaactcagtgaaatatgaatccaatgctgtgagcctcaagggtagcagattacaaacccaatactggttctcatgatagaaaaatgtcctccttaatgtcctactccccaggatactagagaatgataaatggcacaatagttgatagtaagcctcagaaattgagggagaaacttactatactgatgatctttagatatcatttattcagggattgggattattgtttgagatcatgaaaaaacaagttaatggcaatggaaccatcttgatgaagcaggcaaaaaactatagttgggacaactactatggaaaagtttgagctgataatattggaaggaagtgtgtcttctggacagaatacagaacccaaaaagtaagataacaaaattcagttcaggctgttagggtgtgagttccaaccagaaataacaaggatattttaaagaccattggatgattgctgaatacactgacatgactcattttcagatattcttataactatggtgccttgaacgcaagtatggattatttcttgattacatgtgtaacaattcagatgggtgaggcagatggaaggtggatttaaagaactcagtgaggtgcaatgaggatcagggagatgctctgcagagccccagttcctaaaagggggcctggcaaaaggacactaccagccgagagagtctggtatgtgagataaaccaccagaatagggaaccacaagccggaagcaagaagaggatacagctacagaaatgagctttggcaaagacaggatatccaagactgtgcattctcaactctcaaggcctgagatcacgtcaagtcactttgggttatagcaaaggtctttattcaaataccaagcatctcaaggtggagcatctaacattgaaagcagagaagcatctgttgagttgtgtaaaagaggaaaagatcaggaaccagaaagagctggagaaaccccaggggcccatggaagaggtattcttcttaccaagatggtgtatcatcttttcagatagatgcattgatacaaccttagaaggcagtggtatgttgacagttatggaagttgcaatatagagccagctttaagaggatgtcttccccactgtgacactgtggaatagctcactaatacaggttctcagtgactaatcattgctttcctctttactagtataccaaataaaatctgttttctacatttcataagcctttcattatgtggataccaaaaccctttagtattaacctaagccaattgagctatcattcattctatacccctttattgagagctggtgctattccagatacttggctgaatgcagggacatgtggttttgtggtcagggagcttaatgtgtagaaaggtcaagacactggatgtgtacagtagtgagatgcacaccattatgaagttagtacaaactgctggagggatacctcttttttgacctctagatgttataaaggactttccggaataggcagtgtctgagtagtttcctgaatgaagaggtggagtttgcaaagtccaggagacaatcaatgaatcagtcaataagtgaaatcaaataataacataatattttaagtgctaagtatgtaccaggtattatgttaagttcttctcctggattgtattttatgtagcccttataatggtcctatgatgtaggtattattgtttttctcaggttataggtgagaatatagaaacacaaaaattttaaataaattgttcaaagttatgcagttaataagtagaggaattgaaaaggttagagacagagaaattatgaaatgttttgcaacatacattaaataattgaggttttatccttgggataaaaggaatccattcagtggcttttaagtggcatgtgacagatatggatttaggtagatcatctttctatggtctagagcagcagactccaatacagcataattttcaaatcactcgtggagctctgtaaacagacagactactaggccctatctccagggtctgattcttttaggtcctagtgaatgtgagaatcagacttacaaagatctccaaggacaaagttgatgtcagtcaacttaggagtttactgatgagtggatgtaaagaatggattgtaactataccatctgtcattaaggaggtcagaccagaagtcacattggtccgaattgcaatagagttacacattagggatctattagttttacaaatctaattttttttaaaaaaatgagaaatggtaatataattctggagcgtgtctgtaagggagaagaatcatgtcttacaggaaaatgtttggtaacaccaccatttaagggatgagtgaagggaaaagattccacagagagggcatagggacagcttcttcatgtcctttagagatgctgtatactttccttcctctgaatctttgtacaagcttttcctttcacctgtgttgtcctcttaccctgccttttcttctactaaatctcatccatccttttaggatccttctccaacattcatccctgggtcctccattataccctcaaggaaagtttgatttctttcattgaaaaccattatgtgtcccatcttgaatccttatgtaattgttgtttctaatgttttcacatgctggtcttttctcacactagattagaagcttcttaagaggaagggtcactgctaacttttttgtatacctcacagttcttagaattggaccaatgacaggtattcactaggcacctaaatggttattaaatgactctcagtattgtgtgtgttggctagtgatccatatgtcccagagacacaaaataggcctggtttataccagttgtcctggtgtgttattaacagtgccttttgccttcagcattatcatagtttcaacaataaattatatagtcaccctactgatagtgctaccaatacattttttaaaagtctagcatctttaagtggtaacatttcaatacaaatgtcattttgttttggggagtaaggagtgttaagatatttttgcacacatttggcatggagtgatatgtcattccagatgtctccttattaggtgggtggcctgttgctcaattgacagatgtcattgtctattatagagtcacaggtggtttattttaataaaaataccattaaattatctctatttttctgttgtgctctctttatatatagagagaaatagaacacatatgtacacatgtactatattacatattatatataactttatagtatgtatgtacatatatgatacgtatcactacatcatatgtcactatatgtgatatacctatatatcatatatagtgatatatatatgaacatattacatgtacatatgtactatatgttttgtaaaccactaactatagttttagaaatgtcagatgctttttcatgtttggtttaaagataacccttttgagtaaacagttaggaatgttctccaaacagcagaattacaatttttccacattctcagaagaaaattttcaacattttcaatttatttaagcctctcattcatggaaaaagaagcattactactcattcatgaacatcttaattacatagatagttagtttcattcctaatgaatgatcatgctctttcatggagagcaaaatctagattgtcaagctcttggttaaacacaatttcaaaattatgagacaccaaaagtaagtttgtagtattacacttacttcttgaattatgcagtttggattctataaaaaagaattcactggttaatttccaaatctccacctaatatttgttcctctccccaaagtatataacttgacagcagagaaggaaatagataccgttctttcttgtgagccacacactctgcaagggccattcctagttctgctatttcccaggacagagtatcaggaatcatgtgggaatagttcatatgtgtgtgtgcctgggctaatctgtgtttactagtgtagtacagaggggcactgtttatgtctgagaaaatagttataaatcacacttcttctgatcacaaatactcatttatctttagactatatcaccacctgagttatttttatgtaaatattgcacctcttaaatataatgatgataatagaggctgtgaatccttagatttgctcaagtgttccctttttcaataactgaaaatatttaaatcccagaagctttagcatcctaagagaagtagcagacagatgtgtcaatagagtgagacctacagaagttgtgagtaatgaataagtcagagtcatgggcttctgtaagggaactgcggtgcatttcctaggttggtatgttctggctatgctgcgaaccgtagcccagaaatgactgactcagagagagtcctcagctgctttgctcctttcagctctgtcatcacatagaaaggtctctttggcaaagtgtcggaaacaacacaaggtgggcaagcatctgcagatttcctcactcagtcagaagaccagctagagtcatccagcttctggaaatcagtaaagagaccaactttgggtagcgagtccccaagatcacagagaatctatgttgtggtggcatcaccattccttatttgttggcatccttgtctggaaactgcctcatttggctataatttaacttgaagattaaagcacagattttcatatgtatcttctgttctctgaatgtaaaattatgaaatacacctacattcacttctaagtggcagtattgtaattgagcagatttttgtttttcactgaaacctggagttgaattgtcttgagccggaaggcattcaagttgctgttttttacttagctatatttctctataagcatctaattgtttcaaaaagtgaggtaaagtatgtgaaaacctgaatctaatgcaaataagtctgtacagcactaaagctaacaggtgttctcattaatgtaagcagacatggaacaattcttgaatgttttataaacactcataatcatggccaaatatgttacaatagcataaagatacatactgtaacatcttttattcttgttgtacactctcagtacttattaataggagactagtggcaacaatacctacttctgcttaagtcactgtatcataaagttagctaatacttctaaataaaattaacaacgtaactactacctcctcccacagtttgcttatttattaatattaacagtgttcttgtaaaattgctacaatgctgatggacagcaatgagcatctttgcatcactgagtttctctaaagacttgacccattaacctaagtattagctctttaaaattttgaacttatgttccagttcccatactgtcaactcccaattaccaaagcctatatttagggtgagattcttagatgatctagtatagatgatccctgtaaaatacttgggtggctttggaatataatcaagaacgttctattttagagatatgcattgaaatatgactcttgtgcttcccagcccttccaagtttaatcctattgtctgatgtctaggacttgctgactgctgggaaaatatagccttcagactgccattatcaatcttcaaaatagtttgcctactctactcttatgaagtgttttcagtagacgtcagtattacattacttatattacctgaaagaatgcaattgtattgcagccttcaaaattttatgacaatagagaatgagttaaatatattatggcatatcaaacaatgcaatataatgcattcaccaaaatgaataaagtagataaggtttgtctattgattattttcttagtgttccttatgtgtctgttgttcagccatgcatgtagacaattgtcattggcctcaggattattatagcatagtggggggaatggaaagaccaacaaggcattgcaacataaaccagtttgtgctaagataaaggagaagcaggatgttatgagcgcacttgggggaatatctatttcaaagaagcctttactgaaaaggtgacatctcaaatgatttgaatgatatgacagaggatgtcaaaggggtctaggcagcaggaacaacctgctctaaagtatgggacagctggggaaccaaaaaaatcagtatggctggattgtggaaatgcagaggaaaatgtggagcagcggaagtgcagagtgggtcagtgccagagcacacaggggctggcatgccaaattaaagagtttgcactgcactgcaacagctgtggggagcctcagaatgatatcaagcagaagaatgggatgatcatatccaagtttcagagggatcactttggctgcaatatatagtatggacttgaaggaaaaacatggatgagacagtgaggaaagcaaaggatattatgactaaattctcatgagagatgatggtagtatatatagtaaaaggcacaaaaattttcataataatatacatgatattttcattaaactgtaaacatacataatgtttcctcgtgggtcaaaaaggtatgtagaaagagacaacaagtcagtgtatcttgaaggaagggagattctatgtttgttaatttgaatttattaaaacttttaaaattgagcattacctacataaggacagtaataataaaaataataccaatttgaaaacaatgggggcagcagattcccaagtgtcatgtgactgtgactaaatgagtaattgaacacagtgaatatagctcaggcaagaaggtgatctgtggttggcagggagtgactggtgacaaatcccaggatgattcatttatctacagacaagtacacccccccagtttaaaaattaagagcaataaaagtctaagttgatatctttatacaccaactgctttgattagtctctttttgagtcgtttttcatatgagcaccacaggcaaaagttttggtgtggctgctgcaaaactgtggaaattgctaaactatctactaattacttggatagtattctttcatgaatattgagaagactgtttctcagtacttaaaatattttaacacaataaaaagaatgaacatgagggttttttttttttttttgcttgtttgaaataaattttgggtttagatatttgttaataaacagaaagttagagtgggcaagtaatatggggtgtgaatgttcactacagggacaattttattatgcagaacaaatctctgttgtacgaatgcatggacaaaattatttgggtgtcaaagtacagctcaatttcacttaaaaagcattgtttcttgaaaggttggccttaaaccttagattttggaatgtactggaggtctgtcatgtacgtaacccgacattgtttactttccattaaataagaaattgcttacatgggcaggttattttgatatgatgacaccactgagggttccaataaatgtacatgcaaatcaatcaaccccaaacacattgaaaacatatccaataagcgtctggaaactaatgaacgcacatttgttaacatagggggagttgtggaaatgctgagatccattggtggcctggcttatttagtagcatgtggatttaggaacatttcacggagtcagaagaaacagagtaattataacataaggttcaacatctttagatatgtagaacattttccgttgcttaaaacaaatattccctaagaaagtataaaacatttttctgacttgcaaagtttttgcagtctatcatttaaattacttaaataaagggagctttactgctccccaaagctgagaatataacaccctccatgcatattagcttgatcttcttgacagaccagaaaagtgtttgtgtgtgccaattaaaacaaaaatggatccctagtggcttgttcctcatacaacttttgaagactgctatcattgtttgctagggtaaccctggataaggctgctatccaaagtaaacaaacttttcaaaactttcatgacagatggggattacaaatgcattttaataagagagttgccaaagtaacttttttttttttttttgtaatcagcatatatttacttaacatctagcaacattgggaacacaaggcagatactttctcacaaaatgctttaacaagtaacatttttggaaaggcaaattgaagaccttttacatctaactgatattttacccttagttttattttaactttgctcaacatgttaagagaaatgttaggaattactcaaaccagactgtaatttgagacagacattcagcctgatagtgtaatttctttggtggtcataaacacctttgagaccaagtaatttagctattagtataaccatgacaaccttcatttgatcagctatatgtggagtgatgcaagatgaaaaaaatgtgaatctgtgtgggttttgtaagcattattacttcgattttaggtcttgatatctccctatcatgtgtatattttctgctgggagtactgaatacagatatggacaaaattactatcacaaaaataattcatattcacttcaaataaagttagtgtatgttgatataactttttatttttacttaatttaactcaaatataaaaattatatcatgaagtccaaagtctctctaaacataatagcaattaaattccattcctcttatttatgtctctctagaaccactgtagccatattatttaacatgttttagggctctttggatatttggcatattttattatgcatttcctgcatactatttcagtttcactaaaatggaataatccctccttaggttctaatcaaaatgcgaaaggtatttgttcaagtgtaggattgctttagtcctttctaggatttgaaggagttgtagataacccaattcagtcttagatatattttttcatagcaagagagtgcttgtttttggaaagaaaaatcagagctaggattttgcatgatcttttaaaatcgggctatctttagcctaactgcaaggaaagaagcaactttgtctaaagttgctattccaaatttcataactgaaaccaaattatcacggcccttttcctgttcaaacacacagtccttgactgtatacaactgtttgctgagaactagtgaactagaaatcaagatctttgtaatctcttaattctatcatttaaaatgatgccaatttgatagaatggcattctcattttcctcatttgcttcattttcttcatttgcaaaattactttatgatagtggaggaaagctgcatttggagaatgtttattatgtgctttgagatcattaaagctgatatcactttgcataccaagtggtggtattcatatccttaatatactgaagttctgatacaatcaacgtttaaagaataacgtatcatgaccaccagtttatgcatactttcatgatgtaaatgtgcctgcagtaactactccttcctctgaaatcttgacatgagcattgtgtgtgctgctcacattgggactcagtatgagccattttctattgttatttatctgtatatgcatatgtcctatttatccaaacagattgtgagttcttgagggtgggggctgtgtatccctagcttctagcaatgtgccttgtacttaatggatgcttaatcagtcattgttaatgattagtaggatgttctgtcatgaacgcatcctctctattcttctgtacatgaaattatttgtgggatttattctgcaatcagaagggtggggctctcaaacagggtagcaccatgtcactcattatctcttacatctttggtaatctccccatgtgcatctgaagtcagttggaagctggtaatattttaccatcaaatatgttttgctgatgaggtgtatctatctataacattgatcattatttctgtttggttattatttataaaagattggcaataatgaaattaaaatacctacaatgtttactttgtgtagctatgcataattttgattctttatctttatttttcccaaattctacacaatgaagtattattcttagaaaaaagaagttctaaaaaaggttttgtttatattctagtaaacaaaagtatggaaatttataatggtataaatgccattctacacattaatttctcatttaaattaaaaaatctaatagcataaaatcttactgccagaatgaatattgatgagagtgttacttaattgacaatatttaaaagaacaatacttaaatcaacataaacactacttcttaaaactcttttaagatgttttaaattagcatagtaaagctccatttaattaaaatctaaaacgcaaatttcttcgctcttcatcagtgaagtctggacttgcatctacctgcctccatattaagaggaaccgtaccaaggacacagactattctaagcccacgtgaaaactattgttgaattaattcccaaaagccttaaggaatgtgcccactctgcatgttgctcagtggacacgcttctataatttcctgggcataaatttcttaccagcaagaattcagatggacccttatttagtatgaaaaagttcaagacaaatttccccagatggatacttaaagatatgcattattgacactgcacacttcattaaggttactttggtgccctgatatattccttcaaaatacgacctggtgtggtaatgagggatttcaagaaacatttgcctaaattaggtttctaagcaagatggagaccagcagctcttatctaaacctgttatgttgtctataagttcttccttcatccccttaccccagcatctgtcacggaggcaaaacatatagaaagagtacattagcacggcttaatatcaaagcctttatgtctgttatacatcattttagattgtcatcataagttgttcaatcaaaagatttagtcagagctaacattctttactgatgtcttttttccccaagagtgttggaaattcgattgttcaaagtgcaaatatgattcagcaaaccatttatcagaaatcctaaagaggtaaaataaaaaagcgggttgaggaacctgaattaaatgggctttaccagtcaaagattttgaaactactttcctgtgagtgactggaatagagcagaacaaagtcaattactgactgtaattaagaagtggatgcatttaaactgtagagagcagtagcagacttctccagactgcctggtaactcgaaagattagtgggaagacagaggaaaggatgtgaactgcatctctctgatagtatgttttgaatgaattgcattcatatagctctctgatctagcttctcaaaatgaattcgtaaatcactgattatgtatgattaatgcagtaatatatttggacaaaggaacttttaaaatacattttgcttttggttgtgttagcaatataagatcccctttgcattgcatagcatgcaccaaaaatgcaaacgcactgctaaagtacttatattttatcactgtttgaatttactagactgcaagctgaactatgttggctctttcgtaaaccctcataatatagcaaatctaattatgtttgtttctcgtacttcttaaatgtttctttttataattttaataatggtttatttatactggcagagaaacattacattgtacattgtgctttggctaattcatttgtctttgtgtatgttaacaaattatgatgttagaaatacattcataatcaaaatatttcactacagattaggatgaaggtagaggtctaggacattactagttttcttgtgttagaaatgaccttatatttttagattactatttcttaggcaacactctataaagtaaatatttggaactttatctgagtagagaacattgcaatggtgttcagataattaggcaaacatcacctgagctgtcttttactggatacataaaataggaggctgttttgagccatcctaaatcttatatgcagtttcattttaaaaagagagagaaagactgattggcctcagtaatctgtcaaattctagtgtgggcaattaaatctttttatttttaaatctttcacttcttataattgtatacactttagacagttcttctcacagttatagagacaacatttgatattggaacccatctcaatcaagaatggttactttgcagtactgattaatattgaatctctatagagtttttctaaaaacaaatgacaaatgaatatatatgcacatatgtaacagatttctttcaaaaccccaaaatcattgtcattaaatgttgccatgagaatccttgaaaccttcagaatgagccatttggggtagtaattgtcactttaatgatagaattatagagatggcctaaagcgtgatttgtgattttctgaacctgtgccacatttcagcgttcacctcctgtttagagcaaggaaggctgagaagaggtgactggctcctgattgagtattttgaaatgtcagtcctctaaacccctgaactctgtgtgacagtagttgggaaatgttcatcttccagttgcaaggaaaagtcaataatacaaagggaaaatcttcacagttcagattgatggccaaatacaaaaagcatgtccacacccactctaatcaattttttctctaagttgcccgttatgtgtgaaactaagagtattgctctgtttctgtagggtcgtatccttttctcacaagtctggggagaaaaagattcactgtaatgaaaaatggacagttacacgctaaatattgccaactacttagcagtctgagagtcaggaacctgaatgttcatttgataaatactctcccagagaggttcaaatatgtaaatgaacttttattttaatatactccttttgtggggaaattggtttttttattactttcctatagatctctgataagaaagtagaaatagtcaaatgttattcatttcaatgaacttttggaagtctgcaattagtgtttttggtaaataaactgttttagagctctccataaaaggaaatcaaatatagagatactattagatttgaaaaagacagacaggaaagaggcaaacgtgcagaatgaattctgacacacccgggtgcatttttctgcgggttctgacttaagtgtgtactgtctgcagttctctgaacttcctggcttgtttctccttaagttggagtaattcagctctagccctactctgacttaatcgttctattattaaaacaataatgtatttgttatgacgtgaaaaacagtttatagagagcggttcaaaatgctcccagttcccagaaagacaattactggaatacaagaaaatatttcattttattaaactgtgttttttaaaaaaggatttttacatgtaagagatctatcttacatagtttctttacctgtctatttctttttcttttttttttttttgcagatcacaacagtatcaggaaatgagttccttctacagtcagatattgacttcatcatattggattggttccacgctatcaaaaatgcaattgacagattggtatgtatttgttttggctgttacctttattaattaaaatgtagtcatttaaatcttattgctcaggcatataacacacacactcatttaaatagatcctatggactgagagggattaagttcttttagtttaaatagaatctactaaaaaccttttcagcagacaggatttgtagaactgtcgtttaatttctctctttcaaaaatatagtgcattctttctttttttctgaaataacatagacattcatttactggaggctgtaaaaagcacacaagcacttaataactactgatttttttttcattttcagtttatgcagtccatactacatactcctgtaaataaataacatatttaagactcactgttataataccaataaataaataataaccctttgtactgatttttattattcttccagctaagctagattgttcttcttatgaaaattacatatctagaacttcatgaaattatcctaaaacatacattcagagtatgttttctaagaatgaacttatttaaaaccactcattccatgctgagtctctagaacaaacatttaattttatgacactaatatttgcaaaattttgggaagaaatattcttaatacggaatacaacacaatagtaaaagattttctgtgtgattttcttgatacttaattgcaagctttcattataccattttgggattaacactttaaaaagtaaaataacaaatttactttttcctgttattagtatattccccttaaaggggtgtgtgtgtgaatgtgtgtgagtgcacatacatacatacacacagtttgttgccattgaggatggactctggaaccagactgctagagtttgaattctagttctatcatttgttacctgtgtggccttaggcaaattacttgcctattttggcctcattttcttaatgaggaaaataaggataataataataccacctactctatagaattgttgtaatgattaattgaactaatgcatgaatagtgcttagcatttagtaagtaccatcatatacatatataaactattattagagtattgagcttagcatagaggacctatcctcaaataattaccttacttcaaatttccccataaacagcaaaattgaacacaaaattctatggtgaatcctttctttctagtaaaattattcagtctaattatttgctgtttccagccaaaggattcaagttgtccatcaagaaacctggaattattcaaaatccaaagatcctctagcactgaattgctaagtcactacgacagtgatataaaagaacagaaaccagagcacagaaaatctttaagtgagtattttctttgacttgctcattttaagtttgtctaaatgcagtgcttatgaaatataaatgcattgaaatgagatttaagccaaactcatcatactcatggaagattcgtagccatttcctggccagggatttgtgcactggagggcagtctgggcactttgctcacatcattgttggtaatgccttttgagaaaataattgttccaaggtcatggtctctgcttacagcaaacctctgaatctctgagtaatagccatggtgttcagatcagtgattgattttgagagtgggaaatgtcaagcatctccaaccctggtatcctgactattttatttgcatacattaaagggtatgagtgaccaccagtgtggtctaacttaagtcaacaggctatgccactttccacaccttcagaccaccagaaacacttagaaacgtgctttccagagaggctgatagaaaatatgggatgtgaattagatgttctccaaggtcacacctagttctaatattctaagaattaaatttagagtaaaaagaatggtctcactacttacacagtgatcttgagtatctttcttaaccattccccagactgcttcttcctcaatgaaaaggggttattaaaatatgcaacacatatctcactgagttggtttgagtctcaacctcctgaaagaaaaggtagacatctggctgggcgaggtagctcacgcctgtaatcccagcactttgggaggctgaggtgggtggatcacgaggtcaggagctcgagatcatcctggtcaacatggccaaactccatctctactaaaactacaaaaataagctgggcatggtggcacgtgcctgtaatcccagctactcaggaggttgaggcaggagaattgcttgaaccagagagtcagaggttgcagtgagctgaaatcataccacagcattccagcctggttggcaacaaagcaagactctgtctcagaaaaggtagacatctttggaaccagagaaaacctatttcccaaagtcttaaaaattatagtattttgggggagtcttctacctggctgaccccaatcttgcaaatcatcatttttttcctgctatttccctctgacaaaatatcagtatactgacatcctaaactttagaatttaaagagaactcagtaagttgagaagagctgctaatggaatatatgtgtacatatatacatatatacatacacatacacacgtatgtatgtatgctagatgattatttgtacgtgtacatatatgtgtgcattaagaaatatatgtatatacacatacatgcacacaaagactcatacacatatgatagggaagagagaagctatttatatgtgataacatatttgccaaagttgaattactgaagtctacaaatctagaaattgcatgagaatttaagagtagaagcacccttttgaaattaagtctttatgcaaaatcccatgccataattttcaacaactgctagacacatttacttagccagttgtgctaagttggagtttaagattatcagtgttaatgtctagaaaatgcatggtttatttgtggagagttaatgccatttcaaaagacttttccataatggtacagtttagaggtatttcatttaaagaatgttttcctttcatgcctgatcattgtcttcttttacttcatatggtttgagacataaggtaagatttcagaattgggattcagttgggagtatatatttagtgttaatcatatagacattctgtagtacatataaaagaatatgtgatgcaatgactagtaggtctggaatcttagatataattgctggttcagagaccttaagatgtttctaaaacctgagctatggagaaaataaaggtttgcaaaaatgtatttgagaaacattgaggataatgaattctctattaagtaacagtcactttaaaagtattaagatgctgctgaaaaaaaaatcttagatagaacactcactacttctctttagaatctatttttaattggaaaagacaattatttttctactttgagcttaaactcaatcctacttaaaaacaagggaggccaggagtagtggctcatgcctgtaatcccagcactttgggaggccaaggcgggtggatcacctgaggtcaggagttcaagaccatcctggccaacatggtgaaaccctgtctctactaaaaatacaaaaattagccgggcatggtggcgagcacctgtaatcccagctactcgggaggctgaggcacaagaattgcttcaacccgggaggcggaagttgcagtgagctaagatttcaccactgcactccagcctgggcgacagagcaagactctgtctcaaaaaaaaaaaaaaaaaaaaaaaaaagggaagagatacatgatttattctattcatttcaaaatctaactaattgtacagtgacttcatactcaccttttactttgaagttaaaaaaaaactagaaaatatgaaacatttactgtgcaccaggcactgttccaagtgcttgtcttatagcaatacatttaatcctctcaccaatcctatgaggtagatactattagttaccttattttatagaggagaaaactgaggcatgaagaactaaggtaatttgtacaaagacaagttatggagacatgtttcaaacccaagcagtcttattttagagcctgtacttttaatcattacattataacaaagtgaacaagtaaaaggtaaacttagtttatatcgaacttagacttggatagaaatattatgttaaaaataagattcatagaaatcagtaaacttgaatcaggacccaaaaacttattggcaaaaataattaaaactgggtgttttctttcaattttgatttcactattaaaataataatttaatctttaacactagctctaattttagaaaatgattcttttctgtatcttggtgagtatgtatagttgtaagcctttttttttagggccagtatgttttttgcaatgtaggacacagttaatatccatctattactttgaattaagttcattcaatatgtatgtattcattttcatttgaaaggcataatgattgacccacccacacaatatcaaattagaccatgcatttgaaatagtgattgacatgttttatatttgatgctttgtaaaatatattttttcaagtaggaaataccctgtgtgaaacccctctgatctcagtcctagatttgaacacccaaacttaggtttcttaaaacttgcattcgcttttatgtcaccctttggagattaaataattatatagaatcagagactcaacagtatcctcttccttattagtagtctaagcacaaactttattgtcggttttctgcctttggcttcctgtgcccttgatgttcccatgagttttgccgccaagattgtagacagataaagccagaattacttttttaaaaggcatgtgaacatcattagcagctaacaggtggtgatttcgttgtccagtttgtctatataacatgggaaaaatatgttctctcaatgagtgaattcagaaagttatgtttacatatacttttcttttaaaaaatatgattctaacctgccaacactattaagaacgaatcagatattttaagatatcagttgagtctaacagacaagaagccagaaaatttaatgcaagggccaaatcactgtgggaaactcaggacaccagcctgggatgagagtaggagagcagctctccagggagggctgttatggaaagtggagagtcaatcaaagaagatgtgaacatatttctctgaggaaagagaattgtcttccactgacagcaaagagggggaaggcccaaatataataaatcttgcatcagataaccttggcgaggtttcttaacttttctgagctttactttccacatctataaaaatgggtctaatactgtccttaaaggatcgtgtgagaatttgaaattagacatgtaaatacttagctcatagcaggcactcagtaagtaggagctcttattattatcctccatgtccccaagcagatagcactgagacagggcttgagcctggtggtggttgatgaaagactggagcagggcatataagcttgccatcctactccctgagtgtatgaaaggtagaaaaagggtaccagaattggatatgggagtcatagctgcaaaaaatctaagtacgagcagctggtctttcccctggcaactcccatgtaaaaggggcaggtagggcattcttgggagcagcacaccaggaaacagtagaaaggagccaagaaacactcttgattctcctaaacccagaaaagcatgccattcagaaattcaagttgatgggaaggattcagcattagccatctcactattcctttacacaaagttctagtttattcattcatacacacattaattcttttttatgaagaaatacaactaaaggtatacaactaaaattcttgatttcactcatctgtgctttcaatttttaaaaaataacttttgtatgtaggttatgctttagtagtaatatatctcatacctatcaattgctaaactgtaaaatccatgagtgtggagaccttggataacttgaaaataaaactgacactttagtattggaaataagcaccctgaaatgaacatgagttagaagactaaagtcaaaaggtaagagagctaaaaggaaatgggttttcctttagctgtctcttgattaagttatcataaaaaacaaatgtgttctgggtgaaatcctaaatgcatatgtggatttcccaaatctacgttctcttaatgacatgtgcaataagggtatatgtaatatgtttctaataattagggtatatgtatttaaatgtgcatttcccagttccatatccccttaatgatgtgtgcaataagacaacagaaagaaaaaacttgaattgagagagttacacaataaaaattaaaatgctacggacttttaacttgtctttgtttaaaaaatttgcctgcaaagtatcatgaccatgccaagtgatgaaaacaagtttgatagagaaaacattaattttttgtactaatctaaataattataatactggtcttctacaactataagtaggctatgttctcaaaatccaattgtaaattggttgcttagacctggtatgttttcacaaggaaaccatgtaccaagccacaaaagcacacttgaactttctgcagtcacttacaatgttgtttctagggaacaactcattctgaatttgctgcacctctggccctgagagctaagacttcccagtagcattgctttcgatctagtttccggtctagatccccacttctgtaccgtctccaccaaagcgattaggagactcagaatggcttttgcttttgctaggattctggtgagccctgaaagtccccagtagtggcagggagggaatttaaagcctccgagccggaagaaataatagaaaaaggagagaattgaggactgggtaggcagcttttgtagcattaatgggaagtgagtccttagcaagacagatgttctttgtaaaaagtatgtgtaatgacagattaagtctggaattgtcccaaatataaacatttgatgaatctaggtggtgcataggcaagtgatcatgatcctattgtttcatttttttttgtatgtttgaaaagttctccagttaaaaattgaagtaaacgcacatacccacacaaaagtaggtatgtccatgtgcctaattcaataaaagaatatacatattttctgattatgacctgaacctttcaaagaaagatcaaattttctgaatataagttacattaagacctctttacatgaaacattgataactcattgttttcctattttcctccaaaaccaatatatttttttcctgtgaccattgagacctttctgggaactatgtaattaagaaaacttttaagatatttattattatccaaaattaaaaagtcacacgagtttcttggataaatatgtaattatcaattgttaaaacacatactgtgaagcctgttctggaggctcatataaatacatattttaaagttttttcttattaagaattttgtgtaaaacagtctaatcctgccaatgtatgaaaataataagatgaacaaaccatctgccaaggaaatgaaaacagtattaaaattgcacagataaaccatatctagttctgaagaaatggaagagctctttcctggaaaaacaaaaaagtcgtgacatttttgtagaatatcatgggttattatattatcaagaggacaaagttttctgatttgggtgagagggtcactcacccttttttttttttccccaaaataactagcgccactctggtaccagttttattcaaaaccctcttgagaaaaataaactattgagctaaaatgtggaaacaaatcacttcatattactatacttataagacagacaatatctaaagaatagttgagtgtcacttgtcttttcagttgtttttcacaggttgagagttacttatttcaaaatagttggtaaagaaaaaaattgaaaaattataaatgacatttatgttgttaaagctgcaagatgtaaacatcatgagaggaaaagagtaaaaattagacacatttgatagtcaagcatccacattaatttatcagaatagtattatgcatgaaggtcccaggcttcactatggccctgtgtgactctagccattgttctgacatatgttcccaagcagcagtacctactttttctgggacccgtagattgcactttcttcaaaacattcagttttcaatgaatcatttgataagaggacttcattatgagctgagcaaagaatgtcctgattaatctcttctttcccatctaaggggctgatctcgccctctgacctgtggatgtccattgtcgtgtatctcatagcatcagctactctgaaagtccacctaaccctctcagtgctcaagcactagatcaccctatcttccttctgaccctggcaataacaccatgagcatatttccccttagatgaactgcatttaatcaatttctgatttcattaggtcaaatggcatcttgctttcaataatagggcaaatccagagggctctttgctctaactctcaagcaatattttattggcattaatacactactgtgattgtaaacaaaagaaaaaaaaagatctttggtatcctcagaaagtgtccttttgtttattccatgactttaaaatgggcgtatattaatgttttcttataaagttaggcatataatcatcattcattgttgtcacagcagatttaaagaatctttgctaaagctgacatttaagcatttaaggtgtttgtacagtgaatccatgtgcagagcaaaacattattttgaatgcaaatgatcacctctttctgtatacaggatttatttggtcaattcctttttgtttctgaagtatggtaacttacgctactttccttcaaaattctaaagaagtaatttgctttttgatggatttatttggatgtcccaaataggcctaataacatgcttgggggaaaaaaaaaatccgttgttaacacatggaatctttgagattttcttgtaaaataagtttcttattactcatagtatagccctcactaaacaaaatcagatattgctttcacccaaaagtattagatgaacccagaaataccagatgttttcatcaaactttaataaagtgagatctgtaacattaggattcctagctttcttcaagaaatggctcatggatgacttgagaaacctaaagcaatctgccaatacatctttctttggttatttaagtagtacctgaaatcagttgttcctgctacccaattttcctaatgtaaataaatataccctatttgtatacaaaattaattggcctaaaaaggtagaggactagataggaaatgccataaccaagtagaaaatataggactgggattttgctgtcagataaggtcttctccaaaattgaagtcaaagattaagaacaattatttttttttttttttttttttttttgagaaggagtctcactctgtcacacaggcttgagtgcaatggcgtggtcttggctcactacaacctccgcctcccaagttcaagtgattctcctgcctcagcctccctagtagctgggactacaggctcgggcaacaccacgcctggctaatttttgtatttttagtagagatgcgatttcactctgttggccaggcaggtatcgacctcctgacctcacgatctgcccaccttggcctcccaaagtgctaggattacaggcgtgagccgctgcacccagccagattaagaacaatttctaatgactgcattggaattattgctcttggaattagagtccaagtttctgtatagaaagctcattatgatctgtgccccttctccagttttttttcatcactccctgacccataatttatgttccaggtaaatagtccctataatacctgatgcacactgctacatgctgacttttaccttgaaatcagggttatctctttacaaagttaacatcctttaggactcagcccagatcatacttcccaatattcccatcatccattctaacaccctattttatttgaaagagttactgtgattcatagttattcttgcagctcttctgtgggctctgacttggaattttcaagtttctattggaggcaataaaagaaaaagaaactctgtaatatataacaaataattacagtaattttgattatttttataagactgagaatacttttctctagtgtcagcttatttgtaaaaatccagtttaacacaaaagttatcaaagtgttagccctcagaaccctgttcaaaaggttgtatgagattgtgtaagaaatttgagtctgagagtcagaaaatttgagtacagttcttaactccaagatatacagccatatgactttgacaagtttcttaagtttcttgaaattgagtttccagataaatataatatatattttatataattataaaatattataaatgtaaatgttgattatctaaaaagattatatatgtatttgatctagagaaaatgtatatagtggatctaaaatatatcaaataactttgtagattatatattatgttataaaatgatttccatctgggtaaattctgagtaaaataatcatgacttttgtttgtttactataaatctaccaatttagaaatatagcaagaatgtacttttgcaactgttgaaacagttgccaaaatgcagcataaacaaatgcgtaattttttgaaggcttaatttcttaatatcttcattattttattgactctggttaacatatatccttttaccttttgttttcttaagggatcctaagtgtcatggggaataaatgcttggttttgtcattcctgagtgtgagcctgacacgatggcaatctctagagattaaagtttgtcaagtgtctgttgccatttccattcttttttttttttatttaagttttagggtacatgtgcacaatgtgcaggttagttacatatgtatacatgtgccatgctggtgcgctgcaccccttaactcgtcatctagcattaggtatatctcccaatgctatccctcccccctccccccaccccacaacagtccccagactgtgatgttccccttcctgtgtccatgtgttctcattgttcagttcccacctatgagtgagaatatgcagtgtttgggtttttgttcttgcaatagtttgctgagaatgatgatttccaatttcatccatgtccctacaaaggacatgaactcctcatttttatggctgcatagtattccatggtgtatatgtgccacattttcttaatccagtctatcattgttggacatttgggttggttccaagtctttgctattgtgaatagtcccgcaataaacatacgtgtgcatgtgtctttatagcagcatgatttatagtcctttgggtatatacccagtaatgggctgggtaaaatggtatttctagttctagggccatttccattcttatagaaaatagtaaaataatacaagggtagaattttgacagagagttatgtaaattcacttaaaagcaaggaaagattttatttaattttaatgtttaaataatacatattagaatcaactcagtgtcatgaagcatctggtgataaaaagatgggttttgttgactaaagtaaacatattatacaaatcacatggatattgagccacttataaggagtaaactgaaaaccactgaaagtctggtctcaccaaactatagtgtattgatcagctggcaagggatgcccaccatgttcactgtatcaaaaggattgtgatatctgagttctggggagtaatcctagctgacctagcttcagtcattagcttaaaccaggaccactctattccattagactgcaagtgcctggaggtataagccaagaccttctgctaattacccctccctatccccatcactcagaacagagtctgaaacctagtggtgttcagaattattagcttggctcaaaagtaattgcagttttgccattttttaaacctcgtttacttttgcactgacgaataaatgtctgagtgagtgaggaaacaagtgaccgagagcatgagaggggaaccctgaagaaacccttacagattttatgcatgaggaatgaagggaaaggctgaactgtgaggcactgtcctgttgatgggtgttttggtttgggttcctccagaagcagtccctgagacaaagatttgatcacaggtaatatatttggaagtgatccctggacacacataggtaggggctggcagaagagagccagggaagagaacatacctatgaaggagaataaaaggtttatggagtttaatgctgctgtggaactctagcagtttttcagatggagaaacaaggaatgacagagaagagcatggatagacttttgtacaggaaggaaagaaccatagagcataaaatagttgaagagcacaatagattggtgaggctggaatgtgcaaaacattggggcaacaactggagatcaggttggaaatgaagagtgaaccattggcaaagggtctctcacggaatgctaaaaaattaggacttttcactataaataatgggagcctagtgaaagacttcaatgcaggcaagagacatgaacagatttgatttttagagtaataattttggggaaaatgtggagaatggcagagataggtagcacagagtgagagatcagaggtaagaagatgaattcagagatcagaggtaaggagatgaattcagagactattagaatagaccatgtaccatatgctgcaggtccaaactaggcagtaggaataggtgaagaagaaagattccagagatatctgacttgatattgataggttttcttgacatatattgtaagtcttggcagctcccaaatacccattgcctctgtggtttggaaaacaaccatcaggatgccaaggagctaagcagaatctcattctttcaggagcctactagattcttgttactctagatataatccatggaccaacaatgacaatatcacctaggagcttgttagtaaatatggcctctccagcccaaccccaaaccaactgaactgaatctgcattttaacaggtgattcccatgcacattaaaatttgaaaaaaacattaccatatgacataaataacttctttaaagaggtttttgaaagtccagagccaaagggtggcctttgggacttggacaaaagacctactcatataaaagagctatcttgtcggcctttgtgtaaaataaccctgcatatggttattatattggtcatgctatgacaatgcatgattttgaatggtggctatttaatctcatcaatcccttccaacccatgattacggactaaatgagaaagaaccaagacttacactgccttgtaacttttgcctgtgccacacctaagtcagaaattctgaactcccacatcaaaaagtcaacagtcccagccaaagaacagcaacaatatcaaaaaatgattctgagcctaaactaccctcaccaaaacagacaaacaagaaaccaaagctccaagcaattccctggaaattatccattaattccctggatagctcaatgtgcaaaatccatttgaaattctacttatcccttatcttccatttgactcttcttttcggaacacataatctcacatgtagcctctttttgttatttcccttctcaagcaagaataatagtatttgattgcttaaatttctttatttttatgttgttcttgagtacttgaattcatttcccattggcctttcaggttagatgttaaaattctggatgagcagcaacgtagctgttttactcgtagactaagtttatttgctgcacctgccaaaagaatcaaggcccaccaggctgcacttcagtcaagctgttttgaaaaattgcaaagaaaacaaaagtaggcccacaatttcacaatttagttatcaaaaaatagaggaaagattcaaaataaagtctgattaaccctcttagtagggtgagatttcacttactgggaagaactgataatgattatttctgaaataaaacctcattttttttcatgtctacctttttttaattataggaaatggaaaccaaaatgggcaaataatcattcttttctcagtaagaatctttctcataaatttgcccctaaaatgtccagtcttttaaaaatgttttggacagtaatgagacaggtctgaaagagatgccttaaaattttagtagtgcctagattcacttcacttatttacctttcttactttaagacagcttacataagaataattaatctttttttttttcctagtgagtacctgggtttgttattgaggtttcataattaatctttttttttttttcctagtaggtacctgggtttgttactgaggtttcatgcttttttttttttttttaaatcgggcataaccataattgatttccacggaagggtttggctgaagacccaaagaatttttgcttaactcatttttattgaacgaaatccagaattttagtcaagaagcattagatattaatcacatatgagtggggtcattaaaatttcctttaccttccagaactgcaggtcattatggaatcataagaagcagtgagctcacttaatctttacaattacataaaagtgattattttcttaagtcttacaagaagctcttaactattagttgaagagcatgttggaatattagaacatctgtgttgtgttattatagatgtgacttgtgaattaaaaaaaaattctctgactcaaaactcttagaagttaccctttccagcttgaatagttttaattctttaacacagtttgggagtatatattttttacctcgcaagtagagaccttgttgctgaaatataaattccagtatcatttcttaattattacactctcaactttatagaaaatcagaggaacttcacaggttctaaagattaggaaaaaaagaagaagaaaattagaggagaaatgcaattttttttactgcacttaagaataacagttggtgacaatttaaggtgagtcagtttagggaaaaactgagacaaatccatcctctaaattattgttgcctgtctccatctttttcttgtaaccacttctcatctttgactttgaaacccaacagtttaaacttggttcttatttcagtgggctaatcccctttcataaatcttgctcaagagctgaaataatttgcacatcatttaaagagtatttgctttgaaatattcacctcaagcccttttgtatatcctctctctctaaagatttgtagtatttgttttgttctctgaggtataaaagacctggataaactttattcctgttgtttcaagattagttaacgaaaatgcatattaattcagcagggacggaaataaacctcagtaaagatgatcatacattcgcctctcggggatagcaaagtacaaaatgtcagtcttcaaatctccttggacttgctcaaaagagcatttggggatttaaatttccagaatatgtctacaaatgtattttctttgttgtggagaacagaagctatactgattatttttccccagaaaattgattctaatttgtgtttgaacaaaaattaagccatctagaaagtagcacttcaagaagacagaggaaaactgccactgaaaaggtaaatttaacattaaaaattatattcttgataagccactaaatttttagtttatttgtcatcagatcccaaatcccaggatagtttcacagaatttctgtatttttttctatgaaaaaattagaattgaaaggacctcagaaaatcaaaagtagacatatttaaatagagttaaatgttcctctgcatttataagctcaaattttaaagtttgttggtcagctcagaaaaaaaatacaaatttctctagataatatatttgtttcatatgttaagatgtgccctgtgtttttcttaaactgaaaatgaccataaacttttggcacttaagtgcttatccggaaatgactaagtggattcaggagtaataaatcactcatatggatccagccacccacagtcttgttccacttctcttctttacaagtgtagtaatagacatttccacagtcctcagggtgccgaactttgcaccattaggaaaatctgcaagtagcttgatttatcttcctcactcagttagctaagacccaactaactaaaaatcagcaggaatgaacttgacttgttaaacttttttaatagggagatgcaacaattacaactttcctcctttgccacttcaatttacattggatgtgaagcccctggtgaaaaatattcagatgagaactcaaattataggtgcatggctggatgatgctgactctaggttttcattatacacagagaatcgtctgctgtttgcaattaatccagacacaatcctcttggtactttgggaggaatgcggaagaaatagccattttataagttgtaaactcctaaattaccctaaattagagacactattaatcgaacactttgatataggtaggatctgcttattgtgtaggctcatcttcccctgatggagcaatcaattaaatatttaggatgtggaataccttccgggttggataatgcatttcatttaaattatggccctccaacccgaaacattaaaggggatcttaacggatggaagcacattactgtctcttggattgggcgcattaacactttaaaaatgaatgtgcttcccaggatttcctatttgttccaccagctgcctgtggatgtgccagataaacagtttaaggataagtatgtaaaagatgcatgtgtaactttttgtgtgctgaggtgcacccttgtagcaagagtcctcaactgtggcccctttggatttttttttttttttttgtctcaatgctgtagcagtctaaaatgagagtgctcatttgatcatgggagagtaggagggaaagccaacaaaagatgtaattagacttctgacaaaggttctgtctgtgtttaatcttttatcatttctacctataatttatcctaataaatagtgattattactagaaaatattgggatgatatagtagaattcaaaataagcataagctttcccattctaaaaatatttggcataaaggaaattatttaatttttacccaaggacaattactatgtcaaatttatgaacagtattgtaagaacagagttgttatgtctcccataccacggaagcatggtatagatatggtaaatactttagagagcttaccaggctgtaggcagcattctaagcactttaatctactctcattgaatcctgtcaaccctatgcagctcagtgacattattatcatccccattttatctattaagtgactgaggcactgaaaggttaatcaatttacacaaagttatataattaagaagtagctgagttagaatttgaaaccaagcagtctaacttcacagcctggaaccacaaaccactgtgtagcatccggcttctggagtgaggttgatggtttctgcaatttactagctctacaaactttgagccagtcacttaacctcactaagctactgttttataatcttaaaaatgtcaataataatagtatctacctcacagagttgattggaagcataaattagattaagtaatgtaacgtttatagcattgtttgggagaatgtaagtactcaataaatgttaatcataacgttagtacaagtattttcttttcttccatagtatttggaaaagttctcctaatttggttaagaaaatgttatcttaaagataaatgattgaaattcctagagattaatgtattttccaaaatgtctttggacttacaggggaaaaatagtatattgagtgccttacagaaggctataaacttcctgaaccatgagtctgttttcattcattttccatttataaaagtcttgattcactattaacataatacataaatatatcatattagcttactgagtgaaaacaaatttatccaatcggaaaaaaaaaaaaagatgttaaagataggggtcaatttctttgtttcccagagacaggcttttcatatcaaatctgatagaacacatgcttcagaagggagcagaaaactcagctaactggtataattatgtaactcaaatggtcatattgagagggttaaactttggcaatagaatgtggaaatacaaagttcaatgaagttgtaggaatttaactgaaaagaaattacttatcagcattttgatggggaataaacaaacaaaagaaacaaattggtcctttcaaagttgggtggaaagaatgttcctgaagccttccttagtaatcaccgtcattgagaggccctgaggactcgtatctgtagtaattgatacctagtcctcatgctcaaggaggaagacaactggtatttatgggcttgtcaagaaaggaattagttggaattcctttttctactccatctttcactagtctttattgagccaagtttattgtaagttaggggtgaatcatacagatacctttactctttcaatatgctaagaaaacaattgggatgaaaagagaatctgatattttaaacaccaagcaatgtgttttatttggctgggaatacagtcttatgggcaatcactgtatatttatctgtttgcttgtttatttggaagtcctaccagtggagtaaagctcctcatctattgagctctgatcttcttccactgaacagatagaaaggaaaggccttagacagaattataataaaggtgtatgaggcaactcaggctcaaccagaaagatcagccaatcaactctgaaaaccaacaaagatgcaagttgcacagagcaatactcctcctaatatttttcttacgttcataatatgggtggattaataatttttctgtgttgtaatatattcataatacaagcggattaactcagattaaaatgctctatatctggtgaatgagggaagacaaaataggccctaaaaatgggaatgcttatttagggaacaaacaaagatgacgtaaactctaaaaagctggagtactcagagcaagaactcagttcacacattcacatcacagacatttgtaggggagttgctttgtgcatgcactgttttaagcactggagttaaagagactccaaatgttatcaattccacattaacaaagagagtttgttactggaaggggctcccaatccagaccccaagacagggttcttggacctcgcgcaagaaagaatctgaggtgagtccacagagtaaagcaaaagcaagattattaaggaagtaaaggaataaaagaatagctactccatagagccgttctgagggctgctggttggctatttttattgtcgtttcttgattatatgctaaacaaggtgtggcttattcattagttttcaaggaaagaggtgagcaattcccggaactttttagaacatgctaaaggacatactaaaagacatttagcatgctgatgcattatagttagtgtataaggagcagtaaggacgaccaaaggtcactttcattgccatcttggttttggtgggatttggctggcttctttaccacatccttttatcagcaaggtctttgtgacctataccttgtactgacctcctatctcatcctgtgactaagaatatcttaaactcttgggattgcagccccagaggttttatccttattttacccagccgctattcaagatggagttgctctggttcaaacacctctgacatttatggtcaaattttaggtagctatttcccattctctaacaagttgatttaatttaaagatgattatacacatgatgaaatactgttaaaatattcctgcttgattttattaacaaaacgaatatagtattttgatctaatttacatgtctagctcatattgaattttttaagaaatttcgcatttacattaggtccaaactctcatctatggagtattaagtagcgccatgaccacagtccaccaaagtgtttaaaaggaaaaaagtttaataaatcaaaatgctccaatcttgagtcctggtgtctttttttaaaatcccaaatggtctggaggctgacattatttcctggctggccctaggagggaggatctgtcacttgttagtaatagacacagagttaaatgacctggagacctgccattaggaagcaaatactacccattatttaagtccagaggagggcagctcacctgagtatccagctgcactgtaataatgacgaatctgggtggtagagccagaagcctcagcttaaatcctgacgctgccagaacctacatttggcttatgcaaaatttcctcaaagactggcagtgagggctaaataacttagcccctgaaagttctcagaatagtgtctggagtatagtaagttttcattaaatgttggctattaacattgagacttctgttagaccaaatataacagtccatacaacttgcagaatattgaaaacaaaatggtaaacatataaatgacagagggcaacttaattggaggttgtagagaaatatttagaatcattaaaaatgaaatcattttgaattttctattgtgttacatactaaaattaacattaggaaacaatgtgaagtaaaggtgtagagtgaaatggctaaacttattttcataaagtgaaagcatttcccttccaaaaagaaaaaaattgtaatcaatctatatatattagtatcagtatgaattaaaaaaataaaattttgtattcaccatgagctgttctaagcatgtagcatgtattttctcatcttcaagacagttatatgttaataattttatattcatttacagaggaggaaacacagatatttagttttggagtctagattataacttcagcagtctaaatcagaacacattctattataccttttataggctttgtataattttccttttgtaacttgcctttaagttttatttgttattatatataagtaattatgttattaaattgtgtacatgtgttttgaaagacagatttgtgcagatataatgcatgtatgtctatagtatataaaaataaattttaaggggcatattgacagatggaaaaagcataaatgtcaaagaaagttgatttagaaattaatatataataaaaattaaactagcatttattaatttaacagatggtgagttaaaaagtaaaaacaaaatctcgaatcgtaacttgatttttacaattagtgtgattatttcacaaacttattcaaaagtttgctattttcttgttctatttaaaagaaaaaagctcccatctcaaagtttccaccaaataatttactactttcatttaacagattctgttcagaaatctgcatatgtacaaatgagcaccagaatataaaatttaatcatagaccaacatccaaaaaattatagtggatgtaggtgaggcatgctagctcatgcctgtaaccccagcactttaggagatagagactagaggatcacttgaggccaaaagttaaagaccagcctagccaacatagtaagacccagtctccacaaaaaataaaatacaaaacaattagctggacatggtagcatgcacctgtagtcccaggaggctgagggaacttacttgagcccaggagtttgaggttacagtgattatgccactgcactccagcctgggcaacagagtgaaaccctgtgttgtttttttttaatatatatatatttatgatgtaaaactatattttacatatttatattgttgactaatatatattataatttatactataaatacaaatattggacattgtttttaaatacccacagtatttattattaactatatactaaatccacaaaattatacatgcaaaaattattttaaaatgtgatctgtgtaagatataaaaaattgataacaagaaattaacaaaataccccaagtaccttattaatttaaaaattttctgtcaattgcttttgtcttaaggataaatccaatatcaaatttaatagtatgcaaccaaaataatattcagaggcaaatgcatagtattaaatgtttttaatattaaagaagtaaaacaattacataagaaatattttaggttaactaaacataactaaagaaatctgaggttagaaatgataaaataaagaaaaatcaatcacatgtaaaacaaaaaaatattattgcactaaaagttatttggaaagtagtctcttaggaatgaaataaaaataactctgaaaatctaattttagagaacataaagaaactagaaggacataagaaaaactagaatatttgaacatacatcttcaaaatctccctcaaaaaggtcccaggtctaaagatttactagtgaatgatgttaatcttctaactggtaattttcatgtcatttgaaagcacacaaataatcagtgagtaaaattttcaaatactcaagtaatgatcaaggaactgaaaaataaagcaacagacacatgccaacaccgctgtgtctgcagctatagtgaacggcatcaggatggtctgaaggcacttgaaatctaagtaggaccagagctttgacccttgttttccaggaaattccttcagggagacagttactgagacctgcgcaatgactctgcgcactacctgcagtgtgttcagagaccatttaaagggaaggagattcctgctgaagggccggtgatcatgggccagaggaaagaaaaatctgaaagttcttcgtgtccttgacatttgaaaatggactcttcaaatggggaacttgagaactctggctcttgtcaattaagatcattaagatagacatcattcggatgaatagtttagtgaggagaaaatttattccctcctttataatgttttcctctcctttgctaatgaaccattacattttgctttgaagttatgactcagctgttttgacattttcatagtgaccaaatatgccaaaatagagcaatttttttggaagaaaatatttgcaatacttggattgtgatcagcttgaggtaatatatgtaaaaaatggtaaacttgtcataatgcttagggtcacctgacctcttaaatgtagctgtttggtacatgatactaattttttttcttcttaatttaagcaactgactagaacttctttagtctcagtgaggtcatgctctcaaaaggcatattgccagctggtctcaatgcttggaggcatagttgtaaatttttatacagcaccttaagagtttttaaggttgctagtggcttcaattaaagaccacatttaatagattaacaagggatgccagattaagacttgaaaactttaagcaagtcacagtgaatttaagaaagttgcagtggggtataggaaatagaatgatttgagtagctaatgaaaaagagttgcaaagatttgtttttgccagcatccaatccaagttttaggatcaaggtaccactatctgattaaaatgccaaaatggtgcatctggttaaatggggggtggggggaaggatgctttatttgccttgtttcccatccttctcagtaacatttctaatcacaaagatgattagctctatcatttaaaaataaaactaaagtaagaaagtggcatattaatagttttcataaatcttatcaactactatatttcattgcatcataatcatgtagatataaaagcatgtgtgtgcccactcaggggtgtatataagtattttatctgtattgcatacctatgctttctgtatacaatatttggaaatacacactgaaagccttagaaatatgtgtactcttaattttttaaaaaaaagattgtactcctcaaacgatttcagttcttaaaatccattcaaagaaaactaaaagtctgaattgaagtgttttttgatcatagtgaaaaatttgaaataatctacctgtccaacagtgggcctttgtttaaaaaatcatggtgtatccctatgatggtatatatgtaatcaaaaacatttaagttttcaaagaaaattgtggaagcataattctaagtatgaagcatacttagaataaacgtgcataatgtgaagtatgggagagggatacaaaacttgtttgatatgaagtattaaagcagaggcctggtctgcttggccagagatgcatccctgcataaagtaagggctcattaaatatctgttaaataagtgaatgagtataggatgtaaaagaaaaatagcaacagcaactctaagtaatacagtgatcatgggtttactttgttttcttctctagtctccctccctaagtcttctaaattttccataataaatgtttgtttccaatatcagaaatagtataaaatatagcacaattgtgatggatgatgagcaagattattagtggaaatatatctcacaaagtgtgtactatgttttgcccatgaatatttggctcttctcttctgaaattcaaaactctgaggtttgctcacacgaatttttttccccacacttcaccagcccttgacatgtgactacaatatgtattttttgctactagttttattcatttcattttatcctctgcattcttgaaggcatgaatgacagacatctggaaaatatatatatatctagacactgaaaacataatttcttatcaaagagctggaatataaacatctagaagacaaagtatctgaataatgttaaattagaatctttattttatactaaccagatctcaaatatgaagcacaaattgtggtttattgcttgatatgtaattgcattagggttatcattctttttaatatcattttttccctcagttggattttatccaagaagtgatataatgtgctaggaagactttacctaaactttgatgcttttaaacaacatgtatgtgggactcctcctctctttgataagaagaaaatgggaaaatgaagagaaagctgaaacattaccattttaggggaaacttaggaaaggaacccagagtgggcagcttccaggggcagtttcaccattcttgtcagaagggaacagacacatagaatgtaaataacatacccaatattgactatgggaatagaggccccttctgccttccttttatttgaagtaaaatgtttgccccttcctcaggcttcaaattgcttagagcatctagaagacttggctgggcatggtggcgcacgcctgtaatcccaacactttgagaggccaaagcagatggatcgcctcgggtcaggagtttgagaccagcctggccaacatggtgaaaccctgtctgtactaaaaatataaaaattagccaggcacggtggcgcacacctgtaatcccagctactcgggatgctgaggcaggagaatcgcttgaatccaggagacagaagttgcagtcgcaccactgcattctagcctgggctacagaatgagactctgtctctcaaaaaaaaaaaaaaaaaaaaaaaaacagaactcaagcccacctttacattaaaatccttaaacaatttcttttgatgtggcgtattctattagactactcttatacgttgaacacaactgtggggtagtgaagttgtgatgtagaaactctgtttccttgaacttagtgctaactttagggagcacagatattaacatttcttcatttgggctaaatgttataagaacaatataaacactagaggattttagcttcaccaccattcgagaaaattggttttactcccaccattaaaaggaagcaatctaaagtaaaggaatcgatctataagtgtaagaacaacagcaaatttatcaggaaaatgtttaaacagacaaattaaccatttttcagtgtccattttcttcattatgaccaaggatatccttgactgtaaagaaaaattcaattatttgccaaaccgtaggtgctaatcctgtttctgcagttgtctgtaaatagaattcccctttgcagtgccgttttctgcatggtaccttaaacaaataggtcttagcaatagttccaataggattggaggttcaccattaaaaatagacttatcggcctgctgctgtggctcatgcctgtaatcccagcactttgggaggcagagtaaggctgatcgcttgagcagcctgggcaacatggcaaaaccccatctctacaaaaaatacaaaaattagccgggaatggtggtgcgcagctactcggagtagttccagctactcaggaggctgaggtgggaggatgacttgagcctgggaggcggaggttacagtgagtcaaggtcatgcctctgcactccagcctgggcaatagagccagaacttgtctcaataaaataaaatagacttattaccaggtgcacatgatatgtaaagttggttgtgtaaagtaaataaagtaaactataattgataggccatctccattctgctgggaattgttgtgttcacttgtttctaaaattttatttttgtggtggaagtttgcctctacaaaaatgacagcttacagttttaaactattggggaaaaaaaataaaactaaaagactacaaagaagaaatgattcctgaccattaagtcttctgcaatgccatgatagcaaaaaaaaggcacaaagttttactgaaggttagatacacctcacattcccagtagatatttacagaatctcatacatctattcattcaataagtgtgacactgtcctatgcactggagatacaataaacaaaatagatgagcgtccttctccaaaaatgtctcacatatgagggaatgctaaccttaaaatcaaagccatgtgcattgagtgttgaaaggtaaccaagactatacctaaccaacctacttttacaaaagacaaaagttagaccaaacagtcattgtagaatcactctgggttcaacagagaagcagtactactactagtaagatgtagtaagatggatggatggatggatggatggatggacagacggacagacagacagacaaaaagatttttccagttgcaggagcttgctatgcaagtctgaagttcataaagaaacagttagaaagggaagacacaaagtaggctggaactcccaaggcagaggctatttggggtctctgagcttagggaatatctaaaccaggcttgcttgtccaacctgcagcccctagtcctcctgtggcccaggatggctttgaatgcagcccaacacaaattcataaactttcttgaaacatgagatatttttgtgatttttttatttttagctcatcaactattgttagtgttagtgtattttatgtgtggcccaagacaattattcttcttccagtgtggcccagggagccaaatatactggaaaactctgataagcccactcctaggtagctcacctggcctagtctgatatatccataatatatatatattataggccgggtgcggtggctcacgcctgtaatcccagcactttgggaggccaaggcgggtggatcacttgaggtcaaaagtttgggactagcctggccaacatggggaaaccctgtctctactaaaaatagaaaaattagccaggtgtagtggcgggcacctgtaatcctatctactcaggaggctgaaacaggaaaatcactaaccctggaggcagaagttgtagtgagctgggatcatgccattgcattccaacctcgtaatcaagagcgaaactccatcttggggggtggggggggaagatgtcttatagataggggtgtctataataaatcagaacaggccagttgcaacctttttatctaaccatccatccagctatcctacatcttactggtagtggtactgcttctctgttgaacccaggatgattatacaatgcctttttggtctaaattttgccttttgtaaaataatataccttctgattaacttaaagtctgattattagagactttaatttcctctaaaaatttcttcacagcaccacctaaattggtgtgtgattgaatgactaggctatatagttcaccctagctaggttgacatattaaaaagccattacaggcacattcacttgcccagtgtcacacagctgtcaagtggctggaactaaaactgactcatttcctccccagttcattctgtgatgggcatacctatccaacattcacaccctccattctcctgttcttgaagacatctccattcaacagtaaaatgttgctttcaactacctcttaccctcttttcaaagaacaagattataaaatgacctgtaatagttggcatgtctataaatttaattatattttagtcaaaaccactcatttagctttgaattggtaaggctgatgacaaagccagtttggctagaacttctagagtctcggaaaaaataggctatttttctataagaaataaggtaacctatttattaaattgatagagaatcaaggtcaataattctttattccattttatttattttaatagtgacctagtaaagtagatataacttgatagaaataaagaatagactgaaaatataatcttatggaaaacaggtgtctagccttggagaaacagaacaaattacattagcgatttaagacatacaacaacatatcctaaaaagaattcttattaacatggcaaacattgccttaaaaagcataaataaataaataaatcctctgtatattcatgtaaatttggaaaactatgcttagtcttgccagacaagttatttatattactaaatataaatgacagaaatttctatgacaaattctagtcaagacaaacttctgttgcagtgaaaatgatgtaatcaagccgttttgcctctttacttgctgatagtcaaaacatctcaagaagtttgtgttggaggataatgacatttccagagatttctattataggctgtaccctcataatttttttgttctaattttgtctttatcataggtaatcatgatattaaaattctatcactattctttggattcctacattcccttaaagctttttattggaaaattttgctttatcttacataaaaatctttttcatcttatataaggcaattacgtcgtttttcacaatcaaatatttattataacaagttttattttttaaacttaaaaaacacccttcttttaaaatagttcctcacatgaataaaattgtttcactctttaagtgttgagactgaaagcctttctcccatcagtctctcaaaatgtttctattattcctcccttttaacccattgctattttctttccttcttccttaggtctccttaacctcctcctgttttttattttctctggttttccattaacattttaaaatacactttaatgagcctcagccaaaggctctaagatgaacaaaagcctggagaagagaatcaagagagggaggacaagaaggaaaagaggaatagtgggcactgctctcagttttaaacgaatttctgtggctggctctcacttttatagctggacctgaatgctacagcacttactaaggccactaaatcatagcaaagtaagggtctggctattaagaattggaccgtccttaaatcagggattattactgtaatctttacatttaaatattacatatatgggctattgaaaatgtagcaaatctgctcactgaaggcctttactctgttgatatctgcattttcagggtataactggcagtccttttaaatatctgttgtatttattttagcataaaggtaatgctttgtatttttttccagtttagaaatccaaatgctaatatatacatgcatatattacatgaaaaaagcataaaatacttgaaaacataattaccttttagatgctaataaagcaagaaaaataagttttttttttcttttcatcactactttttgacatgtcggccaataaaaatcaactaaagtttaccttctgttatattagcatcagtgactttctaatttgcttcactttctccatttgtgcttaggtatgacactttttgcaattccaaattcacatcacctctctagttcctctcttccaaaaagacaaaaagtcccttgcatgggttggatactctatgtctctgtttagggattcatttaacagataccccagcactgccagtaaacaaacggatgccttgaacagtgatggtttacaatggagactgacttctttctttatttccctgcattccaaaattttttttttttattttctttgtagtttgcctttgtcacattggcatgcagggtgagctcgggtcccagcaaatatccccaggatggtaaaattagtccagaagagaagttttattttgattggctattgtattttcagtctgtcatggttctctacttctatataggaggacaaattatttgggccaaacaatacaatgtggtttggaaacaattggcttttatgggcacaatcttattctttccatatccatttttttaaaaattgtgaaaatcaagccaatttttttttcagaactatgcaatttcccaagactcatggaaaagacagcttgggttgaattttttttttcaatttctgcttatggggaaaaagagttggttgtataaatcagcatatatatttgtccaagcattcatacattgtgtttggagtattagtggaaaagagtattttacataatgggctttgtcttctggtttagttcttcaagttcctgactcctagtccaatactcataaatcaagcatattcaggcaaaaagcaggtaattgagaggagctattctctgggtaattccatcctcttttttgtgcacacatttgcaaatgtaagtggttttcatctgtgcagacacccttgaggggctcgtctatcctcacatcatttttagacatccaagaagtttctttgtaaaactcttattctgtgatgccagatggttgatgccaccctacaagaccatattttgagtaaaaaggaccagtttagcaggtagatgaaacaacacccattacaattattgttgcatctcctgattcagtaatggcaaaatgtacttctcatcacatgttcattccaaacacaaaaatgagtaaaattcatatggttttccttttactctaagaattgggcacagctgctcccttacaagcattaaaaggaaaaaataaaggaaaaacgtctttaatttctcgtgtttttcagcatctcttcgaaaaatatcttagtgatacatggctcaacagcctgaaaatacctactcttgctatactcttaagcatagttttccttcacattatagtatgacagagggaagatttctaatatatagactggggaatctaaggaggagaaaatgaaaacttgaaataatgcttagtcatgctattcaattactccatggcctttttttttttttttttttttttgcagtcttttgtttgattcctgatctatgcagtctctgaaatgagtgtacaattcatttaccttgtctgaaaaaaaagttagtagttacatatgtggcaaatattgagtaaagatgaacattttaagtacttgttagactttcaattatttgggtttttccagaaaattaaaatgcattgatcacaaatgtaacagtacttggtttggggttgtataatcttcaggaaattatatgtgcaataaattaatgcatcaatataaccaataagcatttgttactgatttaaaaaatactaaaataaacccaggtacccaaaactattgtctgcttccatcataaggattgactagaaatttcccgaagaatatctttagatgacaacatagatataatacataattcaagttattaacttctccatttaggcttatagatcttatagacacaactgttttaaaagaagaacaagattttcatgcaaaaatatgaattatacagtagttttactgagtctattgctaatgcacatggagttcagaaccataatgacgatattgggcacttaagtcattagcctgtcatattacagcaaaattatttgtactatataatcattgtttccttttttatattgcacagatctaagcttagttcatctatctttgccatagcagtaccactttattgttgtaaatacctattttttaacaatgatttgagtatgttcgttgtagtttaagttcatgtttattagacctttgcttccttaaagctggaaaacatgaagtttacaatctgccatagggtgccttgtttgattgtgtattacttcatagcatcaattactgtatagtttatattttaagtacttgtatacacactaaaaatttcaaggggaatgggaacaagttttttctggttttttttttctagcaacatttccatcttattcatcatatttaagacatgctcttattcttaatattaaaatggaattctgtttgtagtcaactttttttcctttagggacttttaaagatgaacatgtataagtgatctctgatgactattttcaataagaacaaaatcatttgtggaaaaaaaagctgaaactgaaagcttcagctgcaactcatttgtgaacataaggtgaatatggctgtggttttcagaactggttccagggtttcataaaccttttagaaatggatattgattattactattcaactaataaaactgctttctcagaatctgttttgcttgtatttgatgccataaaggattgtttgccctataattaaatcctagagattatagcacaatataactcacctagcccataggttgctatgggtttctttgtgagagagagagagagagagagagagagagagtgtgtgtgtgtgtgtgtgtgtgttgtaaaagttaagaggtgtgcatacttctgagtttgaataagttgtggctgagactatttgaattgatttcatactgggaaatggcatacaagtaaaatcagtagtctattcaaatcattgtacagtcaagtcagctaaatatatggcaatgaagaagtaaaatcaaacctcaaattgaacaaaaccagtctattctgtagtcaagtagacactatgtctgtctctctaacttctctgcccagaccaaaatcatgatttggagaatgcactgtaaccagacaatgcctatccagcctttcctatattaaaaaatagatcatctggaactgaccctttatgagaatttatatttttttactttgccatgagttttcaagaataaaatattgtgtaataagagaaaggatcagataagcattgccactttagaagctttataactgtctcaagcacagactataaacttcaaatacccaggacccctgagaacctgtagtcgacccattcacacctgacagatatattttaaagtctgggtataaatataattatggagagatgactagcatgagtgaaatttcacaggtagcatgctagaataaagcagcgcttgaaaatgggcatactaaaattcagaaacctaatgattgcagataaaagaatgaaatgcaacttgtacaacctgctctaccgatgtgagatacaaatacattttaaaactttttcttcttatacacccctgcccactgccatagtgagcctatcgctgagtcaggccactgtgccaactgtagcaatgccccacacgcgagctccagtgggccagttctttgtattgacacatacgcaagttcggacatgacacccagaggcttgctccagacctacaccatccaataagaatgttactagcctcatgcaaacactgagcatttgaaacgtggctagactgaattgagatccactttaggtatgacttacacacaagatttcagagacttagtacaatgaaaaggatatgagatatctcattaacaaattttatattgcttccatggggaaatgataatactttggatagattgagtgaaatatatttttaaaattaatactatttctttttaatgtggctaccagaaaatttaaagttatatatgtgccccacattgtatttctatatggaaagtgctggtctaggggtctgagacctcagccacatgctggactaccctttccaagaacctcaatctgactctctcactctctctctttttttttctctctctctctctccataattgtcagatacagagaattctctttatcatcctcatcctatttattgtcattagtcacacaggactcttatctttacaatgttttcctttgtcttccattcaccttgccaatgataaagatgacttagaatgatttcagtatatccatggatgtataagtatccttaaaaaaaatttaactttttttattttaatgtattctatttttctttaagaaagagctcaacatgatttggcactagtatctgtgaataggtcaataaggagaaaaatactacaactctttctaggtgttcaaggttttggaaaaaaaaaaaaaaagggaactgagagcctggatctcctctaagacctgttgtgtatataaactcaaactgtcatttagtgataattaccaatcatcagttcccttcttcataaaacattaggtggtttattttcttagagcatagggcttttccataaatgtttaaatgttagaaacaagagattaagagttttcatttttctaaaaaaggaattcataatattcttttgttttatatatatatatatatttcattctgggaaatagcataaaagtagtgtgtgtgtgtacatatatatatgcatgtgtgtgtatatatgtgtatatatatacatatgtgtgtatatatgtgtgtgtatatatatacatgtatatatgtgtgtgtatatatatatgtatatatgtgtatatatatgtgttgcctgggtaagcatccaaacctgtagatggaggtgattggttacacttcttgtcagtcattcatcctactccaaacaggttggcatatatatatatatcctgctccaaacagtttcgcatatatatatatacacacacacgtatatttatgtgtgtgtgtatatatatacacgtatatttatgtgtgtatatatatacacgtatgtgtatatgtgtatatatgtgtgtatatacacacatgtgtatcatatgtgtgtacatacacacgtgtatcatatacatgtgtgtatagataaagaagatatgaatatgtgtgtatatatgcacacacacatgtgtgcatatatacacatatgatacacatgtataaatgtatatgatacacatgtgtatatatacacacatatacacatacatgtatacacacatgtgtgtgtatagatacagaaagaggatatgaatatgtgtgtgtatatatacacacatatatgtgtgtatatatacacacacatgtgtatgtgtatatgtgtatatatacacacatatatatatacacatagagagcatgcatttatttttgtttgtgtatatatgcacacacatactgagcacttttttgcttaaagattatctgggaccagagtctctagaactgagactagagtctctacaaaactaagtaattaaaaaattggcaaaaatcctgctctgggaaagcctctctaatgggagagaagaaaaaagagatattattaaaagaagtaaaatacatattagatagtgatgtttagcaaagtaaaaacaaaaacaaaaacacagaaaagaaaggggatagagggctcctaagtggggaaaacttacaattttaagtagagaaagaacctaggagaggagggaatgtttggggacaggcctgaaggaagtgaggtatgttaccatgtggatgtctaagaaaagaatgttcaggtcagaggaagaagcatgtgcaaaggacctgaggcaggatgtgctcaagaaagagcaggaagaccaatctgtttggagtaggatgaatgactgataagaagtgtaaccaatcacctccatctacaggtttgaatgcttacccaggagacactcattttgaggacccatcttttactctgctgttcagagctaatctatctgaaaagtgacggaaattaccctatggcctgcagaagcaaagcaaagggtctcctgcctactaatctactcccttacccccaaccgtactcacagctcagttccttggatctttagattctccccagagctgacattccatctgcaattaatcaagtgttgtgttaaattttttttaatatgtaaaagatgtttcagctgtgattatcaaagtatacaattgtgtgtcctaaggctacatggcatgggatatacatctgatgcaattctgatcattatcatcactacataaggtaacattgttccacatttatcaaatcagacctcctgccatttctgtttgggtagacacggcataaattttaaattaaggtgtataaaataaaagatttctatatatttttttaaaattattattaggagaagtggtagtagtaacccacaccatgcattcaccagggagatttatactaccagtacatttattgctatcaagttgcaattaacaaacattcatgcagttggagaattgggtatgcaatgcgtcaaaagtgtgagaaaatgtactgtctcaacaggcgattcctagggctcttcctattcaatatgaacatgactttttaatgagagctagtattaatataagcttaatttaattttatatacttattccaagtttcttaaattattcatatcctctttctgtttagacgcatcagtattgtgaggtttaattgttagctcccaaagcctaaggactatctctatttaactcacttttcagctaagctagtgaaagctgtaaattatgatgatgatggggggaatgatgaagaggaggaggaagggaggggaggactgtaatctacttgagtatatataaagcactgtgatattgtacatcatagtatttaatccttgcaacatggcaccaagatctttttatccttattatgcagatgaggagactgggctccagggaagttaagtcacacacttgctaagtggtagacccaggactcaaaattagatctcttaatgcgcaagcctgtgtgctttccaccatacatcttgctctgatactattcaattattaaacatttttattgatcaccgctacatactaggcttgatgacagacagtgtaggaaccaccattaaactccaaactagaacgtgaagacccacctcaccccaccttcagcctcacctccagtttgcattccaacaacattttatttcttgtggccatgaaatgagaaaagaaatatttttgccaaaccatcacatgactcagagaaattctcagctggccattgacttgcaatggagcaataaatttccattttcctttgcaaaggcccacctaagctccatgtttctgtccccctctgctttccttagccattgcattccccagcacttgttcgtgttttcacactaacgttcacaggtggccttttcttttttctgctgtgccagagtgcaaacagctaaactttctttctgatgactaagtgaaggaaatatttcctggtggatatttcctaactgaactgcttgacaaaaatggggagggagtcagatcctgccagaatatttctcttttactcttggttctgctttgacagtttggaggattaagggacaacaatgacagtagttcttgttattagccatgtcttaccgtgtctttctcaccattcacagtgtccctgttggaataaatgctgatgactacatctgttgtgttatttaaagtagatctttaagtcaaaatgaggatgtgtgcgcactgcctcattttgagtttgcttaatgtttccagccatattttagaaataaatcccaaatgcttttttgctaagtgcattttcctttcgattttaaacctatgtgtattttaaaggtcatttaatctgtgcatttccaattcctccagtcttaaatcatcactgtgttattttatgtaagaggtacttaatgtctcaagaagcttttggaggcctttaaaacccaaagacttttcttttccaagaccagaagttccattttgtgaagagtaaacaagcctgaagaagaccgaaatctcagcccgttcaatagtccaaaagttcaagtttcagaggggttggaatttggcgaaatgaattttcccatccatagctcaatcctctatattccctcctagcttaggctgaaacacatggaaattatatccagcaggcactcttctcagtgacatctgcatctgtaggggtgtcctggcattcagcaacaaaatcctcttcccccagggaaaaggaagactcaaaaccccaaataataataatctattacagatttcaggttaccaaaagttaaagaaatggataaaagcaaaacacttagcattgctacatgtcaaaaggaaggctactgtaatcaccccccacccttgaggcatgtatttttcaggttattatgcataattatgcatacaaatttaaatatatttccatattatattcaaaactgcccaattcttaaaaaatgtaggataaaacaaaattaattgatggcaattactgcatttagatttaaatctaaaattcctggttactggaagaattgggccagtagtgggcacctcgaacaacagaactgtctcttctggaacattcttctggatttaggaacagtgtttctctaaaattaaatgtgagattagagaggcataaagaggtgctgacagaaaaccagaaatggtgattaagaaatttggattgaacctttatttcttactacgtggccttaaccaaatgatttaaacaatttgggcgtctttttcttcatctgaaaagctaggcgcattcactccatgctctctcaagttccctccagatttaatatttcatgtttctgagactccaacatgaactgtgcccaagaatggggttatctgacggtcaacaacagaaaaaagcttggcaatttgattacaattaactcatttaggaaagaagtaaaatatttgggataacactggagttttggcagtaagtaaatctcccatcacaatttttaaatggaaggaagagttaatccaaaagggtggctggaagcagaaagtagttccatttgtcacacacatggtgaccaccatcaccatacagcacccagagggatttcaaaatggacaacacataaaacaacctatatccagaccacatcaagtgtcagaatgatgtggatctttgtggggcttttcctagttttctctccttctttagaaatgtatgttatgaattatgattattgcaatagagccaagtattcaccgggctccagctagatctttgtttagtgagcataagctccctgccagctgcaaactgcagctgtctgtcagcatttgtgaggacaaaccaccccactatccctgatcacttagccgtagacgacatactgtgtcctcagatctgctcagagcaccccttgcatttttcaatacacttcctgtgggggagggcatcagtgcttcgcacgcacattttggagcaaatagcttaaatcttatgtcaaaatgatgcttttaatagagggttctgtcccaacaaaactattctgtgagagactcactgactctggcctgacatttccggatattcgatgtcctgaaaaaggcaagggaggctaccactctgacaaccaactgttcctcaagacacagtgggccctacagagggtgccaagagcatgggccccaggccaggaacctgtcttacagctggggaatgtgggggtaagaaggccatggcaaaggggtgaagccagaggaagggcatagcccagggtgcccagagcagccatcctcctgggccatagcttacagccagagacaagacccaaaggaatccttatttcaggagaaatcgttgtctagaacattcaagtaaacttggaactctgcagttttagaggggctttgagggatgatacatttttcttgactctcatttgccagcctcctatgcaatttattttcctttaaattgcaaggcatgctcagaatgggagagaaactggcagcaccacaccagatttaattaaagcattgttggagttaaccaagagtctcccctgtttttatcaaaagtgactcatgtgggtgagaaaaatcatttttagaggggtgccaatttcaggaataccctgagaattaccctcggaatttaggaatactctgctttttccaggcacttgtatacagtaaacttggggtttcttaaaggataaaaactattgctgaagtttctttgggctctggggtacttctgaaacactccaagaagcctgagctatggtcccctagtacttgtggaaaagacttctttgaaacatgtttaataataatattttcaagtaaaaaaaataaatctggaattcttcctactcatgggggtattgtgagaatgctctttgttatgtaagagtactgtttcagtaagaactgtgtccccttgggaagaaaggcacaatgcaaattcaaattaataataaaactgtacaatatgtagcatatgcccaaagttggcttaagtcacataatgaagaaaacattctaaggtttgggaaaagactcagccctatgcatatgtgtgtgtggagctgtatgtgtttatgggcaggagagcactgacccaacataaacactttctttcccacaacttaaacatatacacaatacttaaaatagtttctttcaggagtagaaaccatgagagtcacagggtcattaaacaatagcaaagctctgttagtccatgatctttccttattcaagaggattataaaataaaaacaaagattctgcaaggaatcaatattttgcaaacacatagcaatttacagtacaagagtatttggattgctaagtaccttcacttctgtgttgctgtttgctgcttcattgtgaaacctttttgctggatgtgttacatgcgatgagcttgggtgttataataaacagagaggaaggctgcaataatgtatttcagttaggaagaagcacttgaaagaaattgcttttgctatacacatgatgtgagccaatcaatagtggtttagtctgacaagccctgtcaatatccattgtcacagttcagaaagtcgttaatggatagttcttcaaaacccaatgattttaacacatgttcaaagtcttgaaatacactctacctggcagaaattaatcacaggtaactcttgggaaagtatacaagcatttttttaatgagagccaaatcatttacacacacacacacatgctcgcacacacacacacacactcgcgcacacacacacacatatacagcagctaagggtctaatctaataacaacagatgcatagtgaatgctcagtaaatgttgaaaaagtgagagacactgggatggaggctgagaagggtcctttttatacacctgttctgtaaatttaatgattattacagtggtgatgatgatgcaggatgcctatcatattttaattattaatcatattttaatcattaatattaatctattaagattaataattgcttctgttaactacatatgtattatacattagacattgagctggatgtttttcctatatcagaacatttaacatacacaaaaatccttggcatggatattattatccccatctaacagatgatacaatacaggcacaaaaaactggcatagcttgaataagatacaacgttaagtgacagagttggaattcaaaatccaaagcctatattattcaaaaaagaaagaatgggtaggagagaaaggaacacacttgaaaaaaaggaagaaagaaagaaaaaagaaagaaatggcattagcaattggaaggaagcatatcaatggttcttatctgcttttccccaagtcctgatcctgaactcttacactcagttcctgtgaagcaaccaggaacaaaacaagcctctgagctctggggttgggcatagagaagaatgggatttcccagtttggctgaaagaagaactaaggagtttgcagaagtaaatgtattcacttacactgttgtgggctaagtgtgtgtctgaaaaagattgtgtgagggcaggggtaaaactgaaagacacagctaggttgctagccatttttgcctgaaaggaacccccaattcccacctacatctctccttctgtgttcattgttgtcttgctgcatagagcaatctggagcatggtgagtgatttgtcttctgcccagtatgcatccttgcagcagaactcaattcatgtccatggtggttacagttctgtcctacccagatgtattcttcaactgttcttattggcaatccagagagtattcagccaccagctccactgttgtcccatgattcactcatcttacctaagatgactctttttctctctcagccgtacaatgatacacaccacatggatagtttcagtaatcagttcatggtaaagcagatgatttaagaccttaggttgcaagtacttgagtatggtgaggcaagggggtgggggacattaccatctctctatgtccttagacacggtgacagcattgccacacagatggacaggcagggccttagggcagggaatcagacaccacctgagttgtggttctgccactgatttgctacttggcttaacttctctgaacctcagatttctaatctgtaaaatggataataatggaacctaccatattgataaggattaaatgagatcaatgtgcttagtaaattccttattatatagcaaataacttcaaaatattagtcattattataaatatgacattagaataatccgattgtctagcaaaagtggaaattaagactattttagaagaattatgtataacttataatctaagaaacattttcccacttcttaactattgattatttggctttaagacatttctcaaactatctgcacatgtcatgtatgtttttctgtcctggctgaaaattttgtttggaaaattaaggatacattatagcatattctttactaaagatacattgtaacacacagtccaggaatttagagatttaaagaagaagcctcaaaattactatatgttactcccctctatacctgctgagaatgtatctttacaggcatttttacaaatgtgcaaacaaatacgtacatatgatatacagtggtagctctcactatgtatgtatacatggaaagagtatttaaatgccactcaactgaaatactgctaatgatggttcagaatctgagtccatacatcagtactgaaatatccaatattcttatatatgcatgtgttttattctccaacttgacttacttttttgcggaaatctaagtgttaatttcgtagaaggcagaggctatcacctctctggtggaattaccacgcctacaactctttttggggttttttttttttctcttttatggactgatgttcacatttatatttaaggctcttctcatttgatttggctgtggcctgttttctatcactagaagagaacccattcctgtatttaatatacaatctttcctcatggaaaacatatttctgcttcacagtgccctttgtgtggattgatgccctatgatattttcttcttttttttagtaattcagctttcaatatcagctactgccttagctcaataaccacttactttattagcaaatttatcaaagttttgaacagctctcaagtgacaaagttttactgacactatatcaagtcataagaagcccagttaaaatatataatcaatagaagaatgtctaaatgatctgaatctttacattttacactgtatctcattttgttttaaggaaaaaaaaaatgtcattgtgtttctctacatacaagataggttttgctgtttaggtatattttccctctttttattgtttttctgaaaatgtagtattttcataacctgtgacgcaaaaaaaaaaagtcattaaactctggcttataaaaggaaaccagataaatctatagtggaagggaaattaaacattgtgatggtatacttaatatttgcagtatgggattgaagttatcaatcatcattattaccattaaaagtactcactatgaaacccaaagctatgctaagtgctataacaaaaagagtttaaacaaaacaccctgccttacactatagaaatacattatcaatgtagatacacctaagatgtattacgagcaaaataaaaatactaagtctatacatgaaaagacagtgaagaatttacatcatagacaaatgcattagaagtagaagacatggatacataaattcctgagaaaagtagccatgaaattttcctatggctgaattgacagtagacgccagctgttcactgatatcaaaaatgcaaaaatgtggttagatttaactacttaaagttgataatgcagtctaaaagtaaacattttaattgtatgaattttcacttctccttaaatgggtagatagcatgaatattaatcatggaatagatgatgagtacacacccttctgttatgaatctaattgtctattttgtatttccacaatgtctaagtgggaattaagtggttaaaactgagcactgcagttaaagtgcccagcattccctctttcaattatttccagatttaatcatgatttgtgttttgagcaagtcacttaaagtttcaataacttagtttttcaggctgcaagttggggtttgaaattatgacttctatttacactgagcaagtgaaaaaaagagatattaaatgaccaacagtacattaagcccaaacttaccctttctgcccactctgacatagggagttatgtgcaaagttctgggagctctgaaaccacaggcgggggaaggcaaagcagtatttattacagccccatgaattagcacaagcgtgaatgccctggaaaggaataaacaggaggctggaaagaaatgtaataaacttgatttctttttttcaatcaatttgggataaggtgctcttatttatgtaatttggaaagtagttaagcagggtaattccaatacaagaagtttgtgttggaaaatgtgagtggagataattcagtactttgttatgtaatccctatgatggtgtgagaagagttttggaacctctggggattaagagcctgacaaaaccttattttgtcttttttttttctttgatttcctgctctgaatactgcagagtggtaagatgatggcactaaagctactgttgccagctttgcccttgatgtccttttggaattgaattgaaatgtttagagctcctagctgctaacaaaactatctacctacactgatgttgatctcaatgtcaaacctcaccgataaagtgagaacaagtagtgtagaaagctgtgtgtaatagcttttctgaagtataatgactccactttcctttagcaacatttctgaaatgttggctgtcccagcacttccaaatttcaaaaaaaaaataataacaacatgtaattgtaacatgggaataccgcgagaacagcagtttggcaggaaaagaaggtatttcaaaataaggtccccagaaagagatgttctggcagatgcacaattttggatcatattatccaaaccgttgaattctggaagatttgggggttttcttttttggttcccataccctaaatgggagtagatattcgtcgtccatccagagggcattgtttccccttcctgttactaaagtgagaaaataagtatactaagggcacccatttacagtaagcattcgtagctctagaggtgatttttaatagcacaatagctgtgtcaggtataacacttgtgttgggctaatgcctattctcatatgtaatactattaactgaagatcatcttagaaagcccactatcctaacatcttagaaagcccagaattctaactcccctctggtgagagcagttttagcaccaattaagtctctcaactggttaagaatggtatttaaagctaatgcctttggcctgtgtgttgagatttgaattgcctattgttattgaaaattctcagtctttgaaaagcattctatttgttcaggcttgacagaaaagatctccaatgggaaaagcagaggaaaacataaaggaaatataagtaaattctagaatacctggaaagctagtacatttcaggttaaggttaatgtttatggaggtaaaaatacctaggattaagagtgattgctctagtctcttatgcaaatcagattaaatatttcagagtttaaacccatatctcttttggctctatttattttcaaataaaaactcaaagtgggaatggaaaaaaaaaactactcgttggcttaacataaatctttaaactgcaggaagcttcaccctcaaaaagtagttgaatctctgagggaaaagaaaaggctgaattctatttttcataaatgatggattattgtaccacactgtgtattttccagtaaagtgtccttttatttgcactgtgtgattacaagtttctaaaagtatgtgtggggtcacttgggtgctgtgggaaaatggaaggaacactgttctgttaaaatcagtagtgaaatcagaagcaaactatgtcccgattatcacaggcatgtgtttaaattttgctttccttaattggttatgttgtatttacttaaaatg

SEQ ID NO: 2478 - DNA, 27687 bp, Homo sapiens
gaaaagaaattatactggagataagaaaatggctacaagtaagaaatgtcttacaaaaagtatttgcataaaactccattaataactcagaaaacatagataatattaattatttttaggaaaatttaagcctagaaaattaactcaagaaattgaaattttctcaatagaaaaaatttgaaaaataataaaatatctgtacctgaaagagcataaggaacattttttatagatgcatattaccaaaccttcaaagaccaagcactctccatgttatataaggtcttacacgtagaaatatgaaaaacaggcagggcatggtggctcacatctctaatcccaacactttggatggcgaaggcaggtggatcacttgaggtcaggagtttgagaccagcttggctaacatggtaaaaccctgtctcttgtaaaatacaaaagttagccgggcgtggtggcgcatgcctataatcccattacttgagaggctgaggcagaaccgctagaacctgggaggcagaggttgcagtgagtcaagatcacaccactgcactccagcccgggcaacagagcaagactctgtctcaagaaaaaagaaatatggaaaacatcccaatttatttatgagaattgaataaccagaaaacaaaatcaagcaaggatagcaccaaaaaggaaactaactgcaggctgatcatgatgatggtaggatttcaaaatacaatattagtaaccaaatcttgttgaccaagtgaaatacttatattcagagtgcaagtatctctaacaggatgaaatttgttttggtatatcctaactaagacacaataaagaagaaaaatcaagtgatcatctcattcattgtttaggaaaaaaaattgataaaattgaatacctgattttagagaatagtggaccacaatagaaatagattatcataggaaaaaatgacttatgtaaacaaattttaaaaccataaaatttaaaacctctttgtgactaaagatactacaaagaacataaaaaaaggattggcagatgaaaaaaatatatttgcaaggagggaaaatataagacagcacctcgaaatgcataagaaatatgccaatagataactaaaaaaaatttaaaggcaaataattaaaattttgaataagcttatagaaaaaaaagtttaactttactaagagtcagggaattgcagcctaaattgggacaccattctcacctatcatgttgataaatattaaaaagtaaaaagattaatcatgttccgttttaaaagaatgctggtgaaaggcattcttattcaagatgatgtctaggtgaaaggcaaagttatagcagcacaatttgtaattgcaaaaatgtggaaccaaaccaaatgcccattaatcaacgagtgggtaaagaaactgtggtatatatatacaatggaatactactaagccataaaaatgaatgaattaatggcatttgcagcaacctggatgagattggagactattattccaagtgaagtaactcccgaatggaaaaccagacatcgtatgttctcactcataagtgggagctaagatatgaggatgcagaggcataaaaatgacacaatggactttggggactcaaggggaaagggtgggaaggggctaaggcataaaagactacaaatcaggtgcagtgtatgctgcctgggtgatgggtacaccaacacctcacaaatcaccgctaaagaacttactcatgtaaccaaacaccacctgttccccaataacctatggaaataataattaaaaaaaaaaaaacctagatgatggattgttagttgcagcaaaccaccgtgacacatgtttacctatgtaacaaacatgcacatccttcacatgtaccctggaacttaaaataatttttaaaaaaacaaaaacaaagggtgaagttacttggtctcgtggcatataaaataatagtctgtattctccaagtctttcatttattctttcaataaatagcactttctctttgccaaactgaattaaaggtcctggggaccctgcaagccataaagaggcaaaattagagtttctgtcctcatagagtttgccttctaaggagaatccttgctggtttcactcgattgcagttggtctggtctccccgttgttctttgtcctctgttactctgtcatgcttgcctggattttgttgttgttgtcaatttgctttggtttgttttctagctggtatcaagctgctcccactgccaaagttggtaagccctttcttttgttttacttctgaggtcccttctttctccagcctcttggtcctgacctcaggttggagcttttagtgcatctgtaattgttctcacgggcacagcaacgcaaacacagtaacacaagccatttacagactgtcttagtcctaggcatagaccctgcctctgcccttgcttccctgcctgccacttcccccaccacccccccacccccacgcccccacgcccccacgcccccaacaccactccaccagaagcttaggatcaggcaacagatttctctcagcatactgtctcacctctaacccctcttgggatgggggtcaggactaccaattcgcttttcagggattctggcaggcgttttcactctaatagggattctgcgaagtctctgtggttgaggtgctcctttccttttttgcttcttagaagttgccattgaggtgaaaacttctttgaaaaagttggtctaagaggtattggagaatgtagtgcctgagtaagcagaaagattcaacctgggtctcggggggtcttaagtcaggtctctttatccccttctacataggatttaattgctgcagcctacaataatatgctcattacttgtcacattttctaattgcattttgtaatttatctgtgcctgatgatcacacctgtgcattatggagatataccacacatgcttatgcataggtgtgaacggttacacatactttcttctttctcctgccattcttttgaagagtttctcttatttcacaaaatgcactaggagaagagcatctgggggaagtaaaatgagaggggtggtttcagatacaccttgttctgtacttgtctgtacttaatatggataattagatactctttactaggtactttgccacagggttttcatggattgcatttaattgttgccacattcttatgcagtggctaccctttttaatctctacaggtgagacagaagcaccaagtagtgaaatgacttgtgcaggactgagcttgtgaatgacgggcacagatatgaccaaagtggtatctgccaagcccatatgtttcaacttgagcgatactgtctcttgctgttctgctacttttatgttctgcttctgcactcaaagttataggctttcattttgttagacattataaagatgtaaaagaaatttaagccatagtccaaaaattgagaatgccatatgatatatccaaatgtcataatattacatgactactaaaaagattgtttatgaagagtttatagtaacttgagaaaccaatttttggataaaggtaaaaacctggatccacaattggatgaaagtttctgcaactgctgatggagtagggtttcacctgccatcatctgtagaacaagaaactcaaactaataggaatagtatattttgggtacaataatactattttttattgtcagaaaatttgcatggctttggattagtaccctagtagcacctgttagcttagagtcaattgcagagactgtgtcctgtgagaaacacatgctacaggcccaacaacaggaagaggataaagggatagtggcctcactggagtcatcaggacagccccgtggtaaatgatgtgatagaaaaattctccccatctacttgtgctgagcctttcctttcttggagttgtagtttctcttttgctgagacacctgttgtcctcaagttcttctccaggcctctctcaaaattccatttcaaatacctaaggctaagtgtaaatattcaaatgaaactgtcaaaatttactaagagatataaataaaaccttgcaatagtgagacatactttcttttctgaggtggaagtcttactagttttaaattttttgttcgtcccaaattaatatagatataatatacaatcttatcaaattcccaataggatcttctggaggaagagaagaaatatttaaagttcacataaaagatttagggtccttcagatgatttctaagaattaaaatataaattggaaaaattacaaagaagtaatacctaaagcttacaatggaaaaattaaaaataacacatttatatgtaaataaggttgtcccatgaacaatgtggatttgaattgcaggggcccattaatatgagaggggtttttttcccaataaatacaggggtctctctgtatctgatgtttccacatctgcaaccaagagtgcagagggaaagagcagtattcacagaatatgaaacacctgatattgatggctgacttcttgtatcgaagatttgctttgggctaatggtgggactcaagtatgtgcaaattgtggtattcacagcagccctggaatcaagctcctttgaataccaagaaacaaaaataatttcattaaaagtgccattcaaaataaattggggaaaatttatgtggtaattgtcaccaaaatttaataaacttccttaaaactgcattccaatcttaaaaatactaaaacttaaaaatgtgtaagcacattagtaagaaattctaagaaaaaaaaaccacaaatgcctaattataaaagaaatgcaagcctaagaaaaaaggagtttcttataaaattcacaaagtatataatgtgttacttcagagaaaatatgaattgaaatgggcttatgctttaaattttggtgagataatacaacttggaacaaactttctagaaaatgattagtaatgcatttcagcagcctttcaaaattcttttatttgacctagtaattctatttctaacaatctcttctaagaaaaacaaatcagaaatcttaacaaaaagtcatgcttatgcagcgtgggtttatttaactaaattgtggaaaaataggaagacacttcaatttattaaagtaaatctctataacaaaatgttaggaagtcattaaacagatgctttcaaagaataatgccatggaaaagccttcatgatatgttaaaaaaaataataagatacgatattgtatatttaatttgacctatgtatgacctatatatatatatacaaacacatatatatgtatataaacataacatatgtattaaagagtctgaaggaaaatacattaaatactaagagggatattttgagtactatgattagaagtgtttttagtttttatacatttctggttttgcatattttaagtcttcgagtatgcatttatattcagaaatagtttgctttaatatattttcctaagaaaagtaacagcaatatctaaacaaaacagcaatatcattgaaaatgtatagaaaaatatcatcctttcacttaattgttttaaaggcttcatctaaaggaataacttaattaaaattccagaccttagacggcaggtttagggaattagtttgtcatccaaagaggcttcttaaggctcccagaatcacactacatggcaattgacagtactgccgatataagttttaaggtcaggtcaggatacggttactgaagtctcacttacggacaatgtggggaaatgcagttcaccaatacataggcatttacccaagtttctcaaatgtagtggcagttttagaacacagcaatgataatgggctaggtggaggagactcaatttactcatttttttgagcctgcaaattttggaaaataatgacatggggaaagaaagggatgaacagaagatggaaaaagaaaagagagcaatcttagagcagcaagcaccttgaattgtagtcttgaaggcagcacagaagaattgagatagctgggggaattgtattgtgtatctgaagtacaccagctctgtttcataggccttgtgccatcacatcatctgggttacattacaaaaacactctactcctcacatagcataagtctctggtaattttggtgcaggaaggatgagtaatttttactatatttaattatcattgtggtaagtgttctctgaaagccttgatgtagctgaagcctctgcggtaatttaccaagaagtctttggagtccgcttagaatcttgccatcctgggcccttcgatgaccctgactttttgtgattttgcttaagatatcctatcaggtatctgcctgatgtcatgggagcataaaggcatgtgttgatggcaagaagaccatggagtcttattctctgataatgtttattccacatctgtgatttgtgtcctacaaggctcttgggacttaaaccacatgtgctatatttgcattaatgggaatttaagaaggagaggccataacactattaaaatgtttagctttcgctcccatcacacagacacatgctagtaactactcccagatcttgtatcatggtgctgcaggatgcaacgtggagtgcactcattgtttcaatacaagggacttgaaaacaaatagctgccatctctgtctctgatagtttgccaggcttttaacttctttggtttttccctctccagatcatggtgaggtatctcagatgtattccaaacagcacattgccccatctttgtttcttcttttataaaggaactcttgctttaaggtatatttagaaaacctagagtctaagccaaattctgaagaaccacatgataattctactttcaaatggcaggaaaggacttagtgcagaatcacccacacagggttattgatcacccaggcctaatagtcacaaacgtgacaaatatgctggaagtttttcctaggtttaaatatccaactgttaaattacatatgaagatattttgaagcatcttataaacagagaggcagggagggtgcagggtgggaagagaaaagaaggggaagggaaggagggacaaagggactgggagagaaagagggaggaaaagagaaagagagcacatcaaggaacagggcatgaagatcacatcttcattactccctaggccagagtttttcaaattgcaaattctgtgatcctttagtgggtcacagaatcaatttagtgagttgggaccagcatttttaaatgaaatcaattaaagaaaaaaagaaaccaggatagaagatatattacatcacatatagtaaagggaggtattattaaataaaacttttgtttcaattatatgatatatatacatatataaatgaacatatgcacatggtgtatatatatatatatatatatatatatatatatatgtgtgtgtttcattattatacattgaataatagatgaatttatgtgtagaaagatacctagatgacagaaagagagagagtgtgagagaaagagaaagggggggagagagagcaagaaagaggtactgattggcaatgattacttcttaacatgtttcatgaacaaaaatgtttgaaagccatcaccagattatacctccaggacagtggcttctttaaatttggaatacgttcttcccttagtgcctcctccacctgcattcaggtaaattaacaagctgcatataagtctcatctaattaagccacaaacttttaaagaaaatgttgtggatgaaactcagtgaaatatgaatccaatgctgtgagcctcaagggtagcagattacaaacccaatactggttctcatgatagaaaaatgtcctccttaatgtcctactccccaggatactagagaatgataaatggcacaatagttgatagtaagcctcagaaattgagggagaaacttactatactgatgatctttagatatcatttattcagggattgggattattgtttgagatcatgaaaaaacaagttaatggcaatggaaccatcttgatgaagcaggcaaaaaactatagttgggacaactactatggaaaagtttgagctgataatattggaaggaagtgtgtcttctggacagaatacagaacccaaaaagtaagataacaaaattcagttcaggctgttagggtgtgagttccaaccagaaataacaaggatattttaaagaccattggatgattgctgaatacactgacatgactcattttcagatattcttataactatggtgccttgaacgcaagtatggattatttcttgattacatgtgtaacaattcagatgggtgaggcagatggaaggtggatttaaagaactcagtgaggtgcaatgaggatcagggagatgctctgcagagccccagttcctaaaagggggcctggcaaaaggacactaccagccgagagagtctggtatgtgagataaaccaccagaatagggaaccacaagccggaagcaagaagaggatacagctacagaaatgagctttggcaaagacaggatatccaagactgtgcattctcaactctcaaggcctgagatcacgtcaagtcactttgggttatagcaaaggtctttattcaaataccaagcatctcaaggtggagcatctaacattgaaagcagagaagcatctgttgagttgtgtaaaagaggaaaagatcaggaaccagaaagagctggagaaaccccaggggcccatggaagaggtattcttcttaccaagatggtgtatcatcttttcagatagatgcattgatacaaccttagaaggcagtggtatgttgacagttatggaagttgcaatatagagccagctttaagaggatgtcttccccactgtgacactgtggaatagctcactaatacaggttctcagtgactaatcattgctttcctctttactagtataccaaataaaatctgttttctacatttcataagcctttcattatgtggataccaaaaccctttagtattaacctaagccaattgagctatcattcattctatacccctttattgagagctggtgctattccagatacttggctgaatgcagggacatgtggttttgtggtcagggagcttaatgtgtagaaaggtcaagacactggatgtgtacagtagtgagatgcacaccattatgaagttagtacaaactgctggagggatacctcttttttgacctctagatgttataaaggactttccggaataggcagtgtctgagtagtttcctgaatgaagaggtggagtttgcaaagtccaggagacaatcaatgaatcagtcaataagtgaaatcaaataataacataatattttaagtgctaagtatgtaccaggtattatgttaagttcttctcctggattgtattttatgtagcccttataatggtcctatgatgtaggtattattgtttttctcaggttataggtgagaatatagaaacacaaaaattttaaataaattgttcaaagttatgcagttaataagtagaggaattgaaaaggttagagacagagaaattatgaaatgttttgcaacatacattaaataattgaggttttatccttgggataaaaggaatccattcagtggcttttaagtggcatgtgacagatatggatttaggtagatcatctttctatggtctagagcagcagactccaatacagcataattttcaaatcactcgtggagctctgtaaacagacagactactaggccctatctccagggtctgattcttttaggtcctagtgaatgtgagaatcagacttacaaagatctccaaggacaaagttgatgtcagtcaacttaggagtttactgatgagtggatgtaaagaatggattgtaactataccatctgtcattaaggaggtcagaccagaagtcacattggtccgaattgcaatagagttacacattagggatctattagttttacaaatctaattttttttaaaaaaatgagaaatggtaatataattctggagcgtgtctgtaagggagaagaatcatgtcttacaggaaaatgtttggtaacaccaccatttaagggatgagtgaagggaaaagattccacagagagggcatagggacagcttcttcatgtcctttagagatgctgtatactttccttcctctgaatctttgtacaagcttttcctttcacctgtgttgtcctcttaccctgccttttcttctactaaatctcatccatccttttaggatccttctccaacattcatccctgggtcctccattataccctcaaggaaagtttgatttctttcattgaaaaccattatgtgtcccatcttgaatccttatgtaattgttgtttctaatgttttcacatgctggtcttttctcacactagattagaagcttcttaagaggaagggtcactgctaacttttttgtatacctcacagttcttagaattggaccaatgacaggtattcactaggcacctaaatggttattaaatgactctcagtattgtgtgtgttggctagtgatccatatgtcccagagacacaaaataggcctggtttataccagttgtcctggtgtgttattaacagtgccttttgccttcagcattatcatagtttcaacaataaattatatagtcaccctactgatagtgctaccaatacattttttaaaagtctagcatctttaagtggtaacatttcaatacaaatgtcattttgttttggggagtaaggagtgttaagatatttttgcacacatttggcatggagtgatatgtcattccagatgtctccttattaggtgggtggcctgttgctcaattgacagatgtcattgtctattatagagtcacaggtggtttattttaataaaaataccattaaattatctctatttttctgttgtgctctctttatatatagagagaaatagaacacatatgtacacatgtactatattacatattatatataactttatagtatgtatgtacatatatgatacgtatcactacatcatatgtcactatatgtgatatacctatatatcatatatagtgatatatatatgaacatattacatgtacatatgtactatatgttttgtaaaccactaactatagttttagaaatgtcagatgctttttcatgtttggtttaaagataacccttttgagtaaacagttaggaatgttctccaaacagcagaattacaatttttccacattctcagaagaaaattttcaacattttcaatttatttaagcctctcattcatggaaaaagaagcattactactcattcatgaacatcttaattacatagatagttagtttcattcctaatgaatgatcatgctctttcatggagagcaaaatctagattgtcaagctcttggttaaacacaatttcaaaattatgagacaccaaaagtaagtttgtagtattacacttacttcttgaattatgcagtttggattctataaaaaagaattcactggttaatttccaaatctccacctaatatttgttcctctccccaaagtatataacttgacagcagagaaggaaatagataccgttctttcttgtgagccacacactctgcaagggccattcctagttctgctatttcccaggacagagtatcaggaatcatgtgggaatagttcatatgtgtgtgtgcctgggctaatctgtgtttactagtgtagtacagaggggcactgtttatgtctgagaaaatagttataaatcacacttcttctgatcacaaatactcatttatctttagactatatcaccacctgagttatttttatgtaaatattgcacctcttaaatataatgatgataatagaggctgtgaatccttagatttgctcaagtgttccctttttcaataactgaaaatatttaaatcccagaagctttagcatcctaagagaagtagcagacagatgtgtcaatagagtgagacctacagaagttgtgagtaatgaataagtcagagtcatgggcttctgtaagggaactgcggtgcatttcctaggttggtatgttctggctatgctgcgaaccgtagcccagaaatgactgactcagagagagtcctcagctgctttgctcctttcagctctgtcatcacatagaaaggtctctttggcaaagtgtcggaaacaacacaaggtgggcaagcatctgcagatttcctcactcagtcagaagaccagctagagtcatccagcttctggaaatcagtaaagagaccaactttgggtagcgagtccccaagatcacagagaatctatgttgtggtggcatcaccattccttatttgttggcatccttgtctggaaactgcctcatttggctataatttaacttgaagattaaagcacagattttcatatgtatcttctgttctctgaatgtaaaattatgaaatacacctacattcacttctaagtggcagtattgtaattgagcagatttttgtttttcactgaaacctggagttgaattgtcttgagccggaaggcattcaagttgctgttttttacttagctatatttctctataagcatctaattgtttcaaaaagtgaggtaaagtatgtgaaaacctgaatctaatgcaaataagtctgtacagcactaaagctaacaggtgttctcattaatgtaagcagacatggaacaattcttgaatgttttataaacactcataatcatggccaaatatgttacaatagcataaagatacatactgtaacatcttttattcttgttgtacactctcagtacttattaataggagactagtggcaacaatacctacttctgcttaagtcactgtatcataaagttagctaatacttctaaataaaattaacaacgtaactactacctcctcccacagtttgcttatttattaatattaacagtgttcttgtaaaattgctacaatgctgatggacagcaatgagcatctttgcatcactgagtttctctaaagacttgacccattaacctaagtattagctctttaaaattttgaacttatgttccagttcccatactgtcaactcccaattaccaaagcctatatttagggtgagattcttagatgatctagtatagatgatccctgtaaaatacttgggtggctttggaatataatcaagaacgttctattttagagatatgcattgaaatatgactcttgtgcttcccagcccttccaagtttaatcctattgtctgatgtctaggacttgctgactgctgggaaaatatagccttcagactgccattatcaatcttcaaaatagtttgcctactctactcttatgaagtgttttcagtagacgtcagtattacattacttatattacctgaaagaatgcaattgtattgcagccttcaaaattttatgacaatagagaatgagttaaatatattatggcatatcaaacaatgcaatataatgcattcaccaaaatgaataaagtagataaggtttgtctattgattattttcttagtgttccttatgtgtctgttgttcagccatgcatgtagacaattgtcattggcctcaggattattatagcatagtggggggaatggaaagaccaacaaggcattgcaacataaaccagtttgtgctaagataaaggagaagcaggatgttatgagcgcacttgggggaatatctatttcaaagaagcctttactgaaaaggtgacatctcaaatgatttgaatgatatgacagaggatgtcaaaggggtctaggcagcaggaacaacctgctctaaagtatgggacagctggggaaccaaaaaaatcagtatggctggattgtggaaatgcagaggaaaatgtggagcagcggaagtgcagagtgggtcagtgccagagcacacaggggctggcatgccaaattaaagagtttgcactgcactgcaacagctgtggggagcctcagaatgatatcaagcagaagaatgggatgatcatatccaagtttcagagggatcactttggctgcaatatatagtatggacttgaaggaaaaacatggatgagacagtgaggaaagcaaaggatattatgactaaattctcatgagagatgatggtagtatatatagtaaaaggcacaaaaattttcataataatatacatgatattttcattaaactgtaaacatacataatgtttcctcgtgggtcaaaaaggtatgtagaaagagacaacaagtcagtgtatcttgaaggaagggagattctatgtttgttaatttgaatttattaaaacttttaaaattgagcattacctacataaggacagtaataataaaaataataccaatttgaaaacaatgggggcagcagattcccaagtgtcatgtgactgtgactaaatgagtaattgaacacagtgaatatagctcaggcaagaaggtgatctgtggttggcagggagtgactggtgacaaatcccaggatgattcatttatctacagacaagtacacccccccagtttaaaaattaagagcaataaaagtctaagttgatatctttatacaccaactgctttgattagtctctttttgagtcgtttttcatatgagcaccacaggcaaaagttttggtgtggctgctgcaaaactgtggaaattgctaaactatctactaattacttggatagtattctttcatgaatattgagaagactgtttctcagtacttaaaatattttaacacaataaaaagaatgaacatgagggttttttttttttttttgcttgtttgaaataaattttgggtttagatatttgttaataaacagaaagttagagtgggcaagtaatatggggtgtgaatgttcactacagggacaattttattatgcagaacaaatctctgttgtacgaatgcatggacaaaattatttgggtgtcaaagtacagctcaatttcacttaaaaagcattgtttcttgaaaggttggccttaaaccttagattttggaatgtactggaggtctgtcatgtacgtaacccgacattgtttactttccattaaataagaaattgcttacatgggcaggttattttgatatgatgacaccactgagggttccaataaatgtacatgcaaatcaatcaaccccaaacacattgaaaacatatccaataagcgtctggaaactaatgaacgcacatttgttaacatagggggagttgtggaaatgctgagatccattggtggcctggcttatttagtagcatgtggatttaggaacatttcacggagtcagaagaaacagagtaattataacataaggttcaacatctttagatatgtagaacattttccgttgcttaaaacaaatattccctaagaaagtataaaacatttttctgacttgcaaagtttttgcagtctatcatttaaattacttaaataaagggagctttactgctccccaaagctgagaatataacaccctccatgcatattagcttgatcttcttgacagaccagaaaagtgtttgtgtgtgccaattaaaacaaaaatggatccctagtggcttgttcctcatacaacttttgaagactgctatcattgtttgctagggtaaccctggataaggctgctatccaaagtaaacaaacttttcaaaactttcatgacagatggggattacaaatgcattttaataagagagttgccaaagtaacttttttttttttttttgtaatcagcatatatttacttaacatctagcaacattgggaacacaaggcagatactttctcacaaaatgctttaacaagtaacatttttggaaaggcaaattgaagaccttttacatctaactgatattttacccttagttttattttaactttgctcaacatgttaagagaaatgttaggaattactcaaaccagactgtaatttgagacagacattcagcctgatagtgtaatttctttggtggtcataaacacctttgagaccaagtaatttagctattagtataaccatgacaaccttcatttgatcagctatatgtggagtgatgcaagatgaaaaaaatgtgaatctgtgtgggttttgtaagcattattacttcgattttaggtcttgatatctccctatcatgtgtatattttctgctgggagtactgaatacagatatggacaaaattactatcacaaaaataattcatattcacttcaaataaagttagtgtatgttgatataactttttatttttacttaatttaactcaaatataaaaattatatcatgaagtccaaagtctctctaaacataatagcaattaaattccattcctcttatttatgtctctctagaaccactgtagccatattatttaacatgttttagggctctttggatatttggcatattttattatgcatttcctgcatactatttcagtttcactaaaatggaataatccctccttaggttctaatcaaaatgcgaaaggtatttgttcaagtgtaggattgctttagtcctttctaggatttgaaggagttgtagataacccaattcagtcttagatatattttttcatagcaagagagtgcttgtttttggaaagaaaaatcagagctaggattttgcatgatcttttaaaatcgggctatctttagcctaactgcaaggaaagaagcaactttgtctaaagttgctattccaaatttcataactgaaaccaaattatcacggcccttttcctgttcaaacacacagtccttgactgtatacaactgtttgctgagaactagtgaactagaaatcaagatctttgtaatctcttaattctatcatttaaaatgatgccaatttgatagaatggcattctcattttcctcatttgcttcattttcttcatttgcaaaattactttatgatagtggaggaaagctgcatttggagaatgtttattatgtgctttgagatcattaaagctgatatcactttgcataccaagtggtggtattcatatccttaatatactgaagttctgatacaatcaacgtttaaagaataacgtatcatgaccaccagtttatgcatactttcatgatgtaaatgtgcctgcagtaactactccttcctctgaaatcttgacatgagcattgtgtgtgctgctcacattgggactcagtatgagccattttctattgttatttatctgtatatgcatatgtcctatttatccaaacagattgtgagttcttgagggtgggggctgtgtatccctagcttctagcaatgtgccttgtacttaatggatgcttaatcagtcattgttaatgattagtaggatgttctgtcatgaacgcatcctctctattcttctgtacatgaaattatttgtgggatttattctgcaatcagaagggtggggctctcaaacagggtagcaccatgtcactcattatctcttacatctttggtaatctccccatgtgcatctgaagtcagttggaagctggtaatattttaccatcaaatatgttttgctgatgaggtgtatctatctataacattgatcattatttctgtttggttattatttataaaagattggcaataatgaaattaaaatacctacaatgtttactttgtgtagctatgcataattttgattctttatctttatttttcccaaattctacacaatgaagtattattcttagaaaaaagaagttctaaaaaaggttttgtttatattctagtaaacaaaagtatggaaatttataatggtataaatgccattctacacattaatttctcatttaaattaaaaaatctaatagcataaaatcttactgccagaatgaatattgatgagagtgttacttaattgacaatatttaaaagaacaatacttaaatcaacataaacactacttcttaaaactcttttaagatgttttaaattagcatagtaaagctccatttaattaaaatctaaaacgcaaatttcttcgctcttcatcagtgaagtctggacttgcatctacctgcctccatattaagaggaaccgtaccaaggacacagactattctaagcccacgtgaaaactattgttgaattaattcccaaaagccttaaggaatgtgcccactctgcatgttgctcagtggacacgcttctataatttcctgggcataaatttcttaccagcaagaattcagatggacccttatttagtatgaaaaagttcaagacaaatttccccagatggatacttaaagatatgcattattgacactgcacacttcattaaggttactttggtgccctgatatattccttcaaaatacgacctggtgtggtaatgagggatttcaagaaacatttgcctaaattaggtttctaagcaagatggagaccagcagctcttatctaaacctgttatgttgtctataagttcttccttcatccccttaccccagcatctgtcacggaggcaaaacatatagaaagagtacattagcacggcttaatatcaaagcctttatgtctgttatacatcattttagattgtcatcataagttgttcaatcaaaagatttagtcagagctaacattctttactgatgtcttttttccccaagagtgttggaaattcgattgttcaaagtgcaaatatgattcagcaaaccatttatcagaaatcctaaagaggtaaaataaaaaagcgggttgaggaacctgaattaaatgggctttaccagtcaaagattttgaaactactttcctgtgagtgactggaatagagcagaacaaagtcaattactgactgtaattaagaagtggatgcatttaaactgtagagagcagtagcagacttctccagactgcctggtaactcgaaagattagtgggaagacagaggaaaggatgtgaactgcatctctctgatagtatgttttgaatgaattgcattcatatagctctctgatctagcttctcaaaatgaattcgtaaatcactgattatgtatgattaatgcagtaatatatttggacaaaggaacttttaaaatacattttgcttttggttgtgttagcaatataagatcccctttgcattgcatagcatgcaccaaaaatgcaaacgcactgctaaagtacttatattttatcactgtttgaatttactagactgcaagctgaactatgttggctctttcgtaaaccctcataatatagcaaatctaattatgtttgtttctcgtacttcttaaatgtttctttttataattttaataatggtttatttatactggcagagaaacattacattgtacattgtgctttggctaattcatttgtctttgtgtatgttaacaaattatgatgttagaaatacattcataatcaaaatatttcactacagattaggatgaaggtagaggtctaggacattactagttttcttgtgttagaaatgaccttatatttttagattactatttcttaggcaacactctataaagtaaatatttggaactttatctgagtagagaacattgcaatggtgttcagataattaggcaaacatcacctgagctgtcttttactggatacataaaataggaggctgttttgagccatcctaaatcttatatgcagtttcattttaaaaagagagagaaagactgattggcctcagtaatctgtcaaattctagtgtgggcaattaaatctttttatttttaaatctttcacttcttataattgtatacactttagacagttcttctcacagttatagagacaacatttgatattggaacccatctcaatcaagaatggttactttgcagtactgattaatattgaatctctatagagtttttctaaaaacaaatgacaaatgaatatatatgcacatatgtaacagatttctttcaaaaccccaaaatcattgtcattaaatgttgccatgagaatccttgaaaccttcagaatgagccatttggggtagtaattgtcactttaatgatagaattatagagatggcctaaagcgtgatttgtgattttctgaacctgtgccacatttcagcgttcacctcctgtttagagcaaggaaggctgagaagaggtgactggctcctgattgagtattttgaaatgtcagtcctctaaacccctgaactctgtgtgacagtagttgggaaatgttcatcttccagttgcaaggaaaagtcaataatacaaagggaaaatcttcacagttcagattgatggccaaatacaaaaagcatgtccacacccactctaatcaattttttctctaagttgcccgttatgtgtgaaactaagagtattgctctgtttctgtagggtcgtatccttttctcacaagtctggggagaaaaagattcactgtaatgaaaaatggacagttacacgctaaatattgccaactacttagcagtctgagagtcaggaacctgaatgttcatttgataaatactctcccagagaggttcaaatatgtaaatgaacttttattttaatatactccttttgtggggaaattggtttttttattactttcctatagatctctgataagaaagtagaaatagtcaaatgttattcatttcaatgaacttttggaagtctgcaattagtgtttttggtaaataaactgttttagagctctccataaaaggaaatcaaatatagagatactattagatttgaaaaagacagacaggaaagaggcaaacgtgcagaatgaattctgacacacccgggtgcatttttctgcgggttctgacttaagtgtgtactgtctgcagttctctgaacttcctggcttgtttctccttaagttggagtaattcagctctagccctactctgacttaatcgttctattattaaaacaataatgtatttgttatgacgtgaaaaacagtttatagagagcggttcaaaatgctcccagttcccagaaagacaattactggaatacaagaaaatatttcattttattaaactgtgttttttaaaaaaggatttttacatgtaagagatctatcttacatagtttctttacctgtctatttctttttcttttttttttttttgcagatcacaacagtatcaggaaatgagttccttctacagtcagatattgacttcatcatattggattggttccacgctatcaaaaatgcaattgacagattggtatgtatttgttttggctgttacctttattaattaaaatgtagtcatttaaatcttattgctcaggcatataacacacacactcatttaaatagatcctatggactgagagggattaagttcttttagtttaaatagaatctactaaaaaccttttcagcagacaggatttgtagaactgtcgtttaatttctctctttcaaaaatatagtgcattctttctttttttctgaaataacatagacattcatttactggaggctgtaaaaagcacacaagcacttaataactactgatttttttttcattttcagtttatgcagtccatactacatactcctgtaaataaataacatatttaagactcactgttataataccaataaataaataataaccctttgtactgatttttattattcttccagctaagctagattgttcttcttatgaaaattacatatctagaacttcatgaaattatcctaaaacatacattcagagtatgttttctaagaatgaacttatttaaaaccactcattccatgctgagtctctagaacaaacatttaattttatgacactaatatttgcaaaattttgggaagaaatattcttaatacggaatacaacacaatagtaaaagattttctgtgtgattttcttgatacttaattgcaagctttcattataccattttgggattaacactttaaaaagtaaaataacaaatttactttttcctgttattagtatattccccttaaaggggtgtgtgtgtgaatgtgtgtgagtgcacatacatacatacacacagtttgttgccattgaggatggactctggaaccagactgctagagtttgaattctagttctatcatttgttacctgtgtggccttaggcaaattacttgcctattttggcctcattttcttaatgaggaaaataaggataataataataccacctactctatagaattgttgtaatgattaattgaactaatgcatgaatagtgcttagcatttagtaagtaccatcatatacatatataaactattattagagtattgagcttagcatagaggacctatcctcaaataattaccttacttcaaatttccccataaacagcaaaattgaacacaaaattctatggtgaatcctttctttctagtaaaattattcagtctaattatttgctgtttccagccaaaggattcaagttgtccatcaagaaacctggaattattcaaaatccaaagatcctctagcactgaattgctaagtcactacgacagtgatataaaagaacagaaaccagagcacagaaaatctttaagtgagtattttctttgacttgctcattttaagtttgtctaaatgcagtgcttatgaaatataaatgcattgaaatgagatttaagccaaactcatcatactcatggaagattcgtagccatttcctggccagggatttgtgcactggagggcagtctgggcactttgctcacatcattgttggtaatgccttttgagaaaataattgttccaaggtcatggtctctgcttacagcaaacctctgaatctctgagtaatagccatggtgttcagatcagtgattgattttgagagtgggaaatgtcaagcatctccaaccctggtatcctgactattttatttgcatacattaaagggtatgagtgaccaccagtgtggtctaacttaagtcaacaggctatgccactttccacaccttcagaccaccagaaacacttagaaacgtgctttccagagaggctgatagaaaatatgggatgtgaattagatgttctccaaggtcacacctagttctaatattctaagaattaaatttagagtaaaaagaatggtctcactacttacacagtgatcttgagtatctttcttaaccattccccagactgcttcttcctcaatgaaaaggggttattaaaatatgcaacacatatctcactgagttggtttgagtctcaacctcctgaaagaaaaggtagacatctggctgggcgaggtagctcacgcctgtaatcccagcactttgggaggctgaggtgggtggatcacgaggtcaggagctcgagatcatcctggtcaacatggccaaactccatctctactaaaactacaaaaataagctgggcatggtggcacgtgcctgtaatcccagctactcaggaggttgaggcaggagaattgcttgaaccagagagtcagaggttgcagtgagctgaaatcataccacagcattccagcctggttggcaacaaagcaagactctgtctcagaaaaggtagacatctttggaaccagagaaaacctatttcccaaagtcttaaaaattatagtattttgggggagtcttctacctggctgaccccaatcttgcaaatcatcatttttttcctgctatttccctctgacaaaatatcagtatactgacatcctaaactttagaatttaaagagaactcagtaagttgagaagagctgctaatggaatatatgtgtacatatatacatatatacatacacatacacacgtatgtatgtatgctagatgattatttgtacgtgtacatatatgtgtgcattaagaaatatatgtatatacacatacatgcacacaaagactcatacacatatgatagggaagagagaagctatttatatgtgataacatatttgccaaagttgaattactgaagtctacaaatctagaaattgcatgagaatttaagagtagaagcacccttttgaaattaagtctttatgcaaaatcccatgccataattttcaacaactgctagacacatttacttagccagttgtgctaagttggagtttaagattatcagtgttaatgtctagaaaatgcatggtttatttgtggagagttaatgccatttcaaaagacttttccataatggtacagtttagaggtatttcatttaaagaatgttttcctttcatgcctgatcattgtcttcttttacttcatatggtttgagacataaggtaagatttcagaattgggattcagttgggagtatatatttagtgttaatcatatagacattctgtagtacatataaaagaatatgtgatgcaatgactagtaggtctggaatcttagatataattgctggttcagagaccttaagatgtttctaaaacctgagctatggagaaaataaaggtttgcaaaaatgtatttgagaaacattgaggataatgaattctctattaagtaacagtcactttaaaagtattaagatgctgctgaaaaaaaaatcttagatagaacactcactacttctctttagaatctatttttaattggaaaagacaattatttttctactttgagcttaaactcaatcctacttaaaaacaagggaggccaggagtagtggctcatgcctgtaatcccagcactttgggaggccaaggcgggtggatcacctgaggtcaggagttcaagaccatcctggccaacatggtgaaaccctgtctctactaaaaatacaaaaattagccgggcatggtggcgagcacctgtaatcccagctactcgggaggctgaggcacaagaattgcttcaacccgggaggcggaagttgcagtgagctaagatttcaccactgcactccagcctgggcgacagagcaagactctgtctcaaaaaaaaaaaaaaaaaaaaaaaaaagggaagagatacatgatttattctattcatttcaaaatctaactaattgtacagtgacttcatactcaccttttactttgaagttaaaaaaaaactagaaaatatgaaacatttactgtgcaccaggcactgttccaagtgcttgtcttatagcaatacatttaatcctctcaccaatcctatgaggtagatactattagttaccttattttatagaggagaaaactgaggcatgaagaactaaggtaatttgtacaaagacaagttatggagacatgtttcaaacccaagcagtcttattttagagcctgtacttttaatcattacattataacaaagtgaacaagtaaaaggtaaacttagtttatatcgaacttagacttggatagaaatattatgttaaaaataagattcatagaaatcagtaaacttgaatcaggacccaaaaacttattggcaaaaataattaaaactgggtgttttctttcaattttgatttcactattaaaataataatttaatctttaacactagctctaattttagaaaatgattcttttctgtatcttggtgagtatgtatagttgtaagcctttttttttagggccagtatgttttttgcaatgtaggacacagttaatatccatctattactttgaattaagttcattcaatatgtatgtattcattttcatttgaaaggcataatgattgacccacccacacaatatcaaattagaccatgcatttgaaatagtgattgacatgttttatatttgatgctttgtaaaatatattttttcaagtaggaaataccctgtgtgaaacccctctgatctcagtcctagatttgaacacccaaacttaggtttcttaaaacttgcattcgcttttatgtcaccctttggagattaaataattatatagaatcagagactcaacagtatcctcttccttattagtagtctaagcacaaactttattgtcggttttctgcctttggcttcctgtgcccttgatgttcccatgagttttgccgccaagattgtagacagataaagccagaattacttttttaaaaggcatgtgaacatcattagcagctaacaggtggtgatttcgttgtccagtttgtctatataacatgggaaaaatatgttctctcaatgagtgaattcagaaagttatgtttacatatacttttcttttaaaaaatatgattctaacctgccaacactattaagaacgaatcagatattttaagatatcagttgagtctaacagacaagaagccagaaaatttaatgcaagggccaaatcactgtgggaaactcaggacaccagcctgggatgagagtaggagagcagctctccagggagggctgttatggaaagtggagagtcaatcaaagaagatgtgaacatatttctctgaggaaagagaattgtcttccactgacagcaaagagggggaaggcccaaatataataaatcttgcatcagataaccttggcgaggtttcttaacttttctgagctttactttccacatctataaaaatgggtctaatactgtccttaaaggatcgtgtgagaatttgaaattagacatgtaaatacttagctcatagcaggcactcagtaagtaggagctcttattattatcctccatgtccccaagcagatagcactgagacagggcttgagcctggtggtggttgatgaaagactggagcagggcatataagcttgccatcctactccctgagtgtatgaaaggtagaaaaagggtaccagaattggatatgggagtcatagctgcaaaaaatctaagtacgagcagctggtctttcccctggcaactcccatgtaaaaggggcaggtagggcattcttgggagcagcacaccaggaaacagtagaaaggagccaagaaacactcttgattctcctaaacccagaaaagcatgccattcagaaattcaagttgatgggaaggattcagcattagccatctcactattcctttacacaaagttctagtttattcattcatacacacattaattcttttttatgaagaaatacaactaaaggtatacaactaaaattcttgatttcactcatctgtgctttcaatttttaaaaaataacttttgtatgtaggttatgctttagtagtaatatatctcatacctatcaattgctaaactgtaaaatccatgagtgtggagaccttggataacttgaaaataaaactgacactttagtattggaaataagcaccctgaaatgaacatgagttagaagactaaagtcaaaaggtaagagagctaaaaggaaatgggttttcctttagctgtctcttgattaagttatcataaaaaacaaatgtgttctgggtgaaatcctaaatgcatatgtggatttcccaaatctacgttctcttaatgacatgtgcaataagggtatatgtaatatgtttctaataattagggtatatgtatttaaatgtgcatttcccagttccatatccccttaatgatgtgtgcaataagacaacagaaagaaaaaacttgaatt

SEQ ID NO: 2479 - DNA, 8116 bp, Homo sapiens
cttattatgggataaaaggatataccatatttctctttttaagacccaaacaatatcattatgggcaaagttttgaaataatagaatgaaattcccttgaaatttactgaatgtttaataccaagacaaaacaagttcttaagaagatgcattaaataatttcattacaaagacattaatttagagtgttttatacaattattgaaataatgtggtcaaactagatagtccaccctatacaactcaaaccaaagactgctgctttggaaattctgatatccagtttagctgcccaaattttagtaaactggaccatcgccacatcatttcattttgtgttgtgtaaatatgtcctactgcctaaaatactatttagtttcttccatttctacctccaggcactgtgcaacttaaacaaatgcagacagatgctaagtaacatatggtttctatcaatgtctagtgtaaaaatggcactgatttttctgatgatgcatattgtttccttctaaacatattcattaacacatgtaagtagattggtacaaataaaatcaacctgtaagtgaaaaccaaaaacatgtaattggtaaacacatggtttgttcaaatgaagccctaaaatatttgtatattttttcaaatattaacctgtaaccaattttacctactttaaattcttaaatattcttattttattcaaaatagtgaaagcaattatcttagagtcttagagaatgtttacaaaaatccttcgatttctttaaattttataatatccctttctatccccgcataaccacagaacagaaaatggggtttgtgggtccagattgtttgtatttcatattttttacatataattattttaaaatgccatttcaacatttaaaatgccatttcaacatgcaattttggccagcagagttacagaggcagttgatgttattgtgtcaacaaaatcattatgctttatatgtaatgaaaccgtgtctttcaattcacttttggaacaattttagaagtaagtagcgtcaagtcactatgtgtagttcagacagtgaatctgaactctgccatctattgatggtataactttgggtaaattatttaagatcttgaatctttaatttcctaatctgtaatttagggctaacaattgtacttcataggattggcttaaaagttagaggagataaatcacttaaaatgttagcataacatctaacccatgataaacactccatgttaagttagctgttgttttttagcataattatcatatggttgattttaatcaaacgctctaatggtttttaggtacaaatactaaaatagcatccaggtttacctcagtaatgtcaaacttcctctatattaaaataagtatgttttaagtaactcaatcaaacagaaaaatagtcattttttttcttaccaaacaagaattatcattagacagaatttccatatgatgaagggcaatacataaagcaacctaaattatcttcccaggaaatttcattctttctatagttgttgccaaattgccaggttcactatcatgcagatcccaaatattatagtacttcatcttcaaatttctgccactagtatggacaataaccttgcctctgttttccatttgcttttgacatgagctaaaaacttccaaactacttttctcaatactaattatgagcaaaatgaatcatgaaaggagaaagtacaagcaatataagaatagcacagtctacaaagtattgctttcttattctagcttatctaatttaatttccaaattctcagatcttttcccccaaaaaacactagcaacatatccaaaaggaaagccctgtcaatctgaacactgccacaaaccataggcagaaaacaacaagtatattaaaagaatcagtagtgtgactatcttttgtctattcaatggaactctcaagttgatggaatcacatgtttacatatgagaagtagatataacctctttcaatagctctcttttggaggctgctggtgatccaaattagattaggccagattagaaagagggtgagtatttcaaccaaggtgctcaatgaaggtcctagaggataaattattgctcttcctccattatgctccctcttcccatgcccttgggctgcttatttaatgaaatatagtagtatcagactgcataaggaatagccatgtccattttgtatggacaactgattttctaccatttgtgaactgctttggtaagactgcttttcctggtcttctagtgagcaggaaaccaagagaagaaagtctttctgaatacctgtgattcttgggctccaaaaccaaccaaccaaacaaaaacctttttagaggcaaaatttataataatagcagccacgatttttgaaacccttagactatccccagcatagagataagcactttaaagttgctatcatatttaacaactccttgaagtattattgtcttttaataaaatggaggtaagtttctcaaggttacactcttataaaaagtgatctattgagtttgaattttgaagttctcaaggaagcaataaggcttctgactactttataatccatctagtcacttactattggatagtaatattttggccactgttactagaactggggaaacagttgtgaataatacaaagcaaaaccctgacctcatgtgactcacactatagcagagggtaaataggcacataaattaaacaatgtaatcccagatagtggtatgtgctttttagaaattaaaacaggactaagggatacaaaaagaatgtggccagggtgagaagaatacttaacatacagttgaaacaagagagtatagaggagagaagtattccaaatggggaagacatccctgtttgtcaaagccctgagcttaaagtttctgaggggcaagaacaggccatgtgacagagtacaaggtaaacgtccaccatggctttttttccattctacagaatgagtaaattaaattcaaagaacatcacttactgaatggctttttgattctgaagttcatactcttttgtgttatatagcttttttaacaattaatgaaaaattgtttactttattctgtttttaaattattcccatctctttcatgtaagaccttcttggtttttgacatcttaatgtttcatcagcaaatattagcagcataatatctagtcattctgttttttctttttcctaaatactaaaaatatgctacagttttgagagtgtgctttgactttctcatatatgtctgtgggtatgatcgagaaaaataaactgtctataataatggaaaacctgattgtaaaatatattatgacttttgggagaaaaaatgttatttatttctattttctatttcaaataacgaagttttaatctattcaaataatgatataattttcaaaatttattgtcattctattgccaggaaaacttaggtatgcttaaattaaatagcacatttaattagctcaaacagaaaagattaaattcatgattcagaatttgcatatttatcaaatatatctgtaggaataaagatatgtgatatttaatgtggatttatagctttatattttttatatcttaagtccaaattatctaattcagttactgtatttatatttccatacctgggactcttctccataagccagtaatagcaatgaccttatagcagacaggttaatgttaaagcatgtccattacttcttgcactactctgtctgcattcaaaccgtatactttatgtagaaatgcaattattttattatataactaaaatggacatattggaaacattttggcaccatctcactttatggcataagaatgttttcacctctcacaacattcagttggagagggatggatttttatgtacactaactgattaaaattcattaatttggagatagacccaataaaacatttaagaaaacctatagttctcacgcctgtaatcccagcattttgggaggccaaggcgggcagatcacgaattcaggagatcaagatcatcctggctaacacggtgaaaccccgtctctactaaaactacaaaaaagtagccgggcatggtggcgggctcctgcatagtcccagctactcaggaggctgaggcaggagaatgttgtgaacctgggcgggagcttgcagtgagccaagatcgtgccactgcactccagcctgggtgacagagcgagactccgtctaaaaaaaaaaaaaagttaaataaataatatctaatgtaaagcctgggatacagaccgcagaataggctatatctcaggaccatagtgtataacaaatttacaatgaataaatggacgtaccgtgagttaagagagcaagggtgatgctgggtaggcagtgacaggtatgctgttcagggaatactagatgactacttttgaactcagtccttgtcaaacctctgacagtgcagtattgccaggttttaaataaatgaaaagcgaaagttccaatttgtcaaaacaggtacaacatcagagtaattagtagagcaaactctataggtttcaacgtaggatttcattaatagttagctgtgtttaaatatggtttaaagattaatcatgtgggaggctgaggcaggagaatcgcttgaacccgggaagcagaggttgcagtgagccaagatcccgccactgcactccagcctgggcgacagagcaagactccattttttttttttaaagaaaagattaatcgtgcacaattttcagagaaaagttatagcttaaagaaaaactgtacttgctctaattgaagaaaaatatgaagaaactggaaatgagataacaggtcacaatattggttaaatatattcagatgtgatctaagaaaaaatgagaattttggtcatttgtactgagaagcagaaatacaagcactaacaggttattttaataagttaaattgagaatgctttggtctaccagttggatagaggttatttttttctgaattttatttgggacctatggcaagtacctacaaaagatatcattgtctacatagttccaaatatgcaacttggcttctaaattgtttggggtcagtatctgaatgttagcaaagacgttctttaaaaaaacaaaccaacaacattttctttttttttttccctataaaagttgggtagatgtcatatgctctcttttctgtggaaaaagatgaagccttttgtctaggttgtgagatttgctctgctctctgattttaaacggtaattaaaatataatttgtaactaattccagtagagtttattttttttttttatctaaagggttccactttgtttttccaagaatcattacgagtaagagtcattgcctctcagggcttggcaagccctaaagttacgtctctttctcttttcccctccctctctgttccctttctttttatctcctgctctgacttgttcctttaattggctctaatataaaactgaagtatatctggtgaatactgttttgtgttctctgtttctaatttaaagaatggatgagtggtagacttttctctctctaaataaaaaataacaaacagtaccctaaatcaactttttgtatggttcttggtttttattagggtgggtcagtgaccctcaattaccaaagaagaggaaaaaagtttcccataccgagtaagcaagaataagtacagtataaggaactgggttaagaaacagaaaggatctgctaatagtatttttatacacagtgaatgattttatgtgaaacatcagctcctctaggaattgttttcaggttagttggatgaaagctaataatttctattgcccctgactccacaagaacatgattcatgaaccattcaaattcaatattttctgaggtggccctactcttctttggatctagctgcagtctttcatcttgttttacacagatgcttctactgatttgaattttagagtcttagtctaatgcctttctttgttgatggagacaaataaggccagacaatcttaagggacatgctgaaggtcacaaataaggcatgggcaagtctgtcctatatgtaagcttcaaagccagttcatgtcttcattccttaaaaatttattgagtgcctactatgtgcaagatcctatgctaagccccgagatgtgtaaagaaacaaagcagaggagactcctgctctcacaaagctagctttataaaattattttcgttaattctagtggcatatctggtagatcattctatggaataaatgttagaagtatctaaattcaaagactaaaaattccttaatattgattcaaaaattgagtaagctacacggtatcttctggtcataaaaaaatcttattacttttgactgatttacttaaccatagttttttctaacataattattaattttgtttataaaaatgttcattcaatgtttacttatttttctacatgaatattttctttataaacatggtccatttaaaaccagaacttgtattatttaattttgtttttaaagatcttaatggtataacatacctaccagggctaaatatttatattcaaacctcgtaatggactaataagaagtgagaacaatgccaatcatagataacattttttgaatcagacgctctgcttaacactgcatctcactgataacactgccattatctcagcctttatagcaaatctatgatgtagatactaatatgatctgcatttttaatatgtataactgaggattagaaaaatgaaagaacatgttccacgctacacagcaagtaagtgacaaagtggaatttgagaccaatactgcctgtctgaagaacactctcaggctgggcacagtggctcatgcttgtaatcccgacagtttgggaggctgaggcaggaggatcacttgaggtcaggagtttgagaccagcctgggcaatataatcaaaccctatctctaaagaaaaaaatatttaaaaaattatctgggtgtggtggtgtgtgcctgtagtccttgctacttgggaggctgggtgggggaggattgcttgagcccaggcgtttgaagctgtagtgagctatgatcttgccactgcactccagcctgggtgacacagtgagagcctatctctaaaacaagaaagaaagaaagaaagaacacactctcctgtaatgacatctagacatacagaaagtatttaaaatgctatacatgagttttacttgaagacggtttctcatgttttacctaaggcctgagaatgataataataaaggaaaatttgcagttttgcttctctcttttcaaattcttcatttttaaagatttgtagagtcaattaaaataatgaagtgagctagaacacagatcaggagaaatcttgaaaatgttaattaattagaaaataagtaaaattaggtgtgagactagatgatctcttcactgcttatggcttataatttctatctgttgaagttttacccatcattgaagtgtttgcttcaattagagtatcacctcaggaatcttcagattctatgagttagaatggttctttcctttctcagtgttccccaggtctttgtagctccagaatagcactcatttttttgttttgttttgtttattttactttgtattactattatatgagtatttcagatgactacataaatgtattctgagtgcctatatgattgatatagtctaatgaaaaaatcagtaactcttactactcattgacgggctcctaaatgccaggtactatatgagtctactttgcgtagtattttcaataacatcatgacccactgtaaacacacacacacacatccctggggcttatttaaagcaaaatcaggctaagtccatactattagcaagtagtgatgacaagtttggaatacatcccatgtcttaatcattgtattatactatccattaaaattgagttggccgggcgcggtggctcacgcctgtaatcccagcactttgggaggccgaggcgggtggatcatgaggtcaggagatcgagaccatcctggctaacaaggtg

SEQ ID NO: 2480 - DNA, 6269 bp, Homo sapiens
aggaaagttgagaacttgctcaacgaacttagctttcaggattagtatggaaaattacacatttaatggatgtttttgaagaatgcttgtgttatatctaaactcaaatataaagtctttgttaattttggtgtgtatttactttgaaggaagtagactggaatttggttcattaaatataaacatatattaattttatgatcaaaacgactttcacactgataacatggaacatagaacaggaaatccttttggaaagtgcataattaaggaagttagctattgttagaaattcaattaattaaaaaattaaacaatatttaggaaaatcattatatgaatttcactcctgccaggttgttccagaccttaatatttgctcatatctcatttgaaggccttcctatccaaattaatgaagacaaatattcatcaaagctttattcttaggaatatcactttctttaaccttggtatttgcaatggaattagacacaaaaaaatattttttgtcaaagtaagaaaggtaaaaaattatattagaagcaattgaaagggagatatttcagaatatcttaaccaaggaaaacataaaattgcgaacacagtgaatctggttgttgtttatttcaggttttttgatgtttcatcaataactgaaggtttgctacgataataaatatatacatatttattatatgtatttgatttatctaatttttcagacattaagagatctgatttaccaggttttgtcattttagaaaacactctagttaagatattgagtcttgatcttgtgacaagatgaaaaatagagtggcagccagtatggattaagactatacactttgattggaattgtctttacataacatggaagtggtggtgttgttgtccagagcaggagacctgtcttgttggccttcgacacctagcatagggccaggcacctcataagtacctcttatgaggtacttctatggaccatattgtttaatcctagtatcccctaaaggaaataaatgtatagtcatatgagttaaaatataaatattctttgacagaaataaactctgggatgaaaaatcagtctgcttccttcccccaaatgaaatatactgcaatattaccagattttaatttgtttagaaaaagagcaattttagcatacaggaaaatatgctactcttgaccacttgaggccagaatgcagctattgggcctatggtttggaaaaaagtgaacgttagacaggctaagtgagaaaacttagtggaaggagagggataccaaaagacagatggaaaattaccaactgcagattgtacttactgtatagtttttcctaacgccctgcaactcatgctgtctgtctgctgggaaaactcttggccatttgtttctgatgtccatgtctgtcttttgaattctgttccttactccttgatctataaaagtatctgaggtggcttaaaaacattatatatatatatatatatatatatatatatatatacatacacacacatatacatatacatacatacacacacacatacatacacacacatatatacgcacacatatatgtgtgtatatatgtatacatatacgtatatatatattttaccttattttataagagtaactgtcacgtgaattacctgcaacatgggtgtttaaactgagagttgaagaactcttaacatagctaacaaaaaggagatcctatgaaactcatgcaactgtaagcaaaatgagaatccctttgaatgtatttttttttaatttatggaaaaaaaggttttggtttcattacattctcaatgtgggtcttaatttataaaatattcaatgataaattcttaaaatgaattatgttaagccaaaacctaaattttttttgccatcctattgcacaggcactctttctttgtatttttgaaatataataaataagaaaatataagtgtcttccattaggtggcagtaataagttcctataataagaactttaaaaaaaatggtcaaaaacaacttggaatcctaaaagctgaatttattggatccttcttaatgttctcattttgagattgtggagctgctatagtaatcaaaactaaaattttccgacagatgtctacatttatctctactgtagtatagtcacacaagtagcaaacaaatttgtgtaaataaatttacttttattatcttgtgttagaagagattcagtttggatttggtgaatcatatcactattcaactttgcacaacttcagtaatgagaggtctaataatagataatacacaatagtataatgaaatatttaggatgtagattcataatatatgtaggataaaaccagagttttgtcaacgaggattgtgcaactttgggtttcactgagtttcacatgtaaagaaacgcaataatttttgtttaatatacctttttaaattgttaatatgcaggtattttaaagtgctcaagttctatggagatagtaattatcaatatcaattttattaggttctggcatgtattgtataatggcaaaaggatggtcactgtaacaactgtaattataaatcacacttgttcactcttcctgtcttacagatagattgcattctgtttatccgtatgggtgttgattgtttggaataaaattttgcatagaaacaaattatgtcctcagtctcattcacaacagacttaaggtgaacatgaaaatttattgaatatgtactaaatgccaagtgctaaaaaatttccacgtgttaattcatggattacttacaaaaccttataaagcaatatgattatcacttccactttatggatgagaaaggggaactaataagtggtaaattttgggttcttatgtggatgatctaaatccaaagcgcatcacagtgtacttctataaataccatatacctaaatttctaaaataaatgcatattttttcttaatttataaagtacattggtatatttgtagaaaagacagaaacaaatacatcattaaaagtaaaattttaaagacatatgcacattgactaataaaacaataaacatgttactctaatattgtttccattactaagtacaaaataaaaatcacagttttgtattgatgacattcttttcccatggttttaactctctttgtctattataatgttatttattgctctctgatacttaccaaagtttctatttttccttcaaattatccttggaagaaaggcaaaattgaggtgcatatgcaaaatatctgtgtaatcattggtctcagtttaattagtgaatgcgggttcaaattaacactcatttgtaaaatttatgaatttggtagttggatacaagaaaaatttatcttcattttggttaataaaaccaaacctgtgtgctcacgaatatgctattgatcctccatgtgactgcactgtaaggagatgggcacttataaaccatctagttgctatgtaagtaaatcattgcaatttaacataccaaatgatatgctcaaaattcaccataatttcatgagaaacataaatgagcttaggttagcctaagcctgaatagagaaataactacagttttatacaaaagtttatgtcatattaacactttttaattcaaaaagatatgttccatgttaagggaaataagatttgtctgaaaattgggctccatccagcagtgttaataaaatataaaactatagccccaataccataggggttatttatgtattcattttggcttatgctagattgaactgggttgggatttttgtctttttaatttttagtaatggaaaaggtgtataacacatttaatttaaaccatgaaaacattaaaaaataaaacttgcttaacatttcaaaagtaaatacactatttgggccatttttgcaaacaataatattttggtgtattagttttgaataatactgtctcttaagtaaacaaactaattgaagaaaaaaatggaagaaatgtgttttaggaaaatatttgcaacttattacctgataataattctagtaacctaggaaacatagaccctaactcagttcacaggcagtgatactattttatatttttgtaagaagaagtaagaccttattatgtccttaaaaattgaatacatttcttctcttttttgtaatatagcttattataattaaattaatttgattttaagattattcaaataaggaaaaatgcagagattaattgacctaatctaatttacatggtccatgtgaatatatgggaaaaggatagatccatctggttagaatgtagacttgtatttctggtaagtttttattttccacctatttgcatcataatatttttgtatattaaacgagaagatgtcttgaaataatttgtaatccagtatggtacatgtactttgtcagaaaaatagaacatacctgagaaattatgaatgtttatagtttacccatggatttgaaaaccagatacagataaatgttttaaatagctgtgtaccatttgtctatcttaagcgtattctccaatattctgattaagtcaaaactaagatacgttacacacttgactctcataagagcgtctttcattaacacccttgcaatgatagcgcttgtgtttatggtttaatagcttctctgaatgccaagcataagatacgcaataaagcaaaagattttaaatactatttcttgaacatatttgtattgtgaaaagtcgatactgtaatcattatatctccaaaaccagaattatttgataaagctgtattaaaagtcatatatagagtatgaaataaattttgtttagtgaataagtttttgatcctttaaagattattatattttttctataaagatctagaacaatcttttaaaattaagttactatcaaacttttgccatgtagataaaattggtagcaaaatatttttacaatgtttccaaatatgatctagttagaaatatataatgatgctattaactgaaattcagttagtgtttatgtgtttatcaaatactttgtccacattaatctgtaaagcaaacaaggtaatcattttacctttatattattttcaattttttatgaaattttatttctgttatgcatgaaaaaatagtataatatgtgcaggtgaacataaatattcttacaaatatgctaagtattgtcttcatttaaaattcattacatgttcggagtcaccagtgagaaaaccatatgaatcttgcccattcatttaaaataatttttaaaattacagacccagtattattttaaacaatgtttttgttattccaatttttcaaagtgaatgaacagtttcatatattataaaaatctacatattttaacttttagtataatgctttggtatgtaagatagaaaaaaaatcttgtaacaataatcaaaaacattatctctttaagaaatagaatatttcaggtaaaacatatttcagctcacattattcacatactatttcaattctatgtttcattttacatatttagcattgactgtaggctcaatgcattgattttatgatgctacaaggaaacatcttctagcaaagtaaattcatttctttatggctaaaagcatgcattgatattctgatattttcttatcattaaagaaagcacattttgaatacaataatatgaatttttatttcaaacttccagttatgtcctcaaatatttcctttggctaatgaccttcaatgttcatcgcctagtgtttttcaaaagtatttttggaaaacaaagattataaaccatactgttagtaaactcataaaaatttaatcaaattatacaagaaaattatgggtttgggactagcaattaaacaaaaattaaggaagtttggagagtttctcattataaaatatgatcataatataatacctcctaagaaaataatctgaattaaaaataatgttgttttaatttttgttactaacccacgtcattgggttagtaaatgtgttgtttccactttctcccccatttatataatggctaaagtcacattctaaaaacacttttcccatttctacacatgtgtcagggaactcagtacaactgaagattgaaaagagagagaaatcagccatgatactcttaaagaatcacaaatctaagaattaatttaaattttcattatattgaggaatttgtggaaaaattgagttgtaaattactgaggagttact

SEQ ID NO: 2481 - DNA, 11613 bp, Homo sapiens
catcttcagggaagctatcctgatgaaagaatattccatagaaagaaaattacatgcacaaggatgtacactgctgtattacataagtaatgcaacaaaccaaaatccacataaatgtttcagaagttggggagatttatataaaatatggcataattatttgatagaatattgtataactatttattatataatgatgcatcaatataactgtggtaaatcgaatcattagccacaacattcctttgtctctgacaaccacatgcttgtcatggcttctctgtagcaaaagcacactttcctatcacttggttttaggctgggccctatgattttctttggccaggggagtggcagaaatgagaatgtgccatttctatatctagagcttaataggcatcgtggatttctgctcccttttatggactgtaccatcatcatgggaagaacttccaatgctgttacaactgttagcccttcccctgggccacagaataaatcactatggaacaaaactgccccaatccaacctagatgaacttgtgcttggagcagagcttttccagtcaagccctgtataaatcaccagaccagaacttagccaacaacagattcataagaatacataattgttgttccaagtcattgagttttattaggatgtttttggatgaatcatcttggggcaataggtaagtgaaacaatagctatgtgaggacattcatatggaaaatgacaaaagaaaatattcaaaattacaattgctagtgtatgtgggttttgcgattgtgagatgccagacccaagcttaatctagtattttcatgtatttgaactgaaaccaacataaggggtaagcatctcttagagacagaattttttaatgaaaaatataaaatattcattttatatgtatcttcattttaaaataaaaatatatattattttgctttaggttatttttgtttctttaaaaaatcccactaaaactcattcctagcagaattcactttattactctcagctgcaaatggagaatctatagaaccttatgtaatcttatctaacttaaaatatcttccttatgctattgtggtaaattcaatgttaatacaaattcatatttctactgcattatcaaagtatattaactcaaatagtttcacagcttgaaaatgtcattaatcaatgatggggcttctataatctgtgtaatttttgtcctctgataaggtcaggttttctaaatgactggcacgtgctaagcatttcactatttctgtcatttaatttttgagggcccaattggccaattcatagttaattactcaatgtttacattcaaagagaagtagaaatgggagatataatacacaatatgtaaaattgtgtatgaaagaaaatgttttcaatagcatggacaacatgaataaaaattattacgaccaagaccagctttgtgcagaatggtgatttaggctccccgactctgtccaggcttgggcatggagtgttctcacacaatctgtatacttttccttatggcaagtgctttcccattgccctctagctgccagtaactctccactgaagcattttacgagtactgcttaaaaatatttcctacttcctttcatccttccccttaaggtttaagctgcctagattctcattccttctcagctaattgctttcgaaaaacagtatcttgtaaattaagtccccttaaaggactgcttaatgtgatacctggtttaggaatagttactatttagcaaatggtacctgtgtatgcctcatcgctaacgtatgcagttctgttgtatggtatctctggcattatggaaggcaaggataggaaataattcaggcaagcaaagttccagagcacgcttcaaatcataccatttagacaactgtctattttatttataatgtgatctgtcctgcaaccaaattacttctttttaagttaaattcaacccataaaactaatttatattcctgagaaaaacgaaatgctacttcaaaagttttatgaaagttcatatttttacaagttttacctaagtagaatagattatttacatgtattataatagaaggaatatatatttacaatagaaaagaaatgaacttgacaatgatgatttgattgtcaaaattagataagacttaataattaaaaagaccgaaaataattaaaaagaaaactcacttcaaactataattttacgttatttttcctactttcaatgttctctgaaaaaaatatgtttgtttttacacaaaatttgcagtggcaccaacttatttaaaatgttaattaccggactgtaatgaagaatttttagcaagacacatatttgacttcatctttgttaatatctctacattctacactagggtacagtaaaacttctgtatcttacctgccatctagtaatactgttggaaagattattatgattgcattatgaatgactgatttaaataaagttaataaatcaaaagagaggaacaaagcctttgcaggagaccagaacagatataaatttttccataagagaagaaaaggacagtctattcttttatatcaaaaatcacttttttttcagtagaataagtctgttttaagatgttaaatttactgaatagtttggacaaaattaaaacatgtagatttattatcatcatcataatgataataagtagttaacggtaatgaacatatacgtatttccaaagcttttatgagactacacattgagaatacatacttataggcccttattatttctttaatgcagaaactctgaacaggctcattgaaaagagcaaaagatggcattgtataaatagcaaaatgaattcaagcttttattattttttgtctcttctgacttctataacttagcaacaacaaattaaatcccatttcaatgtaacactatcatgaaattctctatttaacaaaatgtcttctagaccccagctgattatctaattgttctgagcatttagcaattcagtcacttttattaaatatccactatgtgctatgtgctttgaaggacagagagataaatgtgagtcagtccaggagcttataatctggtgggtaaggtagacttttaaaaacattttataaaacaaagctgaattaaatatgatgtttaaaacagtcctggtagaaatgtaatatatttgtcattatatatatattatatattattaataatatatcaatgatatatttatataatacattagttatataatgtattaatatattacactatattttattatattatattaatctacaatatagattaattatattatataatatatataggataatcctgttaatttgggagctttggcttaggaaaaaatctcttaagatttttctagagcagaacttccaagttagactaacattttggatattaatggtctacatatagcttccctagaatcaacctaatcccaagaagacatggagatcaatttacaatgagcttttgggcttccatacagaactaagaaaacagactgaaatataatcaacacaaacactaaaagttaaaatttcaatgtatttcaaaaacattttgaaatgaagtagtgtggtataaggagaattgcacaaaattagtaagaatcatagagtgcataatccttcattgctttttttaaaaaaatccagcacatattgattgaatgcctgctatatttcaggcactgtgttatggattacggatataatcataatcaaatacatatattggtcctgtctttatggaaccttctatctcaagtagtaaatgttcaaaaaatttgttaagtaataagttatgaatcataaaaatatatttcaatgcaggtccctattgtgtttccatccatagcccttattatcttctcttatactatattatttatttatttattgtatttattgcagactatctccccaaactaaaataacatctcacaagggagtagatctctgtctgttttatttcctcctggctcccaaggacctagaacagtgtctggtatcaataaatatttgttaagtgaatggataggcctgactttgcttaacaccaagtatgcagaatgggaacaggaaactaaatttagcaaacaggtactaccctgatagccacaaaaggatacaccaatataaaataaaggaagctgactaattctctaacaccacatacaagacacattcatatgctatatgtgtatttctgcatttatcaaaacattttaatgacatattttacttaaggcaatccttagagtttaaagaatgaattaaacttcttgcccaactgttatttgcagagatggcttttgtaaaggacttgttcttcccttttgcatgtgtgtatatatttaaacacatgcaggtacacggttttcagttaagtttgtgttgggataaacacacagcatgaatcctgggggctatgaaatacatctgtgtatatataatccaaaatttattatggaaacacaagaaaattcttcacttttaagtatggttagattggggattaagaataaaatttagaatgttagactcttaccctacccatgctctatccgaaaatgactttctacccatgttgagtgtaccctcttctcattatctccagctctgatttactcattcattcattcacatgataatttatgagtgctgttctaagtccttggagttacctaagagctcttctaagcactgttgggacagggttatttccttctgcaagacacaataagaaggtttttgtttgttttgttttgttgtatatcttttcaaattgccattcatcattattgacaatccacataccacttagtttgtgaatatgtttgtgtatttagtttgacattttgggtggaaataaaagccttctgtttgtagttaattaaaaatgaaagtattcatgttgggattttatttttaaaaattgatctggtaagacaaagtggtttttttttcaatcttgctgatatacagttctttttttaatgaaaaaatgtcaaaaaacttaagtaaattaaattttgctatctgctgtatttgttcaatttagttggaaagtttaaaaatacctccaatccatctatatttgctgaagaataaatctagactttatatgtatatattattatacattgatggctataagacacattcatgatcatgcagtttcttcatttgcacataatatttacaacatatgcaattattttatttttattatatacaataaaaggcaggccattttcactttttaaaagtctcctctgaatgatacattgatggctataagacacattcatgatcattctaggccagccccctcactttacaggtgaggaaacagaggcaaaaaagcaagtcttgccttagcagagctatgctagaattcacatcttttgacattaatctgtattgtgtttattccaggactccagattaatgttaatctgtaggataatatatgagtttaagattagaaaaatcttagggaatgtgaacaatatcaatgtgactgaacagagtcttagtcatattaattaaagtggattgacttttatatgttcagttggatgggaaatcagtgttctatcagtatttcctcaatatcatattcatggcagaatattcctttagaattttcaaaacacattttgctactatgaattgtgtagttacgtattaacgaggatggttgtatggttatcattttcgcaccagaagaaaaataaacccacaatacacaaccctgaaataaggaaagtagaacaagctcttctactatcaaattttcttccagagcctgtggcatgcctccacatctgtgatctgtgtctgggccctagaattcttctagggtcatcacaatgctgcagagatggactcaaatcagatgcaaatttaatcaggtgaacaacaacagactcagaacacatctaagatgattatttttacatttttttgtcactgttgctactgttaagcagtggtctcttgctaaaacacaacctcactcagaaaccaatatataaagaaaggttccctagatgaaactgagtgccccacagaaatgtctggttcagtctcattattttacaaggattgaaaaggaagccagattgggagtccttcccacggtctacatctagagtctggacttacttctcaccactcctgcacacactggctcttcccaggtctcactccaccttttccttcctgccaagcatgctccagcatcacatgctgcctccttttctgggagcactgttgccacagtcttgatacagctccttcgtgttgaggtttcagctcaattttgcctattcaggaaatttgctggtaccaaccactctctttccttctttattgagagaaactcagttgcataaaattggactaatcttaatctttggttcatgaagcattctcatattggagccatgcatggtttcctttactttcattagttacttaattagttattttaaatgtgtactaattacctgtcagcttaaagcacacacaaaaagctaggatcttgataatgacttacatgtattacttccattaacccgtccctatgccttctccaatctgaactctgtggtcacatcattattttcagttatatgtactttcattgcgtccatatataacatacacacacacacattattttagttgttttaaactttagtaaatagttatcagtctgcatgcaatcttttaggacttacaatttttatataatatttgattgttgaacttgattcatatattcatatgctactcaagttcacttattttggttaccgttaagtatctcattgtgtggcttattcacccatcagttactttctacgtcatcactctgtcttatttgcttcataaaacatagcagtatttgtagaacataccaactttattaatttgtttacttgtttatcatctgcttctcactgctaggacatactttttaaaggacagagatatatcttatttatcacgctatttcaaattattcatgtaacatatattgcattaaaaaaatgaaaaaagaattcactctagacaaactgaacaccttgagtttccttaatatgtcaggttgtttcttatctattgtccttccttcattgcctttaaagctctgccacttagatttgtgatttgaagcagcctaacatacgcctgcttctttttacttatcgtctatatttacaaatttaaaatggatgacttatcataaaaaattataaatgacataaaatatacaaaatgcctggcacattctgaatggtcagcaaatagtaacaagtatgactgctactccaatcacattacttggagtgaatataacccccatccccctgggtagttttctcatccatcaaggctcagcaaaagtttcacccgcttcagggaagctctgagatacctctctatcccctgtacctatcctaacactagcacactgctctgaatttgttattctacttatccacccccatatcccacaactctttcttggggactgtgtcttatttgtttacttattgactagtcctctttcctctaatgccatgttaaacaagtaccctttgagtggctcattccagcttccagttattgtaaatcacactggattttattaacttgagggcatcatcagtatctgcttccctgatctctatgctaacaacccagttaagaaataaggggcttaatcaaggtgctaaatttgaggagcctactctacttggccaaataactaatgggctctttcctatgacaccctttctttataatgattccctttttatttcgtaccacttctattttactcttttgacttaaagatacatttaattattagcctttaatttgtttatttctatgtttgatcttttaaatttcctactgttaacaatatatttttagttaactttatagtagcttctaaaattagcataactaaaataaattaacgttgaatactagaaagcaataaacatcattccaaaatgaaacaaaatatcaaaatttgtataattttcatatttttatcaatgcaataaaaatataaaaatgtatgtttaagtaggtcacattaaaaaataaaatacaacccaggtagcagaaatgtttataacaatgaagtgaaatgagattacatttcatctacgtgatcttttaattatatttttattaatcttgcaccattaattaatagggttataagacagcacatttaacaaggactgcatagagcactttgatatggccacataaggcatgagaatctaatactgatggtcatatattctataaaacttaacatataccaggatgaaaatagagtggaacacattaaaatgtaggttaaaaaaataataaaaaaaaacccaagtcataaaagcttatgctaaattaaatacagagggatagaaagaaaaacagcaaacattatttgctaatgaaaaagtacttagcttggagatgaatgaataaaaatcataattaaagaatctctaattaggctcattctaatgtttcagttcttgtaagacagttccaactacgctttccaaaggtttttcaaaatttcagagttaagtggctactgggacaacaaaggcaaccctcgtgtccacttcaaacaagtccagtctaatactgaaatagatgttttactcatgaagggtcatgttatgtgtgcagttcactgtgctctctatatcaattggataatgagagagcttttcagggtcttgttaaaaactttagccagatgtcaccccaaatcaccaccactaatttccgtactacaaaacagcctttgacctaatgagtagtcaaatattccagctatggctttttcttagtgtttctacaaacatgactgttatctaagaaaaaagactaagaaaaatcattggaatgttatgtttcctaacaaactattaagtatgatttagttacttaaaataatagtaatgttgccagtcatggtaacattaatacctgtaatcccagcactttgggaggctgaggtgggtggatcacctgaggtcaggagttcaagaccagcctggccaacatggtgaaaccccatatctactaaaaatacaaaaaattagccaggcgtggcagcaggtgcatataatcccagctacttgggaggctgaggcaggagaatcacttgaacctgggaggcagaggttgcagtgagccgaggtcgcgccattgcactccaacctgggcaacaacagcgagactctgtctcaaaaaaaaaaatagtaatgtcttcactgtacttttaaaagtaaatcatccatttgtatttctttttaactagaaactagaccagaagttctgcagtaacaggacaaatgtggcgtcaagccaaggtgacacactcatttttgttcttcccaagaacatcttcagctgtctgtacttgaaagtaaaaggtgaataaatacctgaatataaaaattcatatagctactgtagcttttatacctatcatgtcacagcattcaaattagttttcagtaaatattaactattatgtcttactctagtgatagcatctccacagacttgacatataagccatggatttgaaaaaaaagttgattattatgagagatgcatatgcctgagtattctgtccttactgagaataattttttatatcttacaaattaataagatacgtttagagcatagcactcttcacaaaaatacattattaaaactaaaaatacatttttctctttaagaactgtcacaaataaaatgattctatttatgtattagcctttagtctctgataattggatttatcttttaaaatattttagacataatgcattaaagataaaaactctccttatcaaatactgaaatatgtttcttgaaataacaattaaataaatatatgtatgtgtgtgtgtatatatatatacacataaacgtgtgtgtgtatatatatatacatatatatacacacatatatgtaaccagcatccttgtgtatcagaaggggttagattctagtgatggcaatttcaaaaaggggctggcatgtaaagtaaatatgtgaaccatcctggatagaacagggagcgaggggtcagaggatagctgaagaacacattccctgtctatacgcattgatattaaaatagtttgatgcactgaattgaataaactacatatatatagtttatatatatataaataaataagactatatatatagtttatatatatgtttgcaggtgatatgttgacatataaattagaattcttgtgttcaaatttcagtttggcagctatgaaatctctagaaactgatcaaatattttctaggttcagatattctgcctgtgaagtgaggataacacttccttcacaagtaaaggaaaaataatatataagagtagatataaaaactgcctggaacagtgcctgacaaacagcagatacccagcatattctagaatcctttccccatccccttgtaatcacaatctatcaggatgaccttgggtgcaagtgcagtgaagtatcatatggtttttcaagtaaggagctgatgattgcacataagtactctagaaataaggcagctccctgactggttaattcaattacttaaagatgtcttaagtctaaggacgtcttagttttcaggttctctccatttttctgctctgccattctcagtgttccactgaaaagaaactcctttacattgatttcttcatccagtagaggaaacccttcccagaagcttctcagcagagttcactttgtaaatataaggcataattacaaaagattcccatactctaatcaagacctggcaaggagaatggactacaatgatttgtttagactcagatctagctctgagctatagatagatatgatcatcttccctgagggatggatagaaaaaataggaatttttctgttaagcaggaagaaaagatatgaatttggattggcaaccaaccaaggatactcatgttggattctgtaaatatatcaattttcacttccattaattttatgattagcataattgttcaagcagaagcagcattcttggctaacatggctcaggtttccactgagtcattctaatatcaagctaaatgaatatcagattagactagacctggtcattttcaaactatattaaagtatcctttttaaaatgaaactttctagaagagtcccaatttatctaggagataaaaagtagatctgcctggttgaactgaagcatggtatgtgactgtaccccagttcactggatgccacccctaggtgcatattcagagcatttactatgaaaacgagtgtagtcgatctttacagtcccttctagacctttaattttatgtctatgaaactgacaatatgtcatccttccgcaatttgctaccatgtcagtttgcttcaagatgtgtttgatgggttgcatatttttatgatacgacaaaggagtagtataaagata

SEQ ID NO: 2482 - DNA, 6323 bp, Homo sapiens
aacctgcacatcctgcacgtgtaccccagaacttaaaaaataaaaaacataaaaaactataatctgaaggaaaattaactgggtttgagttttatttgtatttttttgtttcaaagttttattataatgatagaaatggtcacaaatgaaataattcatttcttcaggtaaagagtatcctcttttgaaaggcaaatcttcctgcttctagaggaattcatcttagtgaggatttatgcaattagatgacacttcttcctggtaattactttatgtggaagtaaggagggccatctttatggtggtgggaaagggcaggtacattgcagaggtatagaagtttgaagttcattttttttttattacgtttttattttttcatttgcacataacttattgtttaggaaatttcactagaaagatctctgtcatggaatatctgcctagggagtatagagaaaagtatgagaatcatgggaacactgtttaatctggagatctccagcctggacatgagccattatacaactcaagcttttatgcttatctgatgagttatatttatatctcagcttcacttctaaactttgaaattactttactacataatttttgtagtccattgtagttcattttgaaatttcatccctaatgtcttttccagttctgcaattctgtgatctgtcatcttctgaactgggtattacatgttctctctcacacacacctatgagatgatatttccagatgtttatctcttaagaatgcactagccaacaagctttaaatgatagacagggatggttcaagtacaaaaagcagtttgttaagtattagattaataaaagcgtttatacaagttaattttttaaaaaaaacagatgaataagtcaatcaaaatctcaaaaataatgattgaatcagtgcaacttctctttctcaatttattaatgaaatatatgcagacttcaacatgcatcatgcaaaaatttactgagatggataatacagacatattgaaatggataatatcaatgtaaatttctgctaattcaacttttcttttgaaaaaaaaaagaaaacaattttattgctctgatgagtagattcaattaaatcaaatgtccccatgggtgtctttgaacggtagtgatacctaaactggaaaggaaacgtaccttttgaacaatatccaggaaatgaatatgtgtctgtgatgatttttaggacaaaatagaaaatatacaacaaaaacttacacacaaaatattggctttttttttttaggaaaacaaatcaattataatttctggaaactaatcaaataaaggagctcactccctttagagtataatgagcttcatttgtcttttgtccccaaaattctaattagattgtcttccattttctctcttcccttctctccccttttctctcaggcagacacaatctcgatacccagggtattttaggtgtgagctgacttaaatctttgtatttcaaactgcttaatcaagcataaatggacacagagtgtttcattctcttttaagaatgtattatctcagcccagatgaaatgactggctctttcattctatacctctgtcccccttcttgctctacctaatttccaaaatagattgtggttcttcaaaacaacttgctgcaaagcacataaaaaaaaacaaagagctttgttaatgttatctttatattatcagaagcaataatgtttccattatttatgacataccccaccacacagaaaatcaatgttaataaccaaggaacacaaagaaaatcccttattgcttcgtgttcacacagaagttctaagacagaaacaggctcaagttgttccttagatctccatacttcttagaatcccttgacaacattcttgtaagtcattttgacattcaaaaggagatacatcaaaaaggttctattttcaaaatcattttcctttttcttttactgacagtctaacaacacctatcacttcctacttacctctcactctcttcatgtgttgtcctccaaatctgtggataaatcatgtgacatattcaacgacataaaaaggaaaagagtcaagtattcaaacagaaagggttgactgagcaggtggcctaaaatcaatcctaaaatctacactctagagagtaaaattatattggagtctgatgtgatatgaatatcaaaatgtagtaaccaaggaccttggattcaggacaatttagttcacattccatgctatcctttccttgatgtgtgatattcagcaaattaccaagattccctgagctgtcttctctataaataagggctaccagtacctcctttaaaaagttactgtaaaataaacatgtaccattaatgtaagcatatagtagacacctaataaatggcagcaaatatgattgttagtattaaagttggcagtttagagaaaggagaggtcatatagcttttagacatactggtacacggtaactccttgaagaataaataggatttacagagtagaatgaggagggcatttctatcaattggtgcacttaggaaattctaatcatctatttctaataccatacccattatgagaaggcacttgaaaggtgttatgatagtcaccctatttgcagcccactacctagtatcaccgaaattcattttaaagtattattctttgtttaacagccaagaaatgaaatgggaaaatgatttcaatagttgtactttgtatgtattcatatttatgatggaattacaaagagaagtagaaagtcttgtccaaagagaaatcattttttaaaatgctgatcctcaagaacacttgtgataaaggcagataattttccttgcccattacaccactagaaagtgtgaatagttcatttgagcctgtaagattgcttccttttatccctgacacagtatcattcaattatgttcctaagtctgttgcattaattatatcataagacttaatatattagcttatcaagaacttctcaatttaggtaatgagagcttccctgagaaaaaatactcaaactgaaaactagtaaatctactcatactcctctctcttttctagaaaaggtcatgggtcatcttcagaagagtccctaaaataagtgatgagccaaaattcatataaatttctttcagtcaaaacataattacaccgataatctactgaaaataaagaactttattttctaaaatgtgttatatttgctatatcttatgtgactcagggcaaatctctgaacttctctgaagcttaacctgttctcttgtttgtcagagtgggatgagagtaactgtcctgcttctcccataaagtctcaatgaggacaaaaataaataatagatgcgtaaatgctttgaaactatatatctctatgcagatattattattaaaatcaatattaaatggatacgtaagccaaagcaagcaagattaaatgaggtcacgggaatttttttaaggacaagtaaaaaagagacctttaaaaatagcaacataacatgtattcaataaatatttattgaataaaagaatgaatgaattttagtatataaataaaacatatttgagtaaaaatatcacacatataggtttttcagtcacctataaggttcctaatagtgaagtttaaattgaacattgtcttgataattttatttaaaataataaacagaatattcatcgttgagctcacaatataatattttatactgtagataccagaacctctataactacttgtgaaaagaatactgaataagtgtatgaacaaattcgtcactcaaaacaacttctaatgtaggaaaagaaatttcaaacctatttatttttagcagccacattaatagtgaattattataaacacaccatttaaaatgcatcaaaaactttctagttggtaaatattaaaaatcagtgtacatgatgctaaatggtgggcacaatctttcaaaatggaatatgaatctcctcccagaatattaaaacatgttttttcgatattattgtttgaattatatatttgcattaactcttcctagaagcaatatatgcctatggctgaaattcagttcatttatgcaatctcaggtaatctcctggagaatgacatcaagtataacctctgttttgacacaaataaaaatataaccaagtcttcctagttttttcaagctaatttttccaagagtgtaaagaaagattcattcattaaaataagtagacaaaattgcttttccataaaaataacatactatttaataatgttataatatttagttgatactaacaataattaattaatacaaataataatttgtaatatttgtatttgcaaattgctccatcatacatcaacatctcattcaagtcacatcaaggttatatatgtggtacaggtattatgtccagttactcatccataagtgtgaggtaacatctgtgctatttaatatgctaagcctcagtttattcatgtaaaaaccaagctgaggttaattatgaatagcattggagatagatgtacatgaacacatattttaaacactttcattaaatttaaccatggaaaatataatgttcgtgagaaattatatgtgttaatacaataacagtctgaatatttcctagtgatgggtcacatgatcagaaaatcaaaggtgcataagtcaaattgggtatttatttttttatttcatagaattggagagtttagacccttagcttaattataggttttcactgtatacaaaagtgatccaaaaaccagattaatatgttatttttactacataaacaagagatccaagcacagtgcttatcattgatcaattttgtaaatcaatgagaatgtggatagttaagggtctggagaattgttgagaacaaagagtgagtatgatatctttattcttactccttggcttcactttacacctctgttgatcactgtttccatttaagcagttggcctgaaaacagaacctactttcatggtgacagttacaaactccacagttttactctctggccagagaaatctggatagatcttagatttctataactgacctcaggagtccaagaattctctgtttcttagtcaatatagttcactttgcagcttagtctttatttttttttcaatattttaacaatatatcttgcatctgagtcatgcggattgagcaaaaacttccataactggagcaatccgaatatagtattttgagagcagaaacagagattcaacgtacaactcataatcataaaaatctaggaaagctttgtagttcttcaaaatctgtgactgcatggaacttaggaaagttcagcaacaggaaatgaaggaagttgccagttgttgtccagcaactagcagacaaaactctggaatttgtgaatgccaacacttccttcaataatagcaatgcccctgattttttttcaggcttcaagttgtgtgtgttatgtgatgtcctgtcacatcagtagaaaagtacaatcatgtgacacaccaaaggcctgacaagtttggttcctatgaattcttcaatttccaaaactccttgaactgaggaagtggataagccaaaaccttcaaaaatatgtctacgacctaagcgactcactatattttaaaaaaatcaaactgccataggaggtttcactttcttgtaaatgtccccgcctggcaatggctagtaacacaaagacaatgatgtcttccttctatactttgtgaaaaggtttgacttttaagtttcagaaagacaaattttctcataaatgacgcaatggaaattggattaaaaagctgtctcagttggctttaataaactaccaaagtacttttgtttcgttgttccattctaggcagggaacacagcaggttttaatggtcagctaccactaaaaagctaacagactgcacgcaggcaaaacattaatcaaaactgtgaaatagtttccctttagttccctggatctccccaatttgtgccctttctgcccttttccaccctttaaaagctcaacatacctgagttctctatactttattttcttcttttacagtggtgctcacccttgagagcattcatttttatatggagcctagtagacttaacccaaaggaatttatgtctaaatgtgaatttttattgcaaaaagtaagtgggcaggagagggacattctagagttagtgaagtaggaggcaggatgtaactgcagaggtggggcttagacaccacaccaaattgaggactagctaaaacaggacc

SEQ ID NO: 2483 - DNA, 8709 bp, Homo sapiens
tattttcagagtctgctagcatatctcagtatatactgaggagagaatacacttttggtatattatacagtctaaaaaaagaaagtgggatataaaatgctcttctgttacaaagaatgacaaagcaaaaagaaaatgaatgcaaggtatatctgaatacactttgaagagatgaatgtgaggtacagcaattatgagataattttcctggctcacatgattattaatgaccactagaaaaggaatgccagacttaaaggctgagtcacttttgagatgctattgctttaacgagtaaattctccatttccttctatcagctaagctattatcttcttgttcatatgacatccttttacaaatgactcacatctccttcagccaccctctaagtgaccttcctaagagaagcaagaacaggttttataattcaaagaatgcagagccagaaaaccaaagtttgaatcttcttactaccgtgtgacctcaggcttaatcattttttctctaattttcttacctacaaaatggtgttggctcctaccatgaagtcaagtaaggtgacacatgtggtcaataaatgtcggattcttttccctttaaacggtggttctggggtaatctcaagttgcccgtataatcagagtttgtggttagagaaaggaagctggcctgtcagtcagtctgtggaataccatccattttcacatttgtatgaatcccacagggtcatgaccctggatgtctataaacggagatttctggaattgggaggtgctcacatactgctctctaaacacacgaacagttactgggccatgcagtgatgctggtgaacagaggtggggtcccagggcagacagccgtggcaagaggtgggaggtaggagtgtccctgagaacatctctgtacaggctcgaaaggacaatctgctgaagttgtgtttgttaatagcaaacacttgtatgtaccaggcactgttccaagggttttaaatatactaagtcatttaactctcacatcaatcctatgagataagaactatcatttccccattttcagatgagaaaatagggatagaaagatcaagtaacttgcccaaagttacacagctagtaaacggcaggtttgagatttgaacccaggcagtcagattcaggtccaagctcctaaccagcactctgtgctgtggcacccaacacctggggtatagcagtatattagtccatttttgcattactacaaagggatacctgagactgggtaatttataaagaaaagaggtttaattggctgacggttctgcaggctgtacaggaatcatggtgccagcatatgcttctagtgagggccgcatggagtttacaatcatggcagaaggtgaaagggaaagctggcgtatcacagggtgagagcaagagcaagagagaaatgcaggaggtgccacacacttgtaaacaaccagctgtcacgtgaactcagagtgagaaccaaggggatggcactgagtcactcatgatggatccccgtgatccaaacacctcccaccaggccccacctccaacactgggaattacgtttccacatcagatttgaaggggacaaacatctaaaccacaccaagcagaaaggccaagaatgagagggcaggtgctccagggtctgtcaggcctctgtcccttcctgaccatgtgtatcagaaactactttttgtcctaacatccatctctccacttcccatggtcttacacttctggtcacatggcaacatagaacaatgtctacagggaccagcctcttctgcagctacatgtacatctgtgatgaccttctgaataacagacacaagtgaaaatgtcctgaagtcacctctatagaaaattccttgaaagaagttggcaagcaccctttgctctttcactattttcccccttcatccatcctaccatctagaccacacagatgatgaccgagtttttcctaagtttggtgaaaaacatctacccatacacaatatgctcagtgaaccccagggagaataaatcaaatatacaggaatgtcacagacaagctgctgaaaaccaaaaattgagagaaaacattaaaagaagccaaaaagaaaaaaaaagacatgatacacacatcaagcaatagtaagattgacagatgacttgtcaccaagatctacagaagcataagataacaaaatgacatctttaaggcactggaaaaataaactcgtcaaacagaattctagtttcagggaaaataacttctagtaatcaaggttaattaagatattttctgataaagaacagctgagaaagtttgttgccagcagatctagccacactacaaaaatactaaagaaagttatttaagctgaatagaaacaataataggtggaaactcaagtctacaggaagaaattaagggccctagaaatggcagtctgggggagtaaatattcatttttttcttaatttcttttaaaaatggttaaaagcaaaaagaacattgaattatgatgttgtaacgtacatagaaggaatatacataacaagagaacaaataataagggaagttaatagaattttactaccgttaggttcttacattttgcatgaagtgattaaatattgattctaagtagactctcataaattaagggtgtacactgtaattcccagagcagccactaaaactaaaacagacgcaacaaaaaccccaaaccaaaaaacccagcagtatagctaagaagccagttaagaaaatagtatctttttaaatattctatttacccacccacccccaccaccaaagagggcaggaatagaataaaacaaagaacatatgagaaaaatagaaaataaatagcaatgaggtagacttagatccaatcatatcaaggttatattgaatataagtagactaacaccccaattaaaaggcgtagattgtcagactttatttggaaaaaaaaaaaaagatctaactatgtgctctctaaaagaaacccactccagcataaagacacataaaaatggaaagtaaggacaggtgcggtggcttacacctgtaatcccagcacttcaggaggccaaggtgggcagatcacgaggtgaggagttcgagaccagcctggccaatgtggtgaaaccctgtctctactaaaaatacaaaaattagtcaggtgtggtggtgtgcacctgtaatcccagctactggggcggctaaggcaggagaatcgcttaaacccaggaggcagaggttgcagtgagctgagatcacaccactgcactccagcctgggtcacagagcaagactctatctcaaaaaaaaaaaaaaaaaaaaaaaaaaggaaagtaaaagaatagggaaagatacattgtgaaaaagaaagcataagaaaactagtattctctgttaaaatcagaaaaggtagacttcaagactaagaacattatctgacataaaaagggacacttaatatgaaaaagtgagtaatccaacaggaagctttaacaatcccaaatatgtaggcgcctaataagagagcttcaaaatacatgaaagaaaaactgctagcaagagaaacagaaattatcagagaagaagccctttcttagtaactgacagaatcaattgacaaaatgagctagtttatacaatagttaaataacatattcttttcatgtgcacatgaaataagtcattttaatagatacagaaaaattatttggcaaaattcaatatgcattcatcatttttaagaagaaagaaaaactctcagcaaactaaaatagaaggtaacacttgctgtatcttttagggtatatacaaaaaaaaaactatggctaatatcatactcaatgatgaaataataaatattttctccctaagatagagagcaaagcaaggatgtctaccctcagcatttacattcaatattttactggaggttctatatatgcaaaaaaaaagtaaaagaaataaaaaacataaagtgtagaaaggaaaataagacttattattcaacaatctacgattttatacaaagaaaatccaaagaaatctaaaataaaaatttggggaactaataggtaaatttagcaaactgtcagcatacaaagtcaatatacaaaaatcaatagtgtttctatacactagtaataagcaactggaaattaaaaaatgttttactggcatttataatattatcaaaaagcataaaataggattaaatttaacaaaagatatgcaagatgtctacactgaaaactataaaacattacttgaagaaattaaaaatacccaaataaatgaagacatataccacgttgatgggttggaagtctcactattgttaatatttaagttctattcaaattgatttactgcagtactaattatttggggatgcctattgtttataactaaatcaaattctaattgataaattatgtcagcgcaatcaagtaagtagctcttatatgttttatacatctcttatatgtctgttatcttatttgttaaaaatggaaataatagaatagctgtatgcatccagtagttatagttgtactagtagaaatagaagaagaaagaagagaaattgttgtgttaaaagtaatagaaaaattttattgagttcttactacatacgggacattatgccgagcaattggtatctattctttcttacttatcacaaccactggctcaggtaggttctaccaccatctactttttacagacgaaggttcagagacttcgctttagggaactaacctagaaacactcatctagtaactgggaaaaataacattcaatcaggtttgtctgactccaaatctgtgctcttaagccccaatctatttgctgcttctcacaagagagttcgtgtgaaagcatttgacaagtcgaaaacgccgtgctagcatatgaaattatgttcagatcagctgggcatggtggtgtgtgcctgtaatcccggctactcaggaggctgaggcaggagttcaagaccagcctgggcaacatagtaaaactccatctcaaaacaaaaaaaagaggccgggcacggtggctcacgcctgtaatcccagcactttgggaggccgaagcgggtggatcacaaggtcaaaagatcgagaccatcctgtctaacatggtgaaaccccgtctctactaaacatacaaaaaattagctgggcgtggtggggggtgcctgtagtcccaactactcgggagactgaggcaggagaatggcgtgaacctgggaggcggagcttgcagtgagcagagatcgcgccactacactccagcctgggtgacagagtgagactccgtctcaaaaaaaaaaaaaaaaaaaaaaaaaattatgaaatttgagtcctaaggaataaacatgtgctaccaactccttataaaatcagaactcttaaaataattcagatatcaaattaagagccaagatgtttatgtaagaaactttaagagaaaatcataaatgttttggtgttacaagctaatgtgtaatgttgagagctttttaaaaactattacaagccaatgtgtaatgttgagagctttttaaaaactaccagcatacaaagtcaatatacaaaaattatatatgaaatatataaattattatttctttttagagctgattggttttaaatacaaacctaaagccatattttcaggagaactttttttcataaggatgcacaaggcaaccagttcttacactggtaatttataaaatctaacacaataagaaacatctgatgacattataaattttcagaacaaaaattatagccatcaaatttgaatattagtttttaatattcaagatgcaggcatagcctactaatctgctgatggagaccagacgttggttgattggtggctcttagctacaatgcatgttacaggtttgttgatggatatattttgaaattttgagtcaaaactagcttgtcaacctgatagtgatcacaagaaggtcaaatgttacaaacatagtttcaaaatttaacggagaccacatgtgaaacaatgtatattcagaagaagcacctgtgtaagtgatcccaaactcagatacagtactatgtgagtccgattcccccttgtagaaatatagaagtctgcaagtcaaagctaaagcaaagatgagtaaacgcatccctgtgttggagttacagagtgtagggcagtaggatgagtgctagtaaaaagacattttacaacacaaggtggaaaaggctttgggtcatctgtggctgagacggtcagaacagatttcatcttccccaaaaaattctaaaaataaaccaatattctcattcactctattttctcctttccctccttctctctcaatataaatatacagacatacattatatataaagagttttcaattcaatctccagacctagggacctctctgcattgtcctgttcctacataatgttataactctaaaagaaattatttgagctagcctttggtaaagtttctctttttattagcacggctctttaagagctctgaccggtcaacctagtaataatgatctctcaaggtaagtgttttttttaaaattccccttatagaatatgcaaattaaattagttatggtggcaaagggtagagaattggaaaaggaaatttaacattcctgggttcaagcacattcatggacacatttaacctccaaaatatgaaaaacgatagataggagaacaaatacaatactgctacgtagaatgatgtcatataaataataaaaataatagtagtatttatgaaatgactaaaggattaataagctataacagaggaataatatacagtcctaactggaagctaataagcaaatatatttggatttacaatcttccttgaagagtagaaaatgaaaaactatttggtgatggtagccaaaaagtgcaagcagaaagatgaacatagtgatatctctggtgtgcaatagtgtaattcaaatgatacagacctaagatgatggacataaggaaatcttggaaagaaaacacaacagctccagagaaaaggtctatttcaaacacatggaaacaatggcagcagccaagagatttcaaacaactgattttaaaacaagggaaaagtttagaaaaggatgaaagattaaagaattacaatggaaaataaacaaaatagaattacaaaagaaacctactgaagaggaatgcaaataaagtaatttagctagttgactttccttcaaattttgtgtttgaaccaatattaaagtgaacattactgctgaattatttattatgtaagtagaaagaaatcaatacccttgagatacacccattatggaatcagatatttaagaccaaaagaaaacatttctggaagattttaaattgcaagacaatgaagtcactctatgtattgtcagaaagcaatagaggtgtcagaaatttttgcaatactaaaggaaaatacagaataaagtgacactggcattttttgctgacagggtaaagacaattcacatcaaagaaatgatgtgtataggcattttaaactcaactcagcattccattgccttggcaaatggctccagtcagaaacctaggagtcatacctgattgtttttcttctctgaacccccatatccatccaattagtggatcttatagacactatctccaaaatacatcatgaacccaaacactttcttgcaacttggctgctaccatcctagccaaagatacaactattaatatttcgctcccattataacagttttctcttatgagattccctgtccatcttacccctacaaccaattctccaaacagcaataatcattttcttaaaatgttaatattatcatgacttccagtaattcctagaataaaatttgacctcctttccataggctacaagtcctgtgggctctaagcgcagctcaccagtcttacgccacatgcttcagaagctggccccactggcctccattcagtttccagaaataacaagccattcctcaccttgatccttgccacatgccatttccactgtccagaagctgctgctcctacctgcttacagagttgactcctccttatgtcttaatttttgacataagtgttagacaagcaggtctctcctgatcgcctcatcctaggtacatatccctttcttattctgtatcacagtaccctgctcacccctttcatagcacttttatttgcaatgaaataggtgtgtattggtttccctgtttatcacctgtttcccacccagaataagaccacaggcttcctggaggaggaaccaggttctttcctctcaccattgtgccttggcatccagcacagtgtctgagctatgggaagtgtgcagtaaatgtttgtggaataaatgagtggattaaatgaatggtgtaatagagaacatattccaacagatttgcaacacaatatagttaggaaaagcaaattgacaaatatggatggggttttagaaattacaatgagggaatatgaaaggagaaatattagtcattagatgtttttattacagatatataaatgaataatcactagatcaaaatgaaagtagaaaatatatttatttattttgtgatggggtctcgctttgtctcccaggctggagtatagtggcataatcatg

SEQ ID NO: 2484 - DNA, 9475 bp, Homo sapiens
ttattatattgattacatgttgaaatgattttgtatatatcacattaaataaaatttattgaaactaatttcatctgtttctttttacttttaaagtgaaactagtagaaaatattaaattacgtatatggcttgcatatttctattgggcagcattggtataggtgaaatgaattaaaattgattattgaaactgattaagcatatagaattgagtataactacagaattgaatgcaaaatccctaaactagttcttgaaaaaatagttttgtggaagaataacataataataatagatggtagggttgagggagtcaagggaagtaaaatcacattaaagtaacattcatttaaaagtttttttctccactttctttttcatttttattatactttaagttctagggtacatgtgcacaatgtgcaggtttgttacataggtatacatgtgccatgttggtttgctgcacccatcaactcgtcatttacattaggtgtttctcctaatgctatccctcccccagccctctgccccccgacaggccccggtgtgtgatgttccctgccctgtgtccatgtgttctcattgttcaactcccacttatgagtgagaacatgtggtgtttggttttctgtccttgtgatagtttgcttagaatgatggtttccagcttcatccatgtccctgcaaaggacatgaactcatcccttttttatagctgcatagtattccatggtgtatatgtgccacattttctttacccagtctatcattgatggacatttgggttggttccaagtctttgctattgtgagtagtgccataataaacgtacatgtccatgtgtctttatagcagaatgatttataatcctttgggtatatacccagtaatgggattgctgggtcaaatggtaattctagttctacatccttgaggaataaccacactgtcttccacaacggctgaactaatttacattgtcaccaacagtgtaaaagcattcctatttctccacatcctctccagcatctgttgtttcctgactttttaatgactgccattctaactggcgtgagatggtatctcatggtggttttgatttgcatttttctgatgaccagtgatgatgagcattttttcacgtgtctgttggctgcatagatgtcttcttttgagaagtgtctgttcatatcctttgcccactttttgatggggttgtttgtttttttcttgtaaatttgtttaagttctttgtagattctggatattagccctttgtcagatgggtacattgtaaaaattttctcccattctgtaggttgcctgttcactctgatggtagtttcttttgccatgcagaaactctttagtttaattagatcccgtttgtgtattttggcttttgttgccattgcttttggtgttttagtcatgaagtccttgcccatgcctatgtcctgaatggtattgcctaggttttcttctagggtttttatggtgttaggtctaacatttaagtctttaatccatcttgaattaatttttgtatatggtataaggaagggatccagtttcagctttctacatatggctagccagttttcccagcaccatttattaaatagggaatcctttccccatttcttgtttttgtcaggtttgtcaaagatcagatggttgtagatgtgtggtgttatttctgaggcctctgttctgttccattggtctacatctctgttgtggtaccagtaccatgctgttttggttactgtagccttgtagtatagtttgaagtcaggtagcgtgatgcctccagctttgttctttttgcttaggatcgtcttggcaatgcgggctcttttttggttccatatgaactttagagtagttttttccaattctgtgaagaaagtctttggtagcttgatggggatggcattgaatctataaattactttgggcagtatggccattttcacgatattgattcttcctatccatgagcatggaatattcttccatttgtttgtgtcttcttttatttagttgagcagtggtttgtagttctccttgaagaggtccttcgcatcctttgtaagttggattcctaggtattttattctctttgtagcaattgtgaatgggagttcactcatgatttggctctctgtctgttaatggtgtataggaattcttctgatttttgcacattgattttgtatcctgagactttgctgaaattgcttaatcagcttaaggatattttgggctgagacaatggggttttctaaatataccatcatgtcatctgcaaacagggacaatttgacttcctcatttcctaattgaataccctttatttctttctcttgcctgattgccctggccggaacttccaacactgtgttgaataggagtggtgagagagggcatccttgtcttgtgctggttttcaaagggaatgcttccagtttttgcccattcagtatgatattggctgtgggtttgtcataaatagctctaattattttgagatacgttccatcaatacctagtttattgagagtttttagcatgaagggctgtcgagtttggtcgaaggccttttctgcatttattgagataatcgtggtttttgtcggttctgtttatgtgatggattacgtttattgatttgtgtgtgttgaaccagccttgcatcccagggatgaagccaacttgaccatggtggataagcttttttttgatgtgctgctggatttggtttgccagtattttattgaggattttcacatcaatgttcatcacggatattggtctaaaactctctttttttgttgtgtctctaccagactttggtatcaggatgatgttggcctcataaaatgagttagggaggattccctctttttctgttgattggaatagtttcagaaggaacggtaccagctcctctttgtacctctggtagaatttggctctgaatccgtctggtcctggactgtttttggttggtaggctattaattattgccttaatttcagagcctgttattggtctattcatatattcagcttctttctggtttagtcttgggagggtgtatgtgtccaggaatttatctattttttctagattttctagtttatttgtgtagaggtgtttatagtattctctgatggtagtttgtatttctgtgggattgctggtgatatctcctttatcattttttattgcatctatttgattcttctctcttttcttctttattagtcttgctagcggtctatcagttttgttgatcttttcaaaaaaccagctcctggattcattgattttctgaaggtctttttgtgtctctatctccttcagttctgccctggtcttagttatttcttgcctccttctagcttttgaatttgtttgctcttgcttctctcattcttttaattgtgatgttagggtgttgattttaaatctttcctgctttttcttgtgggcatttagtgctataaatttccctctacacactgctttaaatgtgtcccagagattccggtatgttgtgtctttgttctcattggtttcaaagaacatctttatttctgccttcattttgttatgtacccagtagtcattcaggagcaggttgttcagtttccatgtagttgttcggttttgagtgagtttcttaatcctgagttctaatttgattgcactatggtctgagagacagcttgtcgtgatttctgttcttttacatttgctgaggagtgttttactaccaattatgtggtcaattttggaataagtgcgatgtggtgctgagaagaatgtatatctgttgatttgtggtatagaattctgtagatgtctattagttctgcttggtccagagctgagttcatcttcactttctttatggtgtctttcaatgacattttaaagacatttttaattttaatcaaacttttcaatcttttctcttatggttaatgcttttggcgagtcggttaagaaatccttctgtattccaaggtcagaaagatatttactctttttaaaaaagtaaagctttgttttgacatgtacatgcttaatccacctggagttgattttcctgtattctgtgggacagaagtgtagtttttttctctcctcatatggataaccaagttttcctcctttccccattgatctgcaatgctgtctctgctgaatatgaaagttccatatgcgtggaactctttctgtgttctctgccccagaggttagcaaactttttccgtaaaaggtcaggtagtaaatattttcagccatgagaaccatgtaatctctgttgccactactcaactttgttattgtagtgtaaaagcaaccacaggcaatatataaatgcatgagcgtggctggtttccaatagggctttatttatttatggacactgaaacgtgaattttgtataactttcatgtgctgcaaaatattatcctttaactgggtttttcaactatttataaataaaaaatcattcttagctcatgggctatagagaaatccaggtggtgggccggtccacaggctgtagtttatactgctccactggcccgcactgataccaccctgctgtaatgactgtagcttcagaacaaggccttgtgtctggtagcaaagcccctgccgccttatgcctcttcttcagctatgttttggcaattattggtcttgtccacttccatctacatattataacctgcttattgagtgccgtgaaaaaccctcttgggatttcagttggagtatttatgaacaaaactatctctccatttatttagacttgctttaaagtcttttagtgaatgtttataatttgatttgttaaggttgttcgtatcttttgttagatttatatgtgggtatttatagtttatctgctattataaatactgtatatttatttaaaattgttttctagttgttgattgctggtagatagtaatgctgttgacttataaccagcttcatttaaaactgtttgctttaaacgtgtctgttgagtcttttctgttttcttcgctgtaatagcagcaaacacctaatagggcacggtgtgcaggctctgttctaagacagctaataacataggtcatagtgagactcgggcactgttgttacccattttgaaactggggcatttggaggttaaggaacgtgtccggggccgtatgagtggtgagtggcagaggagtgattcaagcccaggcaatcgcacccagagtccatgcctttagcccaagctccgcaccattgtctgtgtcatctgaaagtcctgatggcttcatttccttctttccagtcttaggcatttaattccctcttactgttgcatttctgtggctaggccctctgctagagtaggaatagtaatggtgattgtgggtaacctcgtttccttccttcctgattttctttttttttttttttttttttttgagacagggcctccctgtcacccaggctggagtgcagtggtgcaatcatggctcactgcagccttgctttcctaggctcaggtgatccttcctcctcccaagtagctgggactgcaggcgagtgccactctgcctggctaagtttttgtaggttccccccccactgtggggcttggttattaatgcgtgttaaattttactaaatgctttttctgggtcgattgagatgattctattatattccttaattcactatatgattgtagcttttctaatatgaaacagtctttacattccttggatcaaatcaattatggtatattattattatttttaatccactgttaagagtctagttgctaattagtatttttccatttatattcatgaatgaaatggacccataattttgtttttcttgtatgatccttattttttttagtaccaaggtcaagaatgaattgaggatattctttgtttttatctgttctggaagagattgtatatgattggaatgtatttcttgacaatttgacagcttcacatgtaaaaccacctgagcttggtgtttctttgtgggaaatacttaaaccattgttttcatttttgtattaattatgagagtattcaggctttttaaaatgtgttttcgagtccattttgactgtcagttttttgaaaattttcaagcttattggaaaaaagctcttgctagaactctttaatatttgctctggatgtagtttagtttagtttagtttttgtttgtttgtttgttttttgtttgtttgttttaaccaatattacttacttaggcatttttctttttttaaatatatttttccagaaatttgtctgtctgtctaaaccactggcttttggctttgttgttctctttttaatctttgtttttcttttcattgatatctccagttttatttaaattttcttccttctctactatttttctttttaaatttattaagttggacacctaagttactagtttttatttagccttttaagaatctaatggaaacttgttttatgactataaattatcatgttttaaaagttagcattcattcattcaccagccatctggcacctgccatgtgctaggcactgttctcggcattcagtcagaaacgaatgacaaggttaacaactgtctttttggcagctgttgagatgttcctatattaatagacttcctaatgttgaacagttcttacacacctcaaataacctttgcctggccatcatctattatttacccaatataaaactatatttaatttgctgacatttaaaaatagaacttcatctctatattaaagtggaattggcctggagtttgagagagagagagagagagtttgtgtttaggttttagaatcaaggttatgtccattttataaaattaatttgggaccctgcgttttttcctgggccctagaacagtttaagtctgatgggtgatctgggttaagggaactttgaggctgggcactttcttcgcagtttgatctgaagccgggacccccccccaggccccaggctgctgggtcagaagcctcttaccatcacttgcaaacccaataccatgaggcactcaagtggttttgcggtcagtctttgctgaccagtaccaggttgcttctgctcttgccttcaggggaggtgggtcaggagtagaaaggccccagagggagggtccagtccttctttggtgccctctgtgggactcagcgttcggtccccacctcaggcagcctggcgctgatgctgatgcagccgccctgtgtcaggtgctcagcggaaccccagacttgttctccttgtttcctgtcgactcactctttggtcgtctgtgtgtcactgggggcctgttttcttgcagtccaaggttacctggaggctgctggtctctcgggccggacaacccccaccccatttaagtccctgcccacgagtctcctcttcagagaggcctttcctgtccacctagctgtgtggggcctcagccgcacactcaccatctctgacccgggctctgctatcctcacagcattggtcactgactgagaccatgcgactgactgagaccatgcagctggctgtcaggatgctggtggagggaagagtgaggagtgccagcttcagcagaactccttattctgtctgccttggcagccacagacacctgctcgtgtgaaggcggcagcgtggtgccatcacttgggtatttggaacttgaccatcctgtatgtgaattttcctttgctcatccagtccttagactcacttcttctattcataattaattctgtgacacgtgttttctgccgaggacctctgacctcatggccacttcctgctgcaggtttagacggtggtttcctcccccgctcacatgccagccattcagttcagtgggtctcttgttgcccagtaactaccttttatagctggtatttttggagtgattaaatatgttaagaatttagaaggcaaaatgtgtaataataacactggagccagaatgataaggaaatactgtagcaataggctcaatagaaaatgattaatattttagtaagacatttaaaatagcaaatccaattagttagtacagaggtggaaataaaaaacaaaataattgaataatcacctcactggccatttccagcattgatggagaaagacaattttaaagtccattttaaaacttagattcttttgctgctgctgcctatgagatggaaagggattctaaaatgtagagaaagtgaactttacaaccttatgtcctttgaaatttgcttagaggttcatctgctcagagacgtctacgtattagaaccattcagagagtgtttctgaaatgctggtgcccaggcccctcccctctcaattaggatcagtctctgggcaggtgctggcgctgggtgtaaaattgctccccaggtgacttcgtatgcagctggatccctacggtgccttccagcttctcagagggcctctctgagccctgcaggagccacgtggagaagctgcttacctgggccctttggttcctgtgcacaacgactgatcctgttaaacccagaaaatatggtgtcttcatgcccaggaagggaaggtcctctcccccgggtccctgagtggtgggggtgtcctcttggatttggctaatttgaacaggaagctctgcagttgaggcagatcttgcagtatccccctaaccgataggaaacatgcactgctgcccgacccagtggcccagcccggccactcacagcatcttcttctcgagcatgtggatggacttggaggcttgtttccaggctgttgtggaagaagcagatcctgctcttcctgagctcagcctcaccctgagcagcctcagttacctgtgattcacccccggccccaaggtgagatgaccccaacaatattttaaaggaaatgcctgcatcacacctttttgtctttgaactcctgaaaaatcaaaataacagaaacactgttgtaaagtgattagaagaatgcaagaaaatgaggtaaaagcatgttagcaaccttcattttcatgaaggtgtgtgagtcaatgtttaaatgtgagtgctgtagccataaaacaaagatggagagcaaggatccttcctgggaatatcttccatagagacttaagttcttttgagtgcttgaaaccagtttttccagatctctattgagtctgactcatttgttttggtttcctgaggatactctcaaaaggcttcatctgtcctatttacagaatagcaactatttttcttgccacaatgacgggatttgggtaggatgcttgggtttttttttttttaattatttatttatttatttttttttttttcagaattctgtttccatggaactcctgggtcagctagggtagcttgaacccaagtttatcttccccctctcagaat

SEQ ID NO: 2485 - DNA, 17266 bp, Homo sapiens
aaatttttttttgtagagacagggtctcactatgttgcccaagctggtcttgaacttttgggttcaagcagtcttcccaccatggccttccaaagtgctaggattacaggtgtgggccactgcacctagccttggacgtgattttattactcatctgccctccaaattgactggaagatcctgacggcaagactgctgtctaacctacttctcttcctagcacccagtgttaagtgaatgaacaagatcatatctctcatctgtgaatgtacgagagccatggattatgagattagttgattttcttaactataatttttagaaacaagctgtgtttttaagcaggtatttatttccttaaatgtacatttctgattacaaaatacttttttttgagacagagtcttgctctgtcacccaggctggagtgtagtggcacaatctcggctcattacaacctctgcctcctgggttcaagcgattctcctgcctcagccttcccagtagctgggattacaggtatgcaccaccacgcccggctaattttttttttctcccgtgacggagtcttgttctgttggccaggctgaagtgcagtggtgtgatctcagctcactgcaacctccacctcccgggttcaagtgattctcctgtctcagcctcccaagtagctgggattacaggcccacgccaccacgcctggctaatttttctatttttagtagagatggggtttcaccatgttggccaggctggtctcaaactcctgacctcatgatccaccaccttggcctcccaaagtgctgccgtgggctgcactttggcattgccttggtcacgtgctgctacctgggattacaggcataagccactgcgcctggcctaatttttgtattttttagtagagacagggtttcaccatgttggccaggctggtcttgaactcccagcctcatgattcgcccaccttggcctcccaaagtgctgggattacaggcgtgagccaccacgcctggccaggaaatacatttacatggctcaaattcaaaactataaaagtcggccaaacatggtgactcacatctgtaatcctaacactttgggaggctgaggcaggaggattgcttgagctcaggtgagaccagcctaggcaatgtagggagacccccatctctacaaagaataaaaaaaaattagtcaggcatcatagtgcacacctgtagtcccagctacttgggaggctgaggtggaagaatcacctgaaccctgaggtcgaggctgcaagtgaactgtaatagtaagagtctcctcctaatcttgtgcatcctttcagagagagagatgatagatattcaaacaaatacatacatatatataacatatttatatatattctttttaacataaaagtatagccaggtgtggtggttcactactagagtcccagctacttaggaagctgaggtgggaggttcacttgaggccacgagtttgagaccagcgtgggcaacatctcttggggaaaaaaaaaaaaaaacccaccataaaagcattctataacacgtaattctgtgtttgtctttcttctcttaatacatcttggagatcagtacgcatcagtatatagagagcttccttgtcctttttcagggctgtgtagtattctgctgtatggctataccatgatgttttcactagctttctactgcctgacatttgggatatttcctgcttttgctattggacacaaggctctgatgaacagcctttactatatttaatttttttgtgagaagtttaactggaagataaattcccagaagtggggcacccagttaaggatatgtgactttgtcattttaacacacactgccagatcaccccctataaatgttgtgccacgtatcctcccaccagcaggggaaaggaggggccaccaagcagtctcactttagtgcttttctctcctttttaccagatgcgagccacccctctggctgctcctgcgggttccctgtccaggaagaagcggttggagttggatgacaacttagataccgagcgtcccgtccagaaacgagctcgaagtgggccccagcccagactgcccccctgcctgttgcccctgagcccacctactgctccagatcgtgcaactgctgtggccactgcctcccgtcttgggccctatgtcctcctggagcccgaggagggcgggcgggcctaccaggccctgcactgccctacaggcactgagtatacctgcaaggtacgtgcccatgggcggctgtcccccagcaccacaggaggcctgggaaggaggcctccaaaggattgccagggtgcagaggggtccttatgttcattcattcttgtgtttgtttagtggggaagcatccagggagcccctgctggactgatactagagaggtaaaccagaggtcgtcccagtcctgggggagttcacagcttaggccctacagtgtgataaatgctgcaggggtagaacttagggatcatgggcgcagaaaaggccgagcagaagttagccaggtagaagtgggagatgggagttgcaggcagggggaacagctgttcaaaggcctagaaaagtgaggggatagcactttagagaatgaaaaggacttctctgtggccagagtggagaggatgtgcagaaaggggcaggagatgaaggttggcagcagctggtcatgaaggtgttaacaaggggcctccactgggctgtgcggagctactgaagatgtttgcacaagagaagggtagggcatggtagacatcaaaactcctgggacctcggaggtgatcgagcctaacctggggccattttacagataggaagactgagatgaagacaggagaagggccatgcgtgaagtcacatagcactgggcctggctcctggggtaaactaaggggtagaaaagtctgaggattcctggcagaaaccaggaaatggacagggtcaaggcccctgagggtcagcccatgcaggacactgacaagtgacagtccaagaagacagagatgagaataaaaagtgtaacaataggtattcactgtgcaccaggtactatgatgattgcttagtgtgcacaatctcttttaatcttgacacaaccaatgaggtggtttctatcattgtgccccttttatagatagaggacactgagactcagaaagccatggttacttgccacatgacagagccaggtggtatcagagctgggattgggcccaggaggctgagcccagagagtcctgtgcccgtgctaggataagcgtttcacacaatcagggcaggctgccctggcaggcaagcataaggaagataagggggacctggaaacccaagggagagtagcgggggcctgggtcccttgggaatgcacagagaagcagaaggacttaagcctcctcctggggcagcagcagagctttgctctgttgacggagatgcagtgaacagcggggcagatccagacagggtccagcccctagcttcacctggcctcttgtgcacagatctccagcgcccttaccaggtgccctaaggagcccagaactctgggtccccttcctgcagcatcacaggctcttttccactcccgctggggaggtgagtccatgataagaggaataacccaagcaggctcaggagagaagcgccatgcgttcacagggccctgattctcaagaaacatttgggaaaatccactggaacatactcacccctatgccaatgtgcaccatgggtgctgaatggtcatttccacacttcctcagcttttctggtcagtgtgtagaaagatcaaaatcttgtctttgtaaatgatcaacttattcattaattcaacacaacttcattgagcacccgtatttgccatgtaccatgctgtggttaaaaaacaaagttctgttctcatcaagctgacgttctagtgggagatacagacactaaacaagcgaataagtaaaatacgtgtcaggtggccgggcgcggtggctcacacctgtaatcccagcactttgggaggccgaggtaggcagatcacctgaagtcaggagttcgagactatcctggccaacatggtgaaaccttgtttctattaaaaatacaaaaaattagccgggcatggtggcaggggcctgtaatcccagctactcgagaggctgaggcaggagaatctcttgaacctgggaggtggaggttgcagtgagccgagatcacaccactgcactccagcctgggcaacaagagcaaaactccgtctcaaaaaaacaaaaaacaaacaggaaaacccttattccagcatctttcttggttcctttgcaatgcttatcagcatttgtcaatatttggtttctgggcatgtttgcatggcctcccagtgggcaccggagagcagagcccatggctgtcagtctagctggacatgtggctggcccgtgcaggcccagggccagcatactgaatgaatgaaagcgtgggtgggcaaagaggacgggagctgtgacggtgatgagcatcaggtgccttctgcatcatccgcccttccggattcctcctgctttgtgggttatttttctgtttgggtgacctgttacttttcagttatccgatgtttgaggccatatagcgtagcagttaagagcacagacaaaaggccgggtgcagtggctcacacctgtaatcccagccctttggaaggctgaggcgggaggatcacctgaggtcaggagttcgagaccagcttagccaacatgatgaaaccccatctctactaaaaatacaaaaattagctaggtgcggtggcacatgcctgtaatcccagctacactgggggctgaagcgggagaatcacttgaatccaggaggcggagtttgcagtgagctgagattgcgccagtgtgctccagcctgggtgacagagcgagactccgtctcaaaaaaaaaaaaaaaaaaaaaaagcacagacagtggagtgcatacgtgcaaatctcagccgtgctgtttgctggctgtgtggcctctcagcttcgttaaccgtaaaatggagcaagtcatcctaccttataggaccatggtcagggctgagtgactcggtcagtgaagcgcttggtgcgatgcctagcacatggtagtgtctaataggtcagctgtgactgtttgcaatgccagcctcagctcccgggagtccccagctgtgctaacaccatgctctgcccacaggtgtaccccgtccaggaagccctggccgtgctggagccctatgcgcggctgcccccgcacaagcatgtggctcggcccactgaggtcctggctggtacccagctcctctacgcctttttcactcggacccatggggacatgcacagcctggtgcgaagccgccaccgtatccctgagcctgaggctgccgtgctcttccgccagatggccaccgccctggcgcactgtcaccagcacggtctggtcctgcgtgatctcaagctgtgtcgctttgtcttcgctgaccgtgagaggtgagtgtggtctcagagaccccagccacagacacacccagggggtgggccatgatggagagaaaccgaggcccaggaaggcaaggtaacttaggcaagaagtgggagaaactgaagtaaccagcagcccctgtttagttccctgagaagagttgactcaggccaggtgcagtggctcacgcctttaatcccagcactttgggaggccgaggtgggtgaatcacttgaagtcaggagttcgagaccagcctggccaacatggtgaaactccgtctctactaaaaatacaaaaattagcctagtgtggtggcgcacacctgtaatcccagctactctgaaggctgaggcaggagaactgcttgaacctgggaggcggaagttgcagtgagccaagatcacgccactgcactccagcctcggcaacagagtgagattccatctcaaaaaaaaaaaaaagagttgactcagtcctcttgggagccccttgggattctgggatggagcactgagatgtgaaagtcatagtagccgacagtgacgaaagcatcgccacattatctaacgtggtcttccatccttacaaacacgaggcaggtactgttattatccccatatgatcaaggaaactgaggcccagagagctcaagtaacttgcccaagatcccatagcagaataaatggtagagctgggatttgaacctagatctgactccagagcctgggtcttaattcaatctgagcttgagaggcaggggcctggctgggcttaccaactgactttgggtgacctagtgtctctgagcctcagtttctccgttggtaaggaaaagggctggattgttagggtgttttcaggattccaagaccacagccaaaatagggtctgaggttccccacacgggaacgttttctgtgaaactgagaattagcactttttggttaaaagaatcttccttctctaggttgggatgctaagaatttttttttttttaattgagacagagtctcactctgtcacccaggctggaatgcaatggcgcgatcttggctcactgcaacctctgctgcctgggttcaagtgatacgcctgcctcagcctcccgaatagctgggactacaggcatgcgccaccatgcctggctcattttttctatgtttagtagaaacggggttttgccatgttggccaggctggtcttgaactcttgaccttaggtgatccgcctgcctcggcctcccaaagtgctgggattacaggtgtgaggtactgcacccagcctagacgctaagaaaaatttttaaaagataattctggggagaagggcagagagactcgcctcctgttccctctccagattcctgggggcagtcaagatgtgtcagggagtgcactaagctgccagttacacaggagttttctgtggagaaaggagtgtgaccccatggcattttaaaaaactttttatcttgaaataattttagacttttagaaaacctacaaaaatagttcaaagagtttctgcatatcctttaaccagtgctctccaatgttaacacctgacgtagctatggtacaattacccaaactattaactaagccacagattgattcccacttcccgagtttcccactaacaccccttgctgtgcaggatccagtgaggatcccaatttagtcatcagtggtttccttggtctcttccaatctgagacagttcctcagtctttccctgtctttgaagacccatgaccttgacacttttttttttttgagacagggtctcactctgtcacccaggctggagtgcagtggtgtgatcacagctcactgcagcctcaacctcccgggctcaagtgatcctcccacctcagcctcctgagtagttggttctacaggtgtgtgccaccccacctggctaattgagatggggtcttgctatgttgcccaggctggtctcagactcctgagctcaagcaatctgcctgcctcagcctcccaaaatcctgggattataggcgtgagccactgctcctggccataaccttgagacttttgaagagtactgatcagttactttgtatgtccctcaatttggatttgattgatgttttctcacagttagattgcagttatgtatttttggcaagaacaacacagaatcgataggcccctctccacatcatatcaagagatacttgagctgatagtcattcctatgtcgtgaccttgatcacttggttagggcaggacctaccaggtttctctactgtaaggtcctaatttaccctttgtaattgacaaataccttgggggaggtaagctaggcatataaatatcctgtttttcctcaactttcacccactaattttagcagccatccatcttgcctatagcagttattattgtggtgcttgcctaagtctaattttctttttcttttttttctttctttcttttttttttttttttgagacagagtctcgctctgttgcccaggttggagtgcagtggcacgatctcggctcactgcaacctccacctcccgggttcaagtgattctcgtgcctcagcctcttgagcagctgggattacaggcacacaccaccacacttggctaatttttgtatttttagtagagatggggttttgccatgttggccaggctggtctcgaaatccgcctgccttggcctcccaaagtgctgggattataggcatgggccgctgcgcccagcccccaaggctgattttctgttaatatttccttctacattttatattagaacaagcatgccttttttaaagaagtaacatttataatgatgtttaagctagtacataacttcaaacacattttaggcttagggtagatacaactaccccggacctcctggaggagacagcgtgcttcctgctcttttcaagaagtcacttgatggcccacacctgttatcccagtgcttcgggaagccaaagtaggaggactgcttgagcccaggagttcgaggccagcctaggcaacacagaaaaccccatctgtacaaaaaatttataaaaattagccaggtgtggtgatgcacacctgtgatcccagctacttgggaggctgaggcaggaggattgcttgagcccagaagtttgaggctgcagtgaactaggattgcaccactgcactccagcctgggtggcagagtgagaccctatctctaaagaaaaaaaagaaaaaaaaaaagaaaaatcacatgagagtcattggtagaagagggaccgtgagttagatagacctgtgtttaaatcctgggttctgcttcttacctgctttttggccctgagcaaatgacttcacctgcctgagcctttgtttcttcatctgtaaaatgggctaataatgctgacaccccttgtcccccaatactgtgattcataggattggtcagtatttgtgaaatgccactggacacccaggaagtaatgccataaagaagaaactaatagcagtggtaatagaatgattactattaaagtcatctttgagtgctcagtggaagttgtttaaagtagaaattgcaaatggcaggacacactttttttttttttttgagacagggtctcactctgtcacccaggccggagtgcagtggcgcgatctcagctcactgcaaccgccacctcctgggctcaagtcatatccttctgcctcagcctcccaagtagctgggactacaggtgcgaatcaccatgcctgctaattttcgtattttttgtagagataggtttttaccgtgttgcccaggctggtcttgaactcctgaactcaagtgatccccctacctcggcctcccaaagtgctaggattaccggcatgagccaccgcgcccagccttacacacttttttttttgccctgcttacctgtttgtgttttttatataaactggttgccaatattttttaaatggggaccttttcattaaaatacaattcctggcttctcttggggaaaacaatgggaatgtggggccatcttgggaactgcgagggtgggtcacagcactggctctgagtatctgccagccagcgttcccatcccaggcccatgctctacagctgtaaaatggtgtcttccttgcaggctgtagcctagatagaatgaggtgagccaggtaatgagctgggtcaagggccaggaacacagcaggcacttggtaaaccctagaatgcgttgtgtaccctttttaggtagcgcttgtgctgagatgtcaggcacacttcctgtttctctcatcttattacctgcctggaccctaagtttgtagctggtttaagagaggcttaaccctctcagccccatcagccccctccccaagggactctgttgaaaaatgtattcctttcagaattttagtttaaatttaattgctctgtggccttaaatgacttaacctctctgagcctgggcttgggtatctgtaaaacaggatcagacatcacaggactggcttgtgtctgtcaaaggccagcaggcacttggaaagtgggtgccacaagggtgatagcatggggtggtggcatgggggttctgggtaggacctgacccttctgtttctccccatgtcccaggaagaagctggtgctggagaacctggaggactcctgcgtgctgactgggccagatgattccctgtgggacaagcacgcgtgcccagcctacgtgggacctgagatactcagctcacgggcctcatactcgggcaaggcagccgatgtctggagcctgggcgtggcgctcttcaccatgctggccggccactaccccttccaggactcggagcctgtcctgctcttcggcaagatccgccgcggggcctacgccttgcctgcaggcctctcggcccctgcccgctgtctggttcgctgcctccttcgtcgggagccagctgaacggctcacagccacaggcatcctcctgcacccctggctgcgacaggacccgatgcccttagccccaacccgatcccatctctgggaggctgcccaggtggtccctgatggactggggctggacgaagccagggaagaggagggagacagagaagtggttctgtatggctaggaccaccctactacacgctcagctgccaacagtggattgagtttgggggtagctccaagccttctcctgcctctgaactgagccaaaccttcagtgccttccagaagggagaaaggcagaagcctgtgtggagtgtgctgtgtacacatctgctttgttccacacacatgcagttcctgcttgggtgcttatcaggtgccaagccctgttctcggtgctgggagtacagcagtgagcaaaggagacaatattccctgctcacagagatgacaaactggcatccttgagctgacaacacttttccatgaccataggtcactgtctacactgggtacactttgtaccagtgtcggcctccactgatgctggtgctcaggcacctctgtccaaggacaatccctttcacaaacaaaccagctgcctttgtatcttgtaccttttcagagaaagggaggtatccctgtgccaaaggctccaggcctctcccctgcaactcaggacccaagcccagctcactctgggaactgtgttcccagcatctctgtcctcttgattaagagattctccttccaggcctaagcctgggatttgggccagagataagaatccaaactatgaggctagttcttgtctaactcaagactgttctggaatgagggtccaggcctgtcaaccatggggcttctgacctgagcaccaaggttgagggacaggattaggcagggtctgtcctgtggccacctggaaagtcccaggtgggactcttctggggacacttggggtccacaatcccaggtccatactctaggttttggataccatgagtatgtatgtttacctgtgcctaataaaggagaattatgaaataattttatttttctctgcaatttcttccatcctttccaacgatctcttaccagtttttcctgccttcaaaactggcccccatggtgaaaggccgtagagttgtgtcttaacctgggctgagtggtttgtgagaacagattacctggagcccagtgggtcttcctgcactccttctgtttcttctggcagcagcagtgtctctattagggtactttctgagtcaaaatggcttcaacaagatggaaatatgtttcacacaaaacaagaagtcagcagatagggtgggcttcagtgctggtccattcaactcccaaagctgcgcacagggaccccggctctccaggctccttctgtctcttggctgtattgtctcgagactgctggcccaatggctacagcaggtgtcacattaaagaggtccatgaccagaggaagaagccaggggtcattgtagtacctgagaactcagaactctggagtcaggctgcctggaattaaatcctggctccagcactcaatagctgtttgacccttggcaagtttcttaaccactctatgcctcagattcttcatctgtgaaatgggggacaatgatagtacctaacttatgagaactaaatgacttattttgtataaagcaattagaacaagcagcgcctggcataataagcccacaataaaagttactcccggctgggcacggtggctcacgcctgtaatcccagcactttgggaggccgaggtgggcagatcacaaggtcaggagttcaagaccaacctgaccaacatggtgaaaccccgtctctactaaaaatacaaaaatttttagtagagacggggcgtggtggtgcgtgcctgtagtcccagctactcgggaggctgaggcaggagaattgcttgaacccgggaggtggacgttgcagtgagccaagatcccgccactgcactcagcctgggcaagagagcgagactccgtctcgaaaaaaaaaaaaatggtgctcccacatttctttcttgggatggaggaagctttcccagaagcgctcctgaccgactttcccacacatctcactggtcagaactgcatcacttgccgtttctgaccaatcaccagcttacattcatggggcacgtgcttacactaaccatggcactcctcgagctaagtggagctcatgcgtcatatggaggggtagtgactcctgagcaaaaccaggttcaaagagggaggggatcgtagggaaaagaatgtgcggaagtgcggaggcccagccaacagcctgctaactgcagatactcgagagcggccaccctagatcatctgacccaggctggcccacgctagaattgcccagtgacccgcaaggtcatgagctaattgagctaaataaaatcattgtgtttttttgtttgtttgttttgtttttgttgttttgttttttgagacagagtctcactctgtcacccaggctggagtgcagtggtgcgatcttggctcactgcaacctctgcctcccgggttttcaaacgattcttctgcttctgcctcagcctcccgagtagctgggattacaggcacgcgccactacacccggctaatttttatatttttagtagagacgggggtttcgccatgttggccaggctggtctccaactcctgacctcaggtgataggcccacctcggccacccaaagtgctggtattacaggcgtgagccgccgcacccggccaatcattgtggttttaagtcactaagtttgaggctattttgttttacagcaaaagctaactgatgcagacagggacaagtcagtctcatctctgtgcacccagcattgcccagaacagggcctagttgtgtctagggtctcatggggcagcccctgacctctatcttgcccctcccagcttccaacagaccctgtcccagctccctccaagctgagtgttggcctgatacctaccagtggagcgaggggaacacgaggactgccaagggcaggtaccgtgccaacccttcactccattccacaaagagactcatttactcctcatgacaatccagtgaggcagatgttcctgtcactttacagataagacaaatgagctttagagagagcagaagactcatccaagacctcacaacagagaaaaagactcctctggtttttgccttggagcaggaacttttgacaaggctgcgcagatgcagccacatgaaaaccgcccattaaaaatgtaatatcggcccggagcgggggctcacgcctgtaatcccagcactttgggaggccgaggcaggcagatcacttgaggtcaggagttgaagaccagcctggccaacatggtgaaaccccgtctctactaaaaatacaaaaaatagccaggcgtggtggcatgggcctgtaatcccagctactcgggaggctgaggcaggagaatcacttgaacccaggaggcagagattgcagtgagtcaagattgcaccactgcactccagcctgagcgacagagcaagactctgtctcaaaataataataaaatgtaatattcactcttatcaaataatggatgtcaccacaccccgaccctaattagtgaggactttcatgttctacttgtcttcatttaatcatcattgtataagagttttacaatatcaaattagtagatgtatattactgaaagggaaggactgttagaaatttacttgaggaatgtctgccactgggggctgaacacaaaagatcctattgtgacctgccagattattcattcacttagcaattcaacaaccatcgctgaatgcctactataggccaggtgccatgcaagacagatgtgctcccaccctcaagggttcacagtctaatagaggagagagatgttaaacagataactgtacagatggcatagctaattatattcgtggaagttcgttgtggcaaagacaggcatctcaatatttcaggagctcccctatattttctagcctcccttacagtcacatgactagttctgaccagtggggtgtgtgtaggagtggcaggctgaagcaatggagagctggtgagcctcatccctctcttcccctgccacagccaccttgcgcccacaagttcccttagctacaagctggaggagagccaccagatccaccttagatttcactgagcaagaaataaagcttcttgtgttaagtctttcagatttggagtttgtctggtagatagtgttaattaccatgactaaggaaaatttgccattagtgaagggaggaaaaatattctccaccagtaacaaggccatgtcagtctgctgcattataaaccccaaacagtagtttatgatcctctgggctggcaatttgggctgaattcagctgggtcactcctgcagctgcaggcagcaagcagctcgaatgtctaccttgccaggaaggctcttctctgctccacatggcctcgtcctccaataggcatagcctactccttcctatggtggtctcagggtttcagaaagcaacaagagaggacaaattccagtgttcaagctgcactagtgtcaaagcatatcaaatagcatgtcaaattccacatcaaattcaggatgcaggcaaattgattctttctcttgatgggaagagctgaaaataatgtgtggtcttgtttttcaatgtacagtggtcccatttatccaggggggatacattccaagacccccagtggatgcctgaaaccacagatagtacagaattctgtatataccatgttttttactatacatacatacctacgataaggtttaatttgtaaattaaactcttacaaattaagagttaacaacagctgggcacagtggctcacgcctgtaatcccagcactttgggaggccgaggtgggcggatcacgaggtcaagagatcgagaccatcatgaccaacatggtgaaactccgtctctactaaaaatacaaaaattatctgggtgtagtggcgcatgcctgtaatcccagctacttgggaggctgaggcaggagaatcatttgaacccgggaggcggaggttgcagtgagctgagatcgcgccactgcactccagcctggtgacagagcgagactccacctcaaaaaaaaaaaaaaaacaaaaaaaacaaacagttaacaataaatagaacagttataacagtatgttgtaataaaagttatgcgaatgtggtctctccctcaaaatgtcctattgtactgtactcacccttcttgtgatgatgggagataataaaatgcctacatgatgagatgaaggtaaatgaatgacatgggcattgtgatctagcgttagactactactcacctgatgatacgtcagaaggagaatcatctcctttgggtgatccaggatcatgaagccgtgacaatgtccatgattggatgtcaggagcagatgatgttaatgattaaccgtgggtaatgtctacaatatggatacagtgcaaaagggatgattcacatcctacgtggaatagtgcaggattgcatgagatttcatcatgtggttggctgcaggtaactgacattgcagaaagcaaaaccacagatcatgggggtgggggtggggaactactgtacaacatgagatatatttgatcaaataagatgaggtgcacctaaaactttccctacaggttgtatgcccctgagtaaattgcttggtgtctctggatctccagctgttccccttctctctgcatggctaagccctgtccgtcacttggggctggacctagagccctgcctggccactaagccctcagaacagggtttcttttttaaaaaagacagggtcgggaggtggaggttgcaatgagccaaggtcgcaccattgcactccagcctgggtgacaagagtgaaactccatctcaaaaaaaaaaaaaaaaaaaaaaaaaaaaaaaaaaaaagacagggtctcactctgtcacccaggctggagtacagtggtgtgatcatggctcgctgcagccttgaacacctgggctcaagctgtcccccaacctcagcttcctgagtagctgggagtgccaccacgcctagctagttttttaaaaaattgttttgtagagacaggggcctcactattttgcccaggctggtcttgaatgcctggcctcaaatgatcctcctgccttggcctcccaaagcactggggttacaggtatgaccactacccacaaccagaacatttctcaaatgtgattggttgatctcctgcatccatccctggggtgcttgtttaaaatgcagagccctggatcctcccccaacctagagagtcagaacatctgggcttctgcatcttaacaagctccctgggtgatgctgctgggcctccaagttggagaacctctgtatttgaagaaatccggactccttggggactcaaatcttatttcagctcttctctggactagtttgactttagccttggtgtaaaatgggtatacattttacacgcctgtgacgccaggatgcgctcacaggggagggagggctttatcagaggtcagaatctaagccaccactacagttgtactagatccaaggagaaagactcccaggcctcatttcctcatcgttctctcttctcttacctggctttatggttcttcatagcactgagcaccaccaggcagtgtattttatgttttttttgagctttataatgccagggactatgttttgtt

SEQ ID NO: 2486 - DNA, 11456 bp, Homo sapiens
aaatttttttttgtagagacagggtctcactatgttgcccaagctggtcttgaacttttgggttcaagcagtcttcccaccatggccttccaaagtgctaggattacaggtgtgggccactgcacctagccttggacgtgattttattactcatctgccctccaaattgactggaagatcctgacggcaagactgctgtctaacctacttctcttcctagcacccagtgttaagtgaatgaacaagatcatatctctcatctgtgaatgtacgagagccatggattatgagattagttgattttcttaactataatttttagaaacaagctgtgtttttaagcaggtatttatttccttaaatgtacatttctgattacaaaatacttttttttgagacagagtcttgctctgtcacccaggctggagtgtagtggcacaatctcggctcattacaacctctgcctcctgggttcaagcgattctcctgcctcagccttcccagtagctgggattacaggtatgcaccaccacgcccggctaattttttttttctcccgtgacggagtcttgttctgttggccaggctgaagtgcagtggtgtgatctcagctcactgcaacctccacctcccgggttcaagtgattctcctgtctcagcctcccaagtagctgggattacaggcccacgccaccacgcctggctaatttttctatttttagtagagatggggtttcaccatgttggccaggctggtctcaaactcctgacctcatgatccaccaccttggcctcccaaagtgctgccgtgggctgcactttggcattgccttggtcacgtgctgctacctgggattacaggcataagccactgcgcctggcctaatttttgtattttttagtagagacagggtttcaccatgttggccaggctggtcttgaactcccagcctcatgattcgcccaccttggcctcccaaagtgctgggattacaggcgtgagccaccacgcctggccaggaaatacatttacatggctcaaattcaaaactataaaagtcggccaaacatggtgactcacatctgtaatcctaacactttgggaggctgaggcaggaggattgcttgagctcaggtgagaccagcctaggcaatgtagggagacccccatctctacaaagaataaaaaaaaattagtcaggcatcatagtgcacacctgtagtcccagctacttgggaggctgaggtggaagaatcacctgaaccctgaggtcgaggctgcaagtgaactgtaatagtaagagtctcctcctaatcttgtgcatcctttcagagagagagatgatagatattcaaacaaatacatacatatatataacatatttatatatattctttttaacataaaagtatagccaggtgtggtggttcactactagagtcccagctacttaggaagctgaggtgggaggttcacttgaggccacgagtttgagaccagcgtgggcaacatctcttggggaaaaaaaaaaaaaaacccaccataaaagcattctataacacgtaattctgtgtttgtctttcttctcttaatacatcttggagatcagtacgcatcagtatatagagagcttccttgtcctttttcagggctgtgtagtattctgctgtatggctataccatgatgttttcactagctttctactgcctgacatttgggatatttcctgcttttgctattggacacaaggctctgatgaacagcctttactatatttaatttttttgtgagaagtttaactggaagataaattcccagaagtggggcacccagttaaggatatgtgactttgtcattttaacacacactgccagatcaccccctataaatgttgtgccacgtatcctcccaccagcaggggaaaggaggggccaccaagcagtctcactttagtgcttttctctcctttttaccagatgcgagccacccctctggctgctcctgcgggttccctgtccaggaagaagcggttggagttggatgacaacttagataccgagcgtcccgtccagaaacgagctcgaagtgggccccagcccagactgcccccctgcctgttgcccctgagcccacctactgctccagatcgtgcaactgctgtggccactgcctcccgtcttgggccctatgtcctcctggagcccgaggagggcgggcgggcctaccaggccctgcactgccctacaggcactgagtatacctgcaaggtacgtgcccatgggcggctgtcccccagcaccacaggaggcctgggaaggaggcctccaaaggattgccagggtgcagaggggtccttatgttcattcattcttgtgtttgtttagtggggaagcatccagggagcccctgctggactgatactagagaggtaaaccagaggtcgtcccagtcctgggggagttcacagcttaggccctacagtgtgataaatgctgcaggggtagaacttagggatcatgggcgcagaaaaggccgagcagaagttagccaggtagaagtgggagatgggagttgcaggcagggggaacagctgttcaaaggcctagaaaagtgaggggatagcactttagagaatgaaaaggacttctctgtggccagagtggagaggatgtgcagaaaggggcaggagatgaaggttggcagcagctggtcatgaaggtgttaacaaggggcctccactgggctgtgcggagctactgaagatgtttgcacaagagaagggtagggcatggtagacatcaaaactcctgggacctcggaggtgatcgagcctaacctggggccattttacagataggaagactgagatgaagacaggagaagggccatgcgtgaagtcacatagcactgggcctggctcctggggtaaactaaggggtagaaaagtctgaggattcctggcagaaaccaggaaatggacagggtcaaggcccctgagggtcagcccatgcaggacactgacaagtgacagtccaagaagacagagatgagaataaaaagtgtaacaataggtattcactgtgcaccaggtactatgatgattgcttagtgtgcacaatctcttttaatcttgacacaaccaatgaggtggtttctatcattgtgccccttttatagatagaggacactgagactcagaaagccatggttacttgccacatgacagagccaggtggtatcagagctgggattgggcccaggaggctgagcccagagagtcctgtgcccgtgctaggataagcgtttcacacaatcagggcaggctgccctggcaggcaagcataaggaagataagggggacctggaaacccaagggagagtagcgggggcctgggtcccttgggaatgcacagagaagcagaaggacttaagcctcctcctggggcagcagcagagctttgctctgttgacggagatgcagtgaacagcggggcagatccagacagggtccagcccctagcttcacctggcctcttgtgcacagatctccagcgcccttaccaggtgccctaaggagcccagaactctgggtccccttcctgcagcatcacaggctcttttccactcccgctggggaggtgagtccatgataagaggaataacccaagcaggctcaggagagaagcgccatgcgttcacagggccctgattctcaagaaacatttgggaaaatccactggaacatactcacccctatgccaatgtgcaccatgggtgctgaatggtcatttccacacttcctcagcttttctggtcagtgtgtagaaagatcaaaatcttgtctttgtaaatgatcaacttattcattaattcaacacaacttcattgagcacccgtatttgccatgtaccatgctgtggttaaaaaacaaagttctgttctcatcaagctgacgttctagtgggagatacagacactaaacaagcgaataagtaaaatacgtgtcaggtggccgggcgcggtggctcacacctgtaatcccagcactttgggaggccgaggtaggcagatcacctgaagtcaggagttcgagactatcctggccaacatggtgaaaccttgtttctattaaaaatacaaaaaattagccgggcatggtggcaggggcctgtaatcccagctactcgagaggctgaggcaggagaatctcttgaacctgggaggtggaggttgcagtgagccgagatcacaccactgcactccagcctgggcaacaagagcaaaactccgtctcaaaaaaacaaaaaacaaacaggaaaacccttattccagcatctttcttggttcctttgcaatgcttatcagcatttgtcaatatttggtttctgggcatgtttgcatggcctcccagtgggcaccggagagcagagcccatggctgtcagtctagctggacatgtggctggcccgtgcaggcccagggccagcatactgaatgaatgaaagcgtgggtgggcaaagaggacgggagctgtgacggtgatgagcatcaggtgccttctgcatcatccgcccttccggattcctcctgctttgtgggttatttttctgtttgggtgacctgttacttttcagttatccgatgtttgaggccatatagcgtagcagttaagagcacagacaaaaggccgggtgcagtggctcacacctgtaatcccagccctttggaaggctgaggcgggaggatcacctgaggtcaggagttcgagaccagcttagccaacatgatgaaaccccatctctactaaaaatacaaaaattagctaggtgcggtggcacatgcctgtaatcccagctacactgggggctgaagcgggagaatcacttgaatccaggaggcggagtttgcagtgagctgagattgcgccagtgtgctccagcctgggtgacagagcgagactccgtctcaaaaaaaaaaaaaaaaaaaaaaagcacagacagtggagtgcatacgtgcaaatctcagccgtgctgtttgctggctgtgtggcctctcagcttcgttaaccgtaaaatggagcaagtcatcctaccttataggaccatggtcagggctgagtgactcggtcagtgaagcgcttggtgcgatgcctagcacatggtagtgtctaataggtcagctgtgactgtttgcaatgccagcctcagctcccgggagtccccagctgtgctaacaccatgctctgcccacaggtgtaccccgtccaggaagccctggccgtgctggagccctatgcgcggctgcccccgcacaagcatgtggctcggcccactgaggtcctggctggtacccagctcctctacgcctttttcactcggacccatggggacatgcacagcctggtgcgaagccgccaccgtatccctgagcctgaggctgccgtgctcttccgccagatggccaccgccctggcgcactgtcaccagcacggtctggtcctgcgtgatctcaagctgtgtcgctttgtcttcgctgaccgtgagaggtgagtgtggtctcagagaccccagccacagacacacccagggggtgggccatgatggagagaaaccgaggcccaggaaggcaaggtaacttaggcaagaagtgggagaaactgaagtaaccagcagcccctgtttagttccctgagaagagttgactcaggccaggtgcagtggctcacgcctttaatcccagcactttgggaggccgaggtgggtgaatcacttgaagtcaggagttcgagaccagcctggccaacatggtgaaactccgtctctactaaaaatacaaaaattagcctagtgtggtggcgcacacctgtaatcccagctactctgaaggctgaggcaggagaactgcttgaacctgggaggcggaagttgcagtgagccaagatcacgccactgcactccagcctcggcaacagagtgagattccatctcaaaaaaaaaaaaaagagttgactcagtcctcttgggagccccttgggattctgggatggagcactgagatgtgaaagtcatagtagccgacagtgacgaaagcatcgccacattatctaacgtggtcttccatccttacaaacacgaggcaggtactgttattatccccatatgatcaaggaaactgaggcccagagagctcaagtaacttgcccaagatcccatagcagaataaatggtagagctgggatttgaacctagatctgactccagagcctgggtcttaattcaatctgagcttgagaggcaggggcctggctgggcttaccaactgactttgggtgacctagtgtctctgagcctcagtttctccgttggtaaggaaaagggctggattgttagggtgttttcaggattccaagaccacagccaaaatagggtctgaggttccccacacgggaacgttttctgtgaaactgagaattagcactttttggttaaaagaatcttccttctctaggttgggatgctaagaatttttttttttttaattgagacagagtctcactctgtcacccaggctggaatgcaatggcgcgatcttggctcactgcaacctctgctgcctgggttcaagtgatacgcctgcctcagcctcccgaatagctgggactacaggcatgcgccaccatgcctggctcattttttctatgtttagtagaaacggggttttgccatgttggccaggctggtcttgaactcttgaccttaggtgatccgcctgcctcggcctcccaaagtgctgggattacaggtgtgaggtactgcacccagcctagacgctaagaaaaatttttaaaagataattctggggagaagggcagagagactcgcctcctgttccctctccagattcctgggggcagtcaagatgtgtcagggagtgcactaagctgccagttacacaggagttttctgtggagaaaggagtgtgaccccatggcattttaaaaaactttttatcttgaaataattttagacttttagaaaacctacaaaaatagttcaaagagtttctgcatatcctttaaccagtgctctccaatgttaacacctgacgtagctatggtacaattacccaaactattaactaagccacagattgattcccacttcccgagtttcccactaacaccccttgctgtgcaggatccagtgaggatcccaatttagtcatcagtggtttccttggtctcttccaatctgagacagttcctcagtctttccctgtctttgaagacccatgaccttgacacttttttttttttgagacagggtctcactctgtcacccaggctggagtgcagtggtgtgatcacagctcactgcagcctcaacctcccgggctcaagtgatcctcccacctcagcctcctgagtagttggttctacaggtgtgtgccaccccacctggctaattgagatggggtcttgctatgttgcccaggctggtctcagactcctgagctcaagcaatctgcctgcctcagcctcccaaaatcctgggattataggcgtgagccactgctcctggccataaccttgagacttttgaagagtactgatcagttactttgtatgtccctcaatttggatttgattgatgttttctcacagttagattgcagttatgtatttttggcaagaacaacacagaatcgataggcccctctccacatcatatcaagagatacttgagctgatagtcattcctatgtcgtgaccttgatcacttggttagggcaggacctaccaggtttctctactgtaaggtcctaatttaccctttgtaattgacaaataccttgggggaggtaagctaggcatataaatatcctgtttttcctcaactttcacccactaattttagcagccatccatcttgcctatagcagttattattgtggtgcttgcctaagtctaattttctttttcttttttttctttctttcttttttttttttttttgagacagagtctcgctctgttgcccaggttggagtgcagtggcacgatctcggctcactgcaacctccacctcccgggttcaagtgattctcgtgcctcagcctcttgagcagctgggattacaggcacacaccaccacacttggctaatttttgtatttttagtagagatggggttttgccatgttggccaggctggtctcgaaatccgcctgccttggcctcccaaagtgctgggattataggcatgggccgctgcgcccagcccccaaggctgattttctgttaatatttccttctacattttatattagaacaagcatgccttttttaaagaagtaacatttataatgatgtttaagctagtacataacttcaaacacattttaggcttagggtagatacaactaccccggacctcctggaggagacagcgtgcttcctgctcttttcaagaagtcacttgatggcccacacctgttatcccagtgcttcgggaagccaaagtaggaggactgcttgagcccaggagttcgaggccagcctaggcaacacagaaaaccccatctgtacaaaaaatttataaaaattagccaggtgtggtgatgcacacctgtgatcccagctacttgggaggctgaggcaggaggattgcttgagcccagaagtttgaggctgcagtgaactaggattgcaccactgcactccagcctgggtggcagagtgagaccctatctctaaagaaaaaaaagaaaaaaaaaaagaaaaatcacatgagagtcattggtagaagagggaccgtgagttagatagacctgtgtttaaatcctgggttctgcttcttacctgctttttggccctgagcaaatgacttcacctgcctgagcctttgtttcttcatctgtaaaatgggctaataatgctgacaccccttgtcccccaatactgtgattcataggattggtcagtatttgtgaaatgccactggacacccaggaagtaatgccataaagaagaaactaatagcagtggtaatagaatgattactattaaagtcatctttgagtgctcagtggaagttgtttaaagtagaaattgcaaatggcaggacacactttttttttttttttgagacagggtctcactctgtcacccaggccggagtgcagtggcgcgatctcagctcactgcaaccgccacctcctgggctcaagtcatatccttctgcctcagcctcccaagtagctgggactacaggtgcgaatcaccatgcctgctaattttcgtattttttgtagagataggtttttaccgtgttgcccaggctggtcttgaactcctgaactcaagtgatccccctacctcggcctcccaaagtgctaggattaccggcatgagccaccgcgcccagccttacacacttttttttttgccctgcttacctgtttgtgttttttatataaactggttgccaatattttttaaatggggaccttttcattaaaatacaattcctggcttctcttggggaaaacaatgggaatgtggggccatcttgggaactgcgagggtgggtcacagcactggctctgagtatctgccagccagcgttcccatcccaggcccatgctctacagctgtaaaatggtgtcttccttgcaggctgtagcctagatagaatgaggtgagccaggtaatgagctgggtcaagggccaggaacacagcaggcacttggtaaaccctagaatgcgttgtgtaccctttttaggtagcgcttgtgctgagatgtcaggcacacttcctgtttctctcatcttattacctgcctggaccctaagtttgtagctggtttaagagaggcttaaccctctcagccccatcagccccctccccaagggactctgttgaaaaatgtattcctttcagaattttagtttaaatttaattgctctgtggccttaaatgacttaacctctctgagcctgggcttgggtatctgtaaaacaggatcagacatcacaggactggcttgtgtctgtcaaaggccagcaggcacttggaaagtgggtgccacaagggtgatagcatggggtggtggcatgggggttctgggtaggacctgacccttctgtttctccccatgtcccaggaagaagctggtgctggagaacctggaggactcctgcgtgctgactgggccagatgattccctgtgggacaagcacgcgtgcccagcctacgtgggacctgagatactcagctcacgggcctcatactcgggcaaggcagccgatgtctggagcctgggcgtggcgctcttcaccatgctggccggccactaccccttccaggactcggagcctgtcctgctcttcggcaagatccgccgcggggcctacgccttgcctgcaggcctctcggcccctgcccgctgtctggttcgctgcctccttcgtcgggagccagctgaacggctcacagccacaggcatcctcctgcacccctggctgcgacaggacccgatgcccttagccccaacccgatcccatctctgggaggctgcccaggtggtccctgatggactggggctggacgaagccagggaagaggagggagacagagaagtggttctgtatggctaggaccaccctactacacgctcagctgccaacagtggattgagtttgggggtagctccaagccttctcctgcctctgaactgagccaaaccttcagtgccttccagaagggagaaaggcagaagcctgtgtggagtgtgctgtgtacacatctgctttgttccacacacatgcagttcctgcttgggtgcttatcaggtgccaagccctgttctcggtgctgggagtacagcagtgagcaaaggagacaatattccctgctcacagagatgacaaactggcatccttgagctgacaacacttttccatgaccataggtcactgtctacactgggtacactttgtaccagtgtcggcctccactgatgctggtgctcaggcacctctgtccaaggacaatccctttcacaaacaaaccagctgcctttgtatcttgtaccttttcagagaaagggaggtatccctgtgccaaaggctccaggcctctcccctgcaactcaggacccaagcccagctcactctgggaactgtgttcccagcatctctgtcctcttgattaagagattctccttccaggcctaagcctgggatttgggccagagataagaatccaaactatgaggctagttcttgtctaactcaagactgttctggaatgagggtccaggcctgtcaaccatggggcttctgacctgagcaccaaggttgagggacaggattaggcagggtctgtcctgtggccacctggaaagtcccaggtgggactcttctggggacacttggggtccacaatcccaggtc

SEQ ID NO: 2487 - DNA, 4337 bp, Homo sapiens
attgtattctcactgtcattcatttaaaaataaattttgttttgatttcctttttaatcccagagttaatagtttaaaaatttcaaagtagatagatttatttctttgtttgttggattaatttctaattttgaagttttgcagtaagtgaatgtgacttgttctttggaatttgaagttctttaagctagtgcagttaatttttgtgagtgctttatgggtttttaaaggaatgtttgcatggttttgtttgttttgggaaacagtcttgctggtcttgagtgtttttttttgtttgtttgttttgggaaacagacttgctgttgtctaggctggagtgcagtggtgcgacctcggctcactgcaccctctgcctcccgggttcaagtgattctcctgccttagcctcccgagtagctggaattacaggtgcccaccactgcacctggctaattttttatatttttagtagagacggggtttcaccatcttggccaggctggtctcaaactcctgaccccgtgatccacctgcctcggcctcccaaagtgctgggattacaggcgtgagccaccgtgcccagccgggtttttttttttttgagatggagtctcgctctgtcatccaggctggagtgcagtgatgtagtgtaggctcactgcaacctccacctcctgggttcaagtgattctgctacctcaggctcccaagtagctgggattacaggcatgtgccaccatgcccggctaattttttgtatttattggagacggggcttcaccatgttagtcaggctggtctcgaactcctaacctctggtggtccacccatcttggcctcccagagtgctgggattacagatgtgagccattacatccggctgttttttttttttttccccagagttctatttgtgtttactagatccaccttattagccatgatattaaaattctctttctaccataattttgtaggtgtgtgtgcaatctacaaattcctgaggtctgtgtcattctcatactgacttgtagatgtgtcagtttctctgttagtgttttcgaagtatgtgttatgtgcataaggaacatggctattacattcatcagttgtacttttttttttttttttttttttgagatggagtctcgctctgttgcccaggctggaatgcagtgctgcgatcttggctcactgcaagctccgcctcccggcttcacaccattctcctgcctcagcctcccaagtagctgggaccacaggcacctgccaccatgcccggctaatgttttgtatttttagtagagacggggtttcaccattcacaggatggtctcgatctcctgacctcgtgatccgcctgcctcggcctcccaatgtgctgggattacaggcgtgagccactgtgcctggcccatcagttgtactttttatgcacatgagagagttttttttttgtcccttcttaatgcttttttgtttgtgttgtttggtctgctagtattgtatctgcttgctgttaacatttgcttgatacagtggagtagcattctccaggcatttattttagtcatttaaattcaagtgtataaattcagcaagtgagttaagtgaatggtgccagcgattctacccagtgtttccgtcagtaactatatgattatgagtgagtatagggatgagaatggtgactctcctttcccctgtagggaaaggaaggggcgtgattgtctggaggggcacctcttgtaatgtgagcatagctctttgccaaatgaaacactggtcttgaaacaaggtatgacctttactgtactatggctcttaaatgtaaatcagctgctctatctagtattcatctctagtgaggtgcttaagagtgcttaacatttttataatgtgtaatacttttgactaaatgccattttcatctttcaaagcattcaactcctcctcatggtgtgactccattgtgggtgatttaccatttttccttcagtttacttgtataatcttgtttgaggtatctttttacatcaacatatacttgaatttctccttttctctcctaattcctggttaagctcacagaatttcctcttcagtctagaagagaaatttgacctatttgtgattactgataagtgcagtcattcccatcatttatttatttattaaattatttttaagttttttttgagatgaagtcttgctctgtcgcctaggctggaatgcagtggtgcgatcttggctcactgcaacctctgcctcctgggttcaagcgattctcctgtctcagcctaccgagtagctggggttacaggtgtgcaccaccacacctggctaatttttctatttttagtagagatgggggtttcacgatgttggccaggctggtctcgaactcatgacctcaagtgatccacctgccttggcctcccagagtgctgggattacaggctttattatttatttatttatttatttaagaggtaggatcttgctctgctgccaggctggagtacagtggctgtatcacagctcactagcctcaaactcttgggctcaagcgatcttcctgcctcagcccctggagtagctgggactacaggtgcacgtgatcatacctaaatttttttttagagatgtggtcttgctgtgttgtccaggctggtctcccaactcctggcctcaagtgatccacccaccttggcctctcaaagtgttggaattacaggcatgagccaccacacctggctgttttgtatttactgtacttttccccatttcttgtcaatcagcttttttgaactgattgctttattttttttctaatgtgaaagtcattttttttttctcctctggagttacctctaaattttgacacatttaaactatcacttctatattcttgtgtagaattaatcagaatctatcttttcttcccttttccaacaagacagaactgctgcttgctttcatttccttctcccttctcttccctcttcaacttcctatgtcgaaatcatgtaagtattttagtttcagattgcttatttttgtaaaagtcagtacttttgtttatttcttaaagctcttggattaaaaaaaagtttcttaaagctcttggatgttttaaaattatggcattcatctaccaattatgttagagaaggtctttgaaaagtaaagttgatcccttacatatgtgaaaattgtttttgcactcccgcttgaaagcttatttggttggctggatataagtttcaaaatcattttccttataactttgaagccagtgctccgttgtcttctggcatctgtgctgctgatgaaaagtctgatactgacttttatgtgatttatgtatctttataggaattcagttttttccttatgatatcttgaaatttcaataggatgtgtctaagttgtcttccccttctctgctgaccgataaacactgttcagcccttagagtaacctgatgattggtgtcttccctttccccaaggaaatttctggaactaacataagatgttggtccttctggttctatattctctccctctctcttttttttttttttttagttagagacagagtctcagtctgttacccaggctggagtgcggtggcatggtcatagcttgctacgaccttgacctcctgggctcaagctatcctctcacttcagcctctcaagtagctgtgactacaggtgtgcgcctggctaattttttatttattttttatttttgagacggaatctcactctgtggccagactgtagtacagtgggacaatcttggctcactgcgacttccacctcccaggttcaagcgatttccagccaatttttgtatttttagtagaggtggggtttcatcatgttggcctggctggtctcgaactcctgacctcaagcgatccacccacctcggcctcctaaagtgctaggattacaagcatgagccaccgcacctggcctagttttttttttttcttttaaagtagagatggggtctggctgtgttgtcctggctgatcttggactcctggcttcaagtgatcctcccatctcggcctcccaaaatgctaggattacaggtgtgagtcactgcacccagccaggttccattttctctatattgactatattgacctttctttcatacttgaaaagcatttggggataatcttttaattttgttttctatttgttttttctgtgcccattttgctgttaaatatatctgtcaagttttattttagcaattgttttttctcttttataacagcgtctttaatgttgtaatttacatacaataaactgc

SEQ ID NO: 2488 - DNA, 70926 bp, Homo sapiens
acaatcttttatcaactgctaagacttccttcttttaaagatatgatcagagcttttgtctttcacagcaggcatcctagtttcatgttttcttgggaaatttgtatagattcacactcactacaaatgttattttcagctgttttatagatgtataatgcaccatttattcattcagtacatatttagcaagtaaaagggaacaaccaagattcattctatgccttcttttgttggaattcaagcacactaacaatgtgctctcttgttggacaagcatgaaagaaaaagataccctccttgtcaggtcttcatagttctctgtgcttacaagaatcctgcaacatttgacgatttcttctcaagctttccttcctgaaaggaaaaagggcaagaaaagaataaactttgtaacatgtaatctgtataatatattccaaaatgctttagctcagatattttggatacctttctgatcacatgctatagttagaatcaattttctttcttaaaagcttgaaagttaattaattgagctatgacttggggacaaaatgaaaacaattcccccatccaattcaacagaaagtgggatctgtaaaaatagctcttcttgaaaattttagaactagaatcatagaactttatttgcttttatattcattatcccataatatcctcttataaatggaagtttagttctgatcatttggatattagctcagggagctcaggaaagtagtatgctgccgttgattaactcttcaggatgctctaactcaacaggcaaagtttcagtaacagcataggcacccacagttttaggtactagtgatttagggccagttgtttaagagtattaactcaaattcggcagccctgctcctgagaggcttgccttctttgccaacatcctctgattcagaatatcctaatctaaagcctgaagacagtcataaggaggtgaatacgatctttacatgtactatattttatttttgtagaagttccagagatagtattttacccatatacaaattagtgtcttggtatggtaaggatttttggcaccaaaatctctaaggggatttttagaactaaggagggctaaagggaaagataatttgaataggttggcctttccacactccttgagttgtggcatgtgacatgcttttcactatctgctgaaggaagccctggtttatctcagaaacattcttgtataagtgccaaatacagtcttgtttcttgttcttgactctgccactccatgtggctgtaatatgctggagcacatttgcctaatgcctccggtatcttttccttggttaaaattgttattaattccacactatcttcctaggtctgtctctggggcccaagcagatttggtcacccaacagctagagcaaccacttgactgggtgaactctattggcaatgaggcatatgggggccaggcagtatcatccacgatagatgaaagacaatctgggtatcaggaccccagttaagcccaggcctcacacacaaacgatcctcccttgaggagctcaatagttgcccctcaaatagtttcccataggattagacttcagctttgacctgtcactattgtagacatgctacctgtgcttacttacttacattaatgtagcaacaccagtgaacacaagaatcaattatacatgtgcatttcataacacccctccaggagccattcttcctcttccttcccagctcccattctaatcatttattcattttttaaaattatgggagatcatctaatattctctctctctctcaccttcatatttactttctttatttgttttagtgggtttttttgttgttgttgttgttttaacaagagctttgaaaggcaacacccaggcagtatgctttatagatttatcaaaacaaaacttgttgaactgggtgctcttgaccaccctgctctctgattctcaacatgagatttcacctgcacattctgataccttgctgagctttcacttttcattaatgacctaattgtatagttttctctgtgttggcatgcttgttctcttccctttccctttctccttccttcctcctttccttctttcctttctttctttcttgcttccttccttccctccttccttctctttctgcctttctctctccctttctttctttcttctttttctttctttcttttctctctcttttttttttaaagcaacctcactcaactcccagttgctcacccatttggctacatgtatcctcggctgcagtaagatactttcttgcttcccaatcctttgggatctgtacagatagggagagtctcagacatgagttattttagattgtctgagaagatctaattaagggtcaaagtagtagatgttgtgggagggcatttgtcactggatgagatgactgtcaccatatgctctcgaaggagaaaacaaaggctatagacagagatgaacatgattttatagatttatttttaaaatcttcctgtgaatctaagcaacagagcagaagcagtgaaattgaagggaagggggaaatttccattccttaaaaaagaagaatcatttcaaattctaactagatttgggaaagtaaaatatttgaaaaaattaagggctttaagatgtgtgataaagagaatgctgaaattaatgatacagcaaagttggaatgtctgcctctcctttgtttaatgtttttcttttattaaaaaagatacttatatgtttttttaatttagaaaatatcagaaagtaaatccaatattctactatacagagatgatagttactgtcaacattttgatacctgatcttttaactatattgaaaaatactcgtcttacaaaattggaatcatacattatctgcagtttgtttctttccccctgcttttgcttacctaaagtttacatctcatgactcttgaaaataccatttttaaccaatatctaatatatcataagaattgatatactctattttcagttttcctggcagttataaacaattttgtacaaaaatggtgcacacattacacatacccctatctcactaatgaatttcttacaaaagggccctcaaagtatcactgagaatcgtgccccatcttagagcctttcactggtacgtccctctccacaagtgcttttctcccatatattacgttagactcccatattacactcagattattgctgaaatgttaccacaccagaaagacatttccctgaacccgtatgtaaaatgtcgtatctgctgcctccgaagttatttgtcttatcctgcgttatttttgtcttaacgttcagtagtacttaatatgtaatgtttatttgtctacttgttatctctacctcatagaatcgaagataaacgaggcagaaattttgttttgttaaatgctttattcctagcatctgaaacagtgcctgagacatagtacgtgatcaataaatacttatttgttcaacaaataaatacataaaaacaaaaagtacaaaacttttggtacatataaataagttgccttccagaaagcctgttttaatttgtatactcatatgtaatgtatgacgatactcattttacaacagaataacccactttgaatattagtttttaaatgataaaaaaataaaaatgtacactatatatcaatgttgcttcaggtttttttgttttgttttgttttttgttttttttttgagatgcagtcttgcactgtcgcctgggctggagtgcagtggggcgatctcggctcactgctacctctgcctctcgggtttaagcagttctcctgcccacagcctctcgagtagctgggattacaggtgcctgccaccacgcccagctaatttttttgtatttttagtagagacgggtttcactatgttggccaggctggtctcgatctcctgaccttgtgatctgcccgcctcggcctcccaaagtgctgggattacaggcatgagccaccgctcatctcttcctcttctttatccattctttttaaattaaagtgtttgctcctttttttcctttaaaataatgtgcaagagctgttatgcattaataatgttgaagttattcacatttttatagacatgtttctctctttcataatatcatttttaagtgatatcgtaatatcatttttattttagattcggggagtacacgtgcaggtttattacatgggtatagtgtagcatgctgagttttgtgtatgaatgatcctgtcacccaggtagtgagtatagtacccaatacgtttagccctttcctccctccctctcttcccccgtctagtgaccccccgggtctattgtttccatctttatgtccatgggtacctggtctttagctcccacttataaatgaggatatacagaatttggttttctgttcctgcactaattcgctgaggatagtggcctccagctgcatctatgttgctgcaaaggacatgattttattatttttcatgactgtgtagtattccacggtatgtatgtaccatattttcttaatccagtccaccactgatgggtatctaggttgattccatgtctttgttattatgaatagtgctgtgatgaacacacaagtgcctgtgtctttttgggtagaacacagaatatacttttaagttttccttatgttttgtgacattttagatttaaaaacatgtgaaatcaaatattagaagatttcttccagcaagcttacctatattgttgctacagatttcaaacacatctcttattttttaaagtttgtcattgatttcactgttgtaattttccagtgtcatttatcatccttacttcatttttttttaaatccattatggtttctttcttttcttttttttatttttaagtgtatacctccgtttcattttcttccttttattttaagccatttcctccttcttgtcctgtatgatagggaacatggctttgtgaattttatttaaaatccctgttttcacctgttttaatagtagtatatttacttattgctctccttttaaaaatgttcttatcccattttctctgtagtatttgtgtataggctccacctttatatttgtttttttattggctcaacactctggattagcttagatctatccaatgtcatgtttacaaccagataactcctgttgttttcttactattcacttcttgctggttaaatcccattcatgctgattaaatccacttcatgttgctccagctgggtgacacgttggtgtgtggacctcccagcagctagagaccaggacacatctatgcaatctgactttgctctcaatagtaagtaggtctcttatgtcccaaaccttgttatatcacaaggatgaaaagctactattcctagtacagtaagttcatttcttcaccatcttcctctctctcctactgtataactcattttaactaattttggggggatgtaatgtgttacatgccagccctccctgccccgtcctcccccaactccacctcgctgcaactttctgtttttgggtactaatgccaaaataggaagagatagtgatataaggacaccgcactatgtaccctaagaaccagcaccttctattgatacctgatgtaattatggcagtccaagttttggtggaacaggccataaatatgactgcagttaatcaagaattgttaaaaataccttcttaattttcagatggataggactaatctttctacaatgcagaccacctgtttttcttagcccaacatcattagctttagaagaatggtaaagatattaccgctattaatcttagtttttagaattgttgagagatgtacttttcagtttaagtattttaacaaaaagttagctgagaccaccttgtgatggtggactgctatccagatgtcatggaaaactaaaatttttatggcaatatttttcaggtctttgattttagttcaactcttccttcatcccaaaatgactatcttccaagacattccaaatgattggacaaatgcatagatgcataataggattagagtagaaaatatcaacatgacataataagtagcaagtattttcttttattatgtgatgttttgaaattatgtctttgtaacttcatatattattattatgtcataccattttgaatggccttttatttaattaaaatataattttaattattttcatatttattctaacttagcatctctaaatacacatcatagggttttagtggtagaattatctaagctattgagatgtttttcaagttagatgaacttagtgaaaaatgttctgcaatgtttgataaaatcaccacggcatctagagcagtggacaatatccccgtgaaatgatggtggaaaccgaccaacttttttcaatagcatcctggtagtgatcttttcagtcacttttaaaatgggatttttttctgtaacccgtatgtaattcagaatgtctgtggttgttttagtcaactggccattaaaaaaaaatacattatggactgtgaactcaccaaggccctttcaagtgctgatgtatgttttatgttttatgtaggttattagtgaccttttttgcacttttatcagaaagtcctttgttttgtgcatgtagctctgtcagaatagaggccagatcttcaggtgtttaattgcagacttctaatgcataagacctgctggccttgttgacttttagaagttatttgttagtctcaaatgaaagaaacaagaaaaaaaaaagcttgctctttttataacagagtaagatgaaacatgcaatgatagggtggtgctgagttgtagaaatttctaaaaactaggtattcctcaaacagtaattagaatttttgattttctacatatctattggctaaagagccaaaaatggttttcaataatgcctgttttcaatatataaaacgtccataacagaatcactaaaagacatcaaattattattatttaaaatttattgagaggcaatgtcaatctgttttttcaaacctatcagtgactctctattgtatattggagaaagtagaaactcttaatttctgccctaacccccacccataactgattttaacactcctattaccacattatttgttactgcagtttttaaaattgactctatccatcagacagtattatttggccgctgtttttttacacctgtcttatttattcttgattttttttttttggtttgtctgttttatttatgtcactgtccactttgcagacaatttagttggccaggtatccatgaggaatattgccattcctgcactgtgctgagtcagacatgccttgtggcatcatcaagtaacaaggttgagaaaacgtgggtgtggcaaatccatttctgagtaacagcctttttggagggaagagattggctaatccaatcagtatcaaagcctgtgcttcttaattgggttgtattattcaaaagcatggatttaatttgaaataaaattgcctgatgtttctgtatcattgatttattgatggtggcggctactattttttagtgttttcaaggaatatgaaaacttacagtatgaaatttacacaaatctgtagttttaaaatattaccttttcctttagtgtttctcctattttccgttagtttgagttctcattttaaaaaaatgttaaagagaaaaaacatttgtctgacatagagctcaaaaggaaattctcattaaaacaactatgagaatgagagaaatcatgatactaagatagtatgtaatctttagagtttaaaatagttgttcctagcccctaaagtgatattattttgacttccttaagcatagagaactttgtttacagtagttctactctgcagttaggtgtaataaaccagcattctttacaaaactcaaatgagaccttggaacctgagctatatgagtaacacatatatgatcctgtgatctatatgatatattatttgtcatttctctattcccagcttgaaatttaatataaaaaaaagtttcactgcttcattctaaatcctgtttgatccaacatggaaaacattgttttagatttcttaatgtaaaaaaaaaaaaaatatatttgactggattagatagtagttactgcaaaaagttactgcaaaaaaaaaaaaaaaaactcggagtttacctttagtcacatcttcagtacattttctattaaagtatttctagattttagtgtctgcttggttttggttatctaagctgtaataagtagccttgggacccctgaaggcacgccccacacacttatgctgtgtgacctaaggtcacaagtaatggctgcaagctaattgattgagaaagggttgtctggcggggcctctttgcgtcctccctttacattcctaagttctgtgaaagaggcactagtagctcaggctagcaaggaaggaaaaaagaggaagtttctctctgcgttctgattacactctgaattcccttgtagtgagcttacttctctccacccacttcttaccaagaactccttaacttgagggtgaacaacttaaagcttgatcctacagttacctgaaaagtgatttgagtattcattgaactgaaagaacaaatcgcctacttcaggcggtggcaagcgtatggaaattatattagaacttcagcaaagtgcacagctgcataatagagaagccggcactcagattgacaggcaaataagccagcttgtggaaggggcctctgggtggcagctctgggcttttgggtgttggacaaccataggcaaaactgaaatggaacaggggcagaaaatagcacacttttactctacgcaactgttgctttttcatggtgagtgcagatttaagatattatatttaaaatatactttctatgttgtaaaacaagttaagaaatctgttgtgctttgagggaaattatagcaaaagcatttcttagaagttcttagacgatgtggttttgtttctgcttgatttcacactaaccttggtgatgcaaacagaaaaatacaatatttgtattgtctcgtgtgtcctttttctgaaaattgtcctttggtttaaatcatgcttctcttcaacttgaatcagcattgttttaggcaaatcatgtgtgggatagatgatgaaggaacaacggtgtgacagaatatatgtaaacatttcatttagttcgactttgtgtcacttctccacggcttcatgttttgccgccttatcttaggaatatatagcgcagtctgcatgaaaagagctttgtgtgagaattcctggccagttgaagggtcagggcctgtgcgttatctgactgccagcaagatcactggtgtgtcctcttatttttaacttaaaataggaaaaaaaaaagtgcatctttacatattaaaaagtaagtgtgtttgatttcaacagttcccttcttgtagtatgtggatgttattcctggcaaagaattgtttaaatttcttttaggaagcggcatgcaaacttcttttgtttctttttgtcttgtttgctcatatttcattgaaactttacacactttaaaaaaatttgaaatggtaccaagtagtttttattttggtgcaaatattttgaaagttgctaggcttatgttttctggagaacaatgtctcagagtgtaaattttgtttaactccccgtgtagtcatacttataactctactttaaatgtgcttcttattttaaaaatatcagagcctatagagactattcctagaaatgttaatagaaatgtttttctttggcaaaaattgcagattcagttttacaatttattaagtgccaagatatcattgctgttgttgactttgctaaaaaagcaattttattaacaaggtgactgcattagatgttaccaactgagacgaagtgaaacatgtgctttcaccctgttgatctgatgaaatatagaggtctgtgtggttacttcgtgcgtcacattcatttaaactttttaaagagcagctgcgtaatacaaattttgtatactcacttaaaaaataaaatttactagagtaggctcttgtttttggagacttatacattctgtttgctaaagtaaactaagaaactgaaaaaatatattggagttagaagctccaaaactcttcaaagggaagaaagcttttaagaaaaaaatgaatgtgctttcagttataaggcaattttgaagcattacttagctctcttttgcaaagatttaaggaaaaatcaactgttgtggaactaagtaataggcttgcctttatacaaaaattatgtataaaaagaataattattttccgaactgtttctatgatttgatacaagcttccttcaacaattgcaaaatgtgactgacaaatccttttctaagagaacaagttcattatgctctcgtcacctgttacattcattctcccttgcccacatacacagttcctagctgtttattagtgctgcaggaaagtgaaaatattttttttgaaagaaaatgtcaaagattttatttgcatgaatcttttgagctttaaaaaattgtggtcttatcataattgcccaaagtgttttgttaataaggtcttttgttattatcttaatatgaatagtcaggaaaggacatataaatcattttggattttctttcactatatctcaagtaaagttaaggtgtggctgagggtttttaaaaggccaagagattagacctttgaaagtttatcctttttgtataaagatgttttaaaaaatgtttaccacttacctattccctccaaatgaatgtaaagaccaaaaattaaagggaactttattattttacttggttataaagtctaaccacaaggcaggaagttactaggctttggagagacgctacaaaagaatgagcttccctctaatgaaagtacataaatcgtgaaaaactaaagacctacttcttagttctcctaacatttaatcttaaactagtaacgcctgtcttttctttgtatatttacttattgatttgctgctgagacagaggcatcttttaaaaactgaagtcaaccacataattttaataccatgattttaagaaggtgtatattttcttatgtaaagctagtcttccatagatgtttagattacgtatttgattactaggaaacagtggctatatggtcacagattaatatatgctgatctctcttatctatatataaaacatatattcacatacaaacataaacacatatcttgtgcttaggcctctaacatcttaaggcaatgtcttttcctcctagttatgcacttagttttgaagacatgtgtagatgaaataaaacgaaagagtcttctgacaagtgttctgaataaaacaagaaaaaaaaatgcttcaccaatggtgtgaagcgtaacaccaagcgcttgttacagaatatatcactagtgggtttgttgcttttcttatgtatttattaccatattgatgattacttctcctttgcctatagaccaggttggtggtgtgtgtgtgtgtgtgtgtgtgtgtgtgtgtgcacttatgagctcacatagggatgagagagtagcctggacatgtgccagggttatgacactctttgatttacttcttcagttctcttggtcactaaatttcaggctcttctgtacccttgtagcagttgacagctgatacagtgaaatcgtgccttctctttaagagtacatattatatcagctgcattctttcaaatggattgaacaatttatgttaaagatgatttattccatcaaaatatagaaaataatctataggactagatcctatcatcccagacaaattatgggtccttaaagactttcctagagagtagcagtatagttttattcttcttcttactgggtagagagcatagagtttgttcatctttctagacactttgatcttcctgaaattatttccacaattttgatcccacaaagcacaaatattgctttttttttttttttttttttttttgacagagtcttgctctgttgccaaggctggagtgcagtggcgggatctcggctcactgcaacctccccctcccgggttcaaatgattcttctgcttcagcctcctaagtagctgggactgcaggcacccaccaccatgcccggctaatttttttttattattatttttagtagagacggggtttcaccatgttagccaggatggtcttgatctcatgaccttgtgatccgcctaccttggcctctcaaagtgctgggattacaggcatgagccacagtgcctggcactgcttcttttaacattagctctaatctctttttctggaactccataatagatatatgttaaagtttcataatatacatatttcttaaattctctttcacactattttatatatctatctgtgctgcacttttggtgaattactgagacatcttcccatttactaattctttttttgactatgtccactccagaatttatttttttgacaatgtttttcttttctggaaattttaattgattctcatcgccacttcaaatgttttatttctacttactttgttacacattgtattgatgttatttcttgtctcttccaaaatcctagcatgcttattttgaagttattctgaaaccgctctattattttcatgtcttctggaataacttcactgaatgttgtttttaaaattttgctggtgcctttttatatcattctctcatggcttagaattttggttttcaggcttaactggaatgagaaggatttaaaaattctctctctctctctcattgctagcccttctgcaccattcctattgtcttagtgttggctctgtaccctctcgtttcccagtctataatctctgctaatggggatatcaaaaacctagtcactaaatcaaagagcagtctgtcccaggatgtgactgtgagattatggctgcttgctttggcctccccaagaaagcagctctatgcaagccgtggctccaggaaaagggaggtgttagtcagttgttcggcttcctcttgtcttaccttcaggttttaatcagtaagcttggcactgattattactccctgtgggacacatgtggcatccagttactttgcagatacaaggattggcttgcttctcattctagacaccatctggtgcagtgtacctcactttgtgtttatagtttatttctggtatgtttatcttgtttttgactattacttttcttttatatcacctcttttaaaacttatctattattgttacatgttggaagcaaaggcacggggctcaaaccatattattgcaatgccatcttgacaagagttttcaaagccgtgggctttggaatcagaaaacttggtttcaaattctgactcacttatgatctatgtgttaccataagcaaagtctttaatctattataaacctccttttcccttgcaaatattgatagtaatgcctacttcgtatgactgttgtaagcattgaatgtgaaaagatgtggaaagtagttaggcctgtgcttaaacattctgtgcgtgcaaattctggaggtggagaaaaagcaattaaaaccaaaacaaaactagatgttactgattatgtaattaacaaatggtaattggagtatcaaatagacttgcttcttgtattctgagtgaaagtaacactatcatttttgatatctaaagcacatttctaaagatgactgctgactgcatgagtttccacaggtggatcaaagctctgttacactatccacctacaccattcacctaattcagagaatcttaataaaatgaaaagcattcttcagaatgaccctttaggtatggttctctaaatccatgtcacttaagacagatggaaaagaagagagaagtggcatgagaacatgcttgtggcttgatgaatagtaatatatataccacccaggttgggtttctgtaatagtgaaaatggggaggagggtggtgatcttttgtaagtgtttcagacagtcttgttttgttgctttgtagctactttgtaatattgtctcttttaaaaacatatattttgatgacctagcattcaaatttatagcatcagcaaagggtcggtttagttgagtgggaaatgaaattctgaaaacaaaaagttttaaaaataagaaagatggggatgaagataaagaagcagtagtagcaacttggaatttgtcttagaatttgaaaatagaaacaggtttctaagaatcagtcttagtccattttctgttgctataacatgataccacaggctgggataaattataaaccatagatatttatatggctcatggttctggaggctgggaattccaagagaatggcattggtggaagcaagaatgtgagacagatgacagcagagagcccgaggggtagagtcccttttttaaaaaacttttttctattttaagttctgggatacatatgcaggaagtgtaggttttttaacataggtaaacatgtaacatggtggtttgctgcacctgtcgacccataacctaggtattaagcctaacattcattagctattttgcctaatgctctctctccccacaccccatcccccagcaggccctggtgtgtgttgttcccttccctgtgtccatgtattctcattgttcagctcccatttgtaagtgagaacatgtggtgtttggttctctgttcctgccttagtttgctgaggataatggcttccagtctctgcaaaggacatgatctcattcctttttatggctgcatagtattccatggtgtatatgtaccacattttctttatccagtctatcattgatgggcatttgggttgattccatgtctttgctattgtgaatagtgctgcagtgtacatatgcatgcatgtgtctttgcaatagaatgatttatattcctttgggtatatacccagtactgggattgctgggtcaggtggtatttctggttctagatctttgaggattcaccacactgtcttccacagagcttgaactaatttacattccaaccaacaaagaatatttaaagaataagcagaagatgctcctacaaatggaaatgaaaggaagaagctaacctggtggaaggaaagccagtggtttggccatactgcccgaagtatggccttactgcccaaggattcccttttacaacaacccgttcttacaataactaacccagcccagcaataacaatccatttatggaggactccaccctcatgacccaatcacttcttactaagccccacctcttaatactgtttcaatggcaatttagtttccaatgtataaactttgggggacatatttaaaccataacagaagctattgtcaatatgtcctcaggtaggacatttatgaaataagcattttatttttctttcttaccactgggtttccttccaccagattagcttatttctttcatttccatttgaaggcacatcttctgctcattctttaaatattcatgaacttcactgctttttcctgggttgccctctcttacttttctttctcctttgttcatctcatccatctccgtaacttcagataccattataagcccatctctagcctgtttcttgctctcaaactttaagccagtatattcagttagccacaggcacttcatcctcaagacgtctgaattcaaataatcatctttttgccagaatcttttaccatgtcaatccatcatccacctggttgcacaaaacagaaacaagatacgaactttgtcttctctctttctgtctctacaacatttaaggcttttgaaatattgatttctaaccatttctatttttaatcatttttttaaatcacagctacacatttcttactatatgattaatggtggaccacttcagagttgtatcacttgaggacaaggaagctggggtgtgtatctgaaactcctttctgtcattggttgaaggttactcctgtgaccatgaattctagaatcccagcccatctcaaggcaaccctagcatgttcttggctagagaacaccctcaggcagagagtggcaggtgcttgcagtaaaacatcctcaatgtgtaaggaaaatataagtgccaaggttatatgagaacaccgaaaacatctgcattgcacatttcagaggcatttaagttgtttctatgtgtttgctatttcaaacagcattgcaaagaacacaattatatatgcacccttgtgaacatgtatcaaatttttcttaggataatacccaaagtggaatttatatgttgtgagatatatgtggtctcaattttaccacttttccaatcactctctaaaatactgaaatttctctccaagggtagtggacaaatttctatttccatcagcagttgctagcattcccatttgcctcagtcctttccaattctttttttttttttttttttgagacggaattttgctcttgttgcccaggctggagtgcaatggcatgatctcagctcactgcaacctccacttcccaggttcaagcaattctcctgcctcagcctcccaagtagctgggattacaggcatgcgccaccatgccgggctaatttttttttgtagttttagtagagacggggtttctccatgttggtcaggctggtcttgaactcctgacctcagatgatccgcccacctcggcctcccaaagtgctgggattacaggcgtgagctaccacgcccggcctccaattcttaatattgtccaatgttttaacttttatttgttgggtaaatgatattttaaggcttttaaaattttcatatttttgattctaaatgaaaacagaaagatatctagtaaatctctgaaatgaagtgagcgatggagaccttatatacaaaatgcaatacattcatcatttttattataaatgtatctttatttattcaagtgttctcttcagtgaagtgcttccttataactttgacaatctttattaaattgtttatctttttttattgactttttggcatttgctatatacattctgagtgctgatactttgtcttatatgtttcaaataatgtctccaaggctatcccttgattttaaacttttgttatgtttttcttataaagaaggtgttagaaattttaattatttttaagataaacatattcatgttgaaatcacaaaagtagacaatatatagagtgaaaagtctccccaccatccttgtttctcatccactccgctcccactggccccttgtggggttcttgactataaaccaaataaaagcatacaatttacacctccttcaattacatacagtgttttaaaccctgcttttgtcatgcaatgtactgtggagatatttcaagatatgtaaggaactgtgcttcattctatgagggatgaaaatatgaacacaatacacagcctatccactgaaagattagtctgtcataccatgttgagagagtcataaaacactgggaattccaaggggagatatttctttccaactgaaagaatattcttcagaacagttgagaatcatgcatcaaggagatacagtttacttcaacaccagaattttttttaatccaacatctttcctttatttttttctcttgagacagtgtctctctctgtcacccaaactggagtgcaatggcacaatctcagctcactgcaacctccgcctcccaggttcaagcaattctcctgcctcaacctcctgagtagctgggattacaggcacgcaccaccatgcctggctaattttttttgtatttttagtagagacagggtttcaccatgttagtcaggctggtcttgaactcctgacctcaggtgatctgcccgtctctgcctcctacaatgctgggattacaggcatgagccaccgtgtctggtctccagcatcttaaacattaagctttctatagctgagaaaagtgtagcaaatttataactgaagaaaatatatattaagaacctagtacatatcaaacactgtgagaggtatgagggatgtaaaagtgaacaaggcagatagtccttgattttgtgggaggtaaaggctgagagttgaactgcaatgaagatatggtggataaagtgtgttaataaaaaggtattgggggtgtagcatgtggacagggtgcatgggtttcagatggagtcttgttgaaagagtagagagatatgtaagtgagagtaagcaatgttccaggcagaggaaagagatatgaaatattataaaattgagagtctggtgagcttgagaaactgcaaaaagtttaaattgtatggagcaccgagtgctgggagtggcaaagggctgagaaggaggtttggagataaatactggctccctcctgaaaggtctagtttggattatcctaagggcactagagacaaatctaaagggtttaataaggttggcaaatggttgtatattttctttatttagataggaaaatatcctggaacatgagtggtagttaaaccaagataatatgtgccatttctcaagaattttttttaatgctgttactgtagttacttagaggattcgaagataggcttcagagttattaaaaactaccagcgtttatatgctgtataagcactagtataaagaagaatatatgtacatatcctttattaaattctcaaacatttcattgattgaaacattgaaaaatcactagattaaattaagaacagtggttgaccagaaaagtacccttaagaacctttaagaaaagaacctttaagaaaatctttaagttcagagaaataacagagagaatcatggaagccaagtgcatgaaagaagaaaaagattccaaaattaagtcctttacataaaacagttaaattccctcatggtacaagccagcctttctgtgctaatggggccgttctgctcctcaaggtaattcaggagcccaggtttctttcaccttgttgctctctcatcccacaatatgttgccttttaggttgcagacatcactgagttcacatatgaagagaaaaagagccaagtttcggagaccacagcctgtctttaacttgaagacagcctagaaattaaacacagtatttctattctactcatctaattgtagttacacagtcacaactgcatatgagaaaagttgggaaatgtggtttctagctggaaagtcatgtctttaagaagagggacaatgaattttaggtgaataacaagcagttgtcacaccaaccttttaagtttcaaaaactattgagtgattaaataagtttacatactcattaaacaagtatttatcaagtgattgctgtatttggttgattattctatgtgatagcaatatagactttttttttttaagaaaatcattaccaagtggtacatattttagaaaggagagataggtgttaaccaaattaccaaataaatatgtggataaattaagaagtaataagtattaagaaaaaaataaatttaaagaatagaggggctgttttcagatagaatagttagagaagggctttaggttaaaaattgcaaaacgttctttaaaggatacaaaattgagatctccctccttggtcgagattttgcagttgagttgcaagcttagaacagtagttgaaatagggcagggagcgtagctcattggaaggagattcagagttaaagtccaaggagtgttatctttttaatgagtttgggggccgtgattacagcttaatgaacaaatgcatgcagaaatgagattgttgagatacttgtgctgacaggaaggagggaatgatgggtaaataagaagttagcaaagctactgagagtgagggttgtgtggactgattccagttcttgatgtagtcacataaaggcacggagttgttatggaaaccctccaggaagttgagaagtccgagtctagtaggggaggtgtgtcatgagactgaacctgtgctagggcttctctagctgtgtgcactggaagggtacctatactaggtaaagaggaggtggcaatgagagaggtttaagtgaggaatgtaatgtctattctacatagcaaaagaaatagtctttcagaagagaactgactgggaggcgggcatgtggctcatgactgtaatcccagcattttgagaagccgaggtgggtggatcacttgagctcaagagtttgagaccagcctggcaaacatggtgaaaccccatctctactaaaaatacaaaaattagctgggcctggtggcgcatgcctgtaatcccagctactggggaggttgaggcaggaaaatcacttgaaccccgaagccggaggttgcagtgagtggaggtggtgctgttgcagtgagctgagaatgtgccactgtactccagcctgggcaacagagaaagactctgtctcagaaaaaaaaaaaaaaaatgtggcagaagagaactgactggaaccacatgctccagttctagatgatgcctgaatttgtaaagagactaaaaatgtgttccagattatatttttcgtgacaggtttttttctttttaatttaatatttaaaattctaaacttttaatttagttgactctcttgattttgttgtgtggggattgttgtgtagagctgtaaattcatggtcacagttataaagttaggtagataagtcataaaaaatattaagaaattaaaaccctcagtgaatctctattatattctgcatttttttttgttaacatcagccggttcctagtggatttattgattttatttcatgtaataactagggaaacatgtattcctgaaaaaaattaaataatgtttaaaagctatttattgatatagttcatttagcatcatatgcatgatcttttatagtccattcctccgtagatactacatcatagagcaaccagccttcttggctagtatatttttcttgataacttggtttcaatttttttttcgtcctttatgtgtggatatttgcatattcctatttctacttccatctttgtattagaaatgacttcagatataaagaaactatggccagagctataaggatttttgccttttgaaggtaataccttgatatcatgacattttctatgattttaagctttttagtttttatcattttatataaagtattaatcatttctgtttatttgctggttcttggattactccaaaaatatctaatatagaccttttgaggcattgctattgttgtttacttgtttctaagcaagcccattttctctagtatttattttttattagttatttgttaaataactaataaaactgttatttattatttattagtttgtctttcctccaaggacatgaacatgtctttaatattttctcctgttcttttttcagttgcattaacttgtcttatttgacttctcttacctttctttctgcaaagtgtagctgatttctgcattcacgtctcataatttgttactttggagtgaaagtcctgtttgccttcagctcttagcaaaatctgtctttcattaccctatttgtattgccacttcttggtgctttaaaattcttctacactgttccccattgctgacacagttcctctcctcagcagaaattttactccactctctgtaaaatatctgtctcaacaaagaagaggtaaacgttttaaatcttgaagctcaatatggtattctttgacatcagtctcttctatgttaagttttgatatcttatagcaacatttaaatgactttcttattgttctcatcttctcaatcaatattttcttgtcagtcagatttaaattagcaagattagatttcatatattcttgaaggcaggatatcacaaaacaatttagcaagctgtttgcaatcaatattatttatatattcacacactagagattacatagggacaaatataacaggaatatggcccaaatcatctagatttagagccctttaatcaacatttagaattatttacttctgtgggtagaagaaattatcgatatttactaaatgttattaactttttaatcactgttacgcctttagcaaataaatttatttatgtattgggtgattagaaatgactagctacaaacagatatgtagaaaagggacattaatactatacacatacacacacacacacacacacatgcaaagactaatagtgacagatacatgtacatagagagatatacacatatcatactttatggaatgctatattccatatttcatctgcataagtcactgatatactttaagttaaatcatgacaaaatgaattgtatggtttgaaagttccagaatgcaccattaaaaaggaggaatcagagtgtgtattcattggaattcttattttaaagattaattattaatgaatcaagtaatttcaaagtaatattaatcctttttaggaaaatttgagtgggctgactttctttaatatctttgaagccagggaattcagttttttaacatagggaaaattttgtattcatcatcaattttggagcttccaatctttccctggtacttgctagttataggggctcacagataactaagatggttgtatctttttagtccatttcattttgaagaatgtgtgactattgcttttcatgacactgtgtctcatttatttttaattttttcaaataatgacaatctagatgaactttttgggattagtgggtgtttaaatttgttttaagaggggcaatgctacatgttgcctatcagcaatccagaattttttacatgtctaatcactttacagccactatggaaggtgctttgggatctagagccaactatctgagctataattcctattcacacattgctgagttgcagtagggagggttaactaagagagcttccttaatgctttatagaaaaaagcagaatataaataggtttattcagaggataaaagattaccaaatgaatgttagagatgtaggaagcaaggcaagaacattctggattgactgataataaacaatgtatgtgagagcaaataatgtaagagcaaaacatttgtttgactttgagtgatggcaaagattggaatatatggctaggagtttaaaagtttagtcaaatggatttagtggtcagtgagaaggtctgaagaaccaattccatacagaggtagcaaatcccagaagagtaacagtgtccaaatggagaaattgttaaatctaagcagcagcaaaaggctgggttcagcattggaggaaagacgagatggccatgccagccaaggtaaagtcgttccagccaagttatcccagactaaaaccaggagaaaacagaagtaagatttagttctaagggacaggattgtagggaacagttatgacccctgttatatataaagtatggactggggaccttctagttcacagacatttttgccaaattggtaaaagttctcttataaaatctttaactctaggaaaatataattctcaaacacatgagggtaaattcttctgttctataagatgatggacatagaaattatgggaagccaaggccaggtatggtggctcatgcctgtaatcccagcactttgggaggccgagataggcagatcacttgaggtcagagctcgagatcagcctgggcaacatggtgaaaccccgtctctactaaaaatacaaaaatcagccacgcaagttggcgaatgcctgtaatcccagctcttgggaggctgaggcaggagaataacttgaacccaggaggcggaggttgcagtgagccgagatcgcgccactgcactccagcctgggcgacagactaagactctgtctcaaaaaatgaaataaaataaaataaaataaattctgggaacccaaaagagatgggtagaataggaagattcaccttttaaaagtgcattctgagggaaaggaacgtgataacttgacagagatgtttgactgctcctccttctgaatcccctgctaaaaacttcagctgacagtttcagtctcacccagttcaagggcaaaggctactgggccagtggctcatcgacttattgtttccaggggagacgtaagacagtctggaggatgaggagttagtctggaaaagtgaagagggcctgctatagatacagaaactgatgggtagcatccatagttggagcacaggtgcagagggtgtgttcctctgacacagggcaacttgtggtggagtttgacttagaagtgagattgtttgggggatgaaaagggaaagatagatatgaaaagaaaatttccaaatagcaaatatattggtcttctgctgaaaatggctagaacggacatataaactctgagaaacaggaaattcaggaaaggagctaatggtagagagactagaggagcttagtttgggaaataataagtttgtgaggggtgataagaaagccgagaggcaagtccttttggcagttgcaagcaatgaaggagagaagtcaaacctggagatgcgtattttaagagcctatctcaaatgtgcagatcatactggttttcatatatgattttaaaaaaagttaagaaaacatacgttctttaaaatgcaataaggttgtataatattctctctggaccagtaattcacacagccatcacaacacaagtaaaacatgctaatatcttctggtaaactacctttcacaattcaattagataggtattgtaccagctccatttcttaatgtgttcgtttatctcaaatgcaacagtgtggtaggattgtatgtgcctggagaccctgagcatagaaacaggggagaagagaaatgcattaataagtacaaggcttaaactaaatataaagaatttcaatatcacgaacatataatagctttaatcatgcttgttctcaaacattatttatggcagtggtttatgtgattttacttaattaaaaattaggtaaactgatttttaaaaatgtatatataaagaaagcaagctattatttctttgaaaactgagcttttgctttggcaagtcttgataaaagtaagtctctaagaagtatttccattgcataaagtatggacaatacaaatgtaaaagactacacaaattataaaaattcagatgtctgtactgaaatttttttctctagtgactaaattctccattcatttaaaaatatattaaattcaaaattattgatggggcagtttatacacaaaaagcaatagcaataaaattatgcttgatgggcacacaggtaaagaaaactttaactatataaatatacacatatatacatatgtctacattaataacattatttattatagtctccattgtaataattggctgaccaatcagcagacttgctgtgttataaggatatatcagctgatgtaatagataaaaccccagcttcttagaggttcagagcttgttcagattacaatccacgcagtatgccttggacagttttttactccctgattcaaagactgaagttctttccatcttgtagctccaccaatagcaacttccacagttgctattgaagtattagttcacacatggggaaattttatggtctggacctggagcagacccatatatactccactcttcagtgcccagccacatggccataccttgctcaggtgaatctgggcaatgtcatctctctgtgtccctcatgagagccagataacacacgtaggataactttggttgtatgtacaaactctgagccaggcactgtggagagcacttctacaaccagtatacattttctaccctctagattcttagtagttacggaacagaactttccgtaagtcagtgttaatgcaaggctggatttattagcttatacagtagagggataaagactttctcataaggagaaactttttgcaaggggcagtattggaacagagcttgaagcataggcagggactcgtcatcagcagagatagaggctacagcatgaaaagtgacatgacaacaggaaactataaaatggccagagatgagattctatgataggggcagagataaagatatctgaaagatatttgtggactatcacatgacaggccttaagcaccctatttatagttcaggagtcacttcaaaatcttcagcaaatgcttgagaaagaaagcagtgttcagaacaagtagaatggaaagaaattaggaatgggagtagtgcagagcagcttgaactaatgcactgggaatggaaatgagagaacaggcaaaacatttgagaaagtcgatttgaaaaggcagattgtttatgttggtgagtaatccagagattttgtatttcactgacagagtgttctcaatcgttaatccttgggaattatttgatgagttccaaagggcactaacagctaacagtcgatctcattaactaaggatctgttaaaacctgccaaggcaagaattttttctgggtttgacaatgacgtctctgaaagccttgaacttgaagagaagcacagtaaaaatatcttctgttatagccacaagttaccacattttgcaaaacaaaactgaataataaattatataggatagaccatgcccccacctttttaaaaactcattaaaaagtcttttttatctttgtttttccttaaccaaaattatatggctctaatcttctttctacattctcttctagagttatggtcagggtatagatattttttgaaatgatactgaaaggtaacatttcagagagtttgaaggcattatgagtcttgattctgctagacttcagtgaaggaaaaggtaatattggagttcttcttcaatggcacctgtaagtctcatctgcataatcaagaatactgtattcacaccataaagggcactcttgaaatagggttttgagggccattcttttctcatttttatgatgcaggggaagtatttaaacgtttgaggagtaaaatagcctcttctattcccattagacgtagctgcaatttaccacaatgtaaaacatcaaatagtgttgatgtagaatatgtgaagtctcattttcaggtatttgacttaagaatatttttcactggcaactgagactgttagtcctccaagaagatagcctaagtcttgccaagttcaaaatgaaagatcctcctcaactccgtcagagaaggggtaacaaagtttagatgacagccatagagtcataattaacatgtaacttttagattgataatttaaattattccaactttcagaaaaattgtcttactaccctcaaacatattatgtgctatgtataattgttaagcttagaatggcaattggaaatatagtgtggtagcagaattcaagtggaagtgcattaattgtaataaaaaattgtatctaatcatgtggtttcctgttataatgggtagtagtatttatgtgctctttaaacactttgatctaaggtgtaggtttcctttcaataatggatacattccaaaaatatttaaaagggaagaaaaagacatattaaacgtgtttgaaatttacttttattatttcctactcgttgatggtattgagagagtgaagaaaattttgattaagcaagaggaaaaaggactaagttaccagaaaatatgggttttagcttagtttccctccttattggccatgaaacttgtctgagtttttagtttttatccacataaccattctatccacttcacagagttattttgagggccaaattattacatgttttacatacacaaacagtgtataaaatcatttcccttctgaggtcactctagtatttttataacatcatggcttaactccactgacataaatcccatggcctattgttgcgactttctgatcactcatgagtctgtagaggagtcttggtcctcagcctaccgatgagtctgtagaggtgtcttggtcctcagcctaccagtctcggcttttaacacctgggagaatgatacaattccagcaattcagtaaggtaaaatattagggcaatgactgagataaaaaaaaaaagaaagaatataagttttaccctataattggttgctgccaaaggattatttttctacattgcaattcttattacatcacaccactctacttaaaattatctgttaatgttttttcaagtctcttggtttttgattttggcatttcttcaaatctatctcatgtactagaatctgtgatttgagaatttaggctgaaaatgtgtaagaatcaggtgctcttgttaaattttgttgagttggaataaaaccacaacagaatacttttgagtttttaaaaaataaactcccactgatttttaaatagtatgcacttggagggaaaatttttattttgttttgctatgcctcatcaccatttcttttgctctgcaggacagtactacagaaggactaagtatataggaaacttgacttatttaaataaggcagtgaaaaaaatagaatatggggagtaaaacaacctctgaagctaagtctgcatatataataactgggtaagtctttcagtgagtttattgattagtaacaggggtttgatacgtaaaacagagcaaattgcatataggtatgatttgaatgggctaacatacttacaattaatataaaatatttccagattaagaattataagcacacattaaaataagaataaagaaactttttcaggtgtcttgaagaccctgaaggatttagtgagtcatcagtgagacatattaataaggatgagtatatgtatgagtacctgttgggtttgttttcctatcgttttttcactctaagtagtagcatgtattttcttttttctttttgaaatggaggtttgctcttgttgcccaggctggagtgcaatggcatgatctcagctcaccgcaacctccgcctcccacgttcaagtgactctcttacctcagcttcccaagtagctgggattacggccatgcggcattacgccgagctgattttgtattttttttagtagagacaggttttctccatgttggccaggctggtctcaaacttccgacctcaggtgatccacctgcctcggtctcccaaagtgctggaattacaggctgagccaccgcacctggcaggtaggatgtattctctagttcttttacaaaaggaggattttcatttacctgcactttttgttccccaaagagggagtcctggagtctcttggtgtgtatagaaaggcttaaatattttagccagtcctttgtaactttttccttgcttgtcaaaagcaataatattgccatcattgagaaatggtttcaatgatggcgacacttcacagataagaacaagcttattaatcttgggaaactcacaaatgattattgagtctcctagattgctaaaaacaaagaagaattaattttttgtcctgaagatttaaggtaattgtccacagcttaataatcatcaggaagaggataaactcaatcacaggaaatacaacgtagtagtgaaatttgttcaattacagaggaaagttccatcggaaatggtggaaatcctggcacttggaataagcaaaaccaaacaggacaaagtactaaactacaattagtaaggttctaatacagctctaaaaaggaatgcttcctatattgatgataattagttgatgatagattactgagctgaaaacttgacatttgattgctacttttaagtgttaggcaaattaagaggtatggaaaattggacatatcatagtgtaaatgaatttattttctccatggcaggatttggttgcttgtgaacatatagcagattctctaatactcataaggctccctctttcctttaatacgaaggatgtaggagaagttcagcaagcacttatttgttaggttgaattctaaatatggacacagtgcagtcttaaattatgttagaaaaaggacatttggcttagtgagacacattaatcatagtgcagtcttaaatagatctgaggacttacaacagtgcatagatatgtctttaaatcagcagaaattcagaagaacatggcaggttagaaatgataggatgataacttggatttgattatggcaagattaactaagcagctgttgagattggataatgatatgtgaggttctcatcaccctgtaacttgtttccactaatacagattaagaatgtctggaggaactataattatctctgtggctcgtgcataacataattatgttttgccagtgcaaagcattttattaagtggaaaatgatttttaaaaagttatacaagtggctacaagaacaaatcaactaagaacagaaacattggcacttcataatagtaatgtgaaaaatacttatctctttttgttatatggagttttcagaatttaaagccttgtttatatgacagatacatgagggattatttcagtgatgttgaccctcttactgaagtttgtgccccaggtgtccagaccacaaaatagaaaatgcaatctttgtctgccttacataaatacagtactgagatcagcttgtcttttaaatgtctgattgctatttaattacaaaaaatttgtctttaaacagagcacccaaaacaacaaaaaaacagtaaagaactcatttcggagccttgtaatccaccctaccacataaaaagagggtgatatgtctgacaactctctgtataatcaggtttattaagtgatagtcattatgcattttataaacactaccctaaaatatgtaatgtgaatgtatctgttaatcagaaaaagctaactaaaactgaatgcaatgtactcatttccattctggtggcattcttacataatgattttaaagcaactgtgatgagatagaaagagtgttaaagctgtagtgaacaaatgggaattcaaattccagctctgaagtgttccggctggctgagtttcttatactttctgagcctccgtttatccagtagtaaaatgcagctatgaatttctaccccagtgggctgctgagagaattaaatgagataatttatgtgaacaatcttcttagaatatgtttatttaatctgaccttgaaaaataattcacaaaaaatgtgtcagagtaagttttctctcgtctcaaaggagagaatatgaagtagattaagtgacatttttgaaaaaagttccacatttgaaacttttatttataaaattgtgaatttatctttagttatagaataactttcctcttcctttgatctttttaagcgtaatatttagccctctctttattactctgagagaagatgaatattttaaaactatttatatcacatgtctaaaagtatttctcatttttttcttaagctcttttttgaatatttataatttctttcccttttattctcatatttcacacctagtatttctgctttcatttcattaatctttttttaataacttggcacctgggcctgttttgcagctatgtgcagcaatcttaagtactatgtatagtttagttttcaatcagttccttgctgttactttctgcaaataaaaactagcttagctatgcatgtgattaacatggcccaggtattcctattactaggtctttctattactaggtctttctttccttctgtgttatttaatataaggcaaaataggaccctgccgcttaccaagctttcaggatcctccatcttccatcttccactaatcccttcctatgtctctatgaaaaatatatctctaagatggtggttgacaagagtgtgagagtcaaatggtaaggaatattgcttggaaataaggctgaattaataattccagagaaacattgtgaaataacttataggtacataaattcactatatttagatctgcctcatacttttaaaccagcagcatgataattcatagcatggacttatcatcataccatatattgaaacattcctctattgttggatggttatttcatttcctctgcttcattgttttgaacatccctataataatcaccactgtatatgccattttttgcagaagtggaattcctagttaaaagttgaatttcaaaattgttcttgacagtttatacttctagcaacaaagtctctaagtcttactattaagagaaaatgcaagacttagaacaatacattttataaatgacatgtgtattaaaaaagatctattatgtgaatgtatcatataacttgaatgatatacactaaacacttaacctctggggaggaaaataaaattaagaaaaggtggggaaggaaaatttacttcaaatacatttgtattgttcagattttttacaggaaagatgagtttatatactgctatgtgtgtatatatatatataacatatatatatctatatatatatatagatatatatagataaattttttttttttttttttttttttttttttttttttttttttttttttttttggagacggagtctcactctgtcgcccagactggagtgcagtggcgcaatctcggctcactgcaagctcctcctctcaggttcatgccattctcctgcctcagcctcccgagtagccgggactacaggcgcccgccaccacgcctggctaatttttttttgtatttttagtagagatggggtttcactgtgttagccagggtggtctcgatctccagacctcatgatccacccgccttggcctcccaaagtgctgggattacagatgtgagccaccgtgcccagcctactgctatgtatttttaaaataaaattaaaatagagacacaaaggtattactatagtggtatcaaagtaaacagtgtgaaagcatccaacctgaatttcatagctgcagtgtgatggcatttttattcagctatttctaggcatattttaaggtctgagactcaccatatgcactatcatgtaaatttatttttataggtaaaaactgtaaagtaataaaacagtctcagtttccagagcaaatcatatccatctgtactgctgggtaaatgtagttctgattcaaccacatgaataagattacacgtgtttttgaaaatcactatttgctgaagatcataagcaattcacatgctttgtctatggttaattttggtaataagatgcaagacagctcacagatctttaagctatatctagaaatagtgctgattgaatttaagctgattatgcagcttattttggtcgtttgccctcttcctaaattctaaagttcaaagtttaacgtgaaatagttttctcaagtttagctctagccaaagtccatgaaatggcttatgtctgtcaatagttgacctaatagatttgtcctatgttgacactttgttcttttcatactagactgtgcgtatcatgtaggtatgttattttcagtgtgctgtgctttaaaatgggattagaaagtcatggagaattttttgaaaatgttttgatgtgttagtgttttttggtagggttttgggatacatcatttatttattaattaattcattattctgtatttattctagaatgtcatcagtaatgtattgaactaccaatcatgttagtggagataacaaggcaagaccagtatagtgacattagaggcataaaatcaatgggttctataaaatatttgagttgctttataagaactgtgtatcaacaggagtaaagtcatcaagaagaacctcttctaccagtgccatcaagaaagggttcatttatatggggaagctccaacagaatctggatagacagaaataggattctttttcacaggcagggatggagatatgttttagacatggaacatttgagaggataaaagaagcatgaaaccacatgtctggtacctgtgactactaaggcatgtaaataaggcatgctgagagatgagaatgaaggtaaggtggtaaagcaggggtaagattttggaaaccattaaaaaccatgccaaagttcatgaacattttcctttaggcagtgaagatcttttaaggggttttcagcaggagagcaacagagctgtacattttagaaagagccctctggcagaaatgcaggggatgaatggggaatgcacaataagaggcgttaaatgattccttctggtaatattgggacataaaataaagcctgaatggtggggatagagaggaaaggatttgatgcagtatatgttaaggaagtagtagggtgtgtgtgtgtgtgtgtgtgtgtgtgtgtgttttctttctttctttctttttttttttttttttgacagtttcactgtgttacccaagctggagtgcaatggcacaatctcagctcactacaagctccacctcccaggttcaagcaattctcctgcctcagcctccagagtagctgggattacaggtacatgccaccatgcctggctaatttttgtatttttagtagagacggggtttcaccatgttggtcaggctggtctcgaactcccggcctcaggtgatccacctgcctgagccttccaatgtgtcgggattacaggcgtgagccaccacccctggccagaagtagtattaacaagtcaaagtcaatgataaaatttggatgatgtggaagaggcagtagattcccaagcatctgtcttgggttaatgggtagatggtgatgctgttcaccaataggaataggaaaagaggtttgggaggcaagagtgagaagtggttagtgttcagtgtttagctatgttttgtttggagtgtttatgtggcagccaggtggagattccaagtatgcagttcaatatgtgggcccaaaggttagaacacagggacgaattagagatgtagatttgttggtcattgacgtttcataaatgtagtgttaatatcgcacaaagcaaaatgtttagaggaggaagaataacattaggaatagcaacctgccatatatatatatatatatatatatatatatatatatatgacttaccaacataatccatagggtgtcacaattaggagtttattagggacgtttgtgagaccagtctcagtaacatagtggaagtataagtggagcacccactcagtgcatagtagaataaaatacaaatgaaagagttaaaatgaacaggttcatgttcttttttgaggagcttagctatgtaggggaggggaggacattaactggaggaattcacagggtagagggatgcattaattaattagacaagagacacaaaggcattactaatagtctatgggaaaataactggtggagtgagagactgaaaatgtagaagagataggaattactcacaaggcacagatacagcaactctcaacacaatgcagcagaaaaagggcaaactggctattcttattattgagaaaattgtggatgataaaatagaaattatggtatatgaaaggacagcctattaaccacttatatagcaatgttttaaacctgcataggtaaaacggccgaaatggtagtctttcttccaaatctctttccctccaccatatgctagacacacccttttaataaacagcaccacagtctaccttgttgcttcagctgaagacctgagttgtccttgattctcttttccacagtttattctccagacatctcaacttcctatgttcctgtcaatttctactactgcattctaattgaaagtatagttacgttatccccagactacaagagtagcctaacttttctctctgcttatctagagccactccagccccactcttccatctgttctccacttaccagccacaataatatcataaaaaagtaaaccaagtcatgtcactctctggttcaaactcttcaataatgcatagtgggcatgtggtaaattatgactattataatcataattagaattttcctttctctttctctttctcttttggttttctctttaccttcatttaactctataatagcaaagacatttaaaaattggccaatctattctaaacatatgattactggtagatttatagaaaacatattcagcactaatgtgacttatttctgtcataaacatttgactccttgctgttgccttatttgaaaatgacaaatgacaaataagtaaaacggtgtttctgttacttgtgttttatttgacccctcaattcccagtaataagtaagataatactttaaacaatctttgacatttttttctaattagatgacaagcaatctcaatgcatgcaccacgtgtttcaaggatataaattagagtgaatactttaaaaaaatagaataaaagcgggacacactgatatttgacatttttgaaaatctcgaatctcacatccctgatttttataatgacagtgattaggaaaaaaaagcttaatgtaagacaataagctctgagatttttcttagaaatgtactaaatttgattctaggaggagaaggcacttgagaagagcctgttgaagtctcatctgctggagaaaatttactccaagaaaataggatgaaagtgtcaaagacaatagttacaagccttggtggtgcaattgattatgatcttgtaatggtataattctgaaacgatgacacagatagtgtctttatatgatggagctggtccctagaagcagaaggcacagttttcaagttcagaaatttctaattaatatcatgtatatggtgaattacatatatatgtaataatatgtaatataaggttctgtaatatatgtaaggagttttattttatgatatataccataaaatgttccttatgtcctaagtgtatgacaaagaataaaacacttcatatcatagctatgacgttgtggaaaagacacagaactagtagtaaaggagcatgaaccagattccattctatcaatcaccgactatgtgcctgggtttgtctcctctttaaaacatagagaatgcttctcctcaggcgttctctgatgggtccattctatgagctgattctttttggtgaaatcagtcactaattcagtatcctgaatgccatattaaggaggtttagagaaaatctgaaaggtaactatgctaaaacagaggcatttctaagtgaatcaagttggtagtcacattcagaggctttggactcggtcacaaggaagcctaaccaataatcacttcacactgagtaaccattctacatatctttctgttgttataattttaggaacaactgtaattttaggcaaaacttggcaacttggccttatgtttagtaaattattttgggctctttgttttccagatttcaactgatgtttttatagtgacaaaaccatcccaatttgcctcatgtgaaagtcattctaaaataattgatatccaaagtcattaagataatgcaactaaacaggaatgtagttacttatatcttattggtagggagcataaaaatgtaggcacgagaaaggtgttttagtgatctaaagatccaatctgttatttttaaacgatgccattctattttgcaaatgcctactataagcagaacagctgaactcactgccaaatatgaaagagtagttaagaaatgatttgcagaatggatctcaaggtctttattttgctcttgcgtgtggaatctatttgctcatttgcacgtgtggaaattttaatctctacagcatgtttttaagcgtcacactgagcctggaagttaacacagaatcagatcagtaagtaaataaagcatatctttgaaaacatgaaatggaaaaaaaatacttgttttttgaaagttttatctttgcacaaaatgtctatctacatgtcaaagatattcagatgttcagctaagcactttgtaggtcaaaaaatatattttttgcattctgaactcttggcatcttggttaaactttcattctatattaattatacggatggaagagtttattcaatactttaatgaaccaagattattagaattaagcttcatgaaatcaggttctttgtctatcatgttcattactgattccccagtgctcagttagatgcttggaatatattacagctttaataaatatatttcaaaataatgccatggaaagaggcataaaataaagctttgagacttagcctggccatagcactgcttctaagcttagatcttagccaagccatttctctttccttgagtttcattttcctcatcttctaaaaataaggatttttttaaattgatgagagttctctggtcttataaaagtacttgacaattattataccatgtctgaaataacgtgctaatcacaatcttaaaataaatatatttccagaggtgatataattgccaaacatacaaattagctcacctagtatatagactcaaaaagttcagaatgtagatttcctctgatcacacttgaagattatagtgcaattttctcctacagaaagtttgtgaagtaccattaaaaattatgagtgtaggttgtggggaagatagccaaataggaacacctctggtttgcagctcccagctagatcaacacagaaggcgggtgttttcttcatttccaactgacatacctggctcatctcattgggactgattagagagtgggtgcagcctatggagggcgaaacaaagcagagtggggcgttgtcttaccaaggaagcacaaaaggtcgggaactccctcccctagccaagggaagccgtgagggactgtgccgtgaggaatgatgcattctggcccacatacccacagaccaggagactccttcaggtgcctataccaccagggccttgtgcttcaaacatgaaactgggcggctggttgggcagacactgagctagctgcaggagttttttttcatgccccagtggtgtctgaaatgctagcaaagagaactgttcactcccctggaaagggggctgaagccagggaaccaagttgccttgctcagcagatcccactccacaaagcccagcaagctaagatctactggcttgaaattctcgctgccagcacagcagtctgaagtcgacctgggacactcaagcttggtggaaggaggggcatctgctcctactgaggcttgagtaggcagttttctcctcacagtgtaaacaaagccacagggaagcttgaactgggcggaacctactgcagctgggtaaagccactgtagccagactgcctctctacattcttcctctctgggcagggcatctttgaaagaaaggcagcagccacagtcaggggcttatagataaaattcccatctccctgggacagagcacctgggggaaggggcggctgtgggcgcagcttcaaaagacttaaacgttccttcctgccagctctgaagagaggagaggatctcttaacacagcactcaagctctgctaagggacagacttcctcctcaagtgggtccctgatctccatgcctcttgactgggagacacctcccaccaggggtcgacagatacctcatacaggagagctccagctggcatctggcaggtgaccctctgggacgaaacttccagaggaaggagcagacagtaatctttgctgttctgcagcctccactggtgataccaaggcaaatagggtctggggtggacctctagcaaactccagcagacctacagcagaggggcctgactgttggaaggaaaactaacatacagaaaggaatagcatcaaaatcaacaaaaaggacgtccacacccaaacaccatttaaagatcaccaacatcaaagaccaaaggtagataaatccacgaaggtgaggaaaatccagcacgaaaaggctgaaaatgctaaaaaccagaacgcctcttctcctccaaaggatcataacttctcatcagcaagggaacaaaactgcacaaaactggatgagtttgatgaattgacagaggtaggcttcagaaggtggctgataacaaactgctccgaaataaaggagcatgttctaacccaacgcaaggaagctaagaaccttgaaaaaaggttaaatgaattgctaactagaataaccagtttagagaagaacataagtgacctcatggagctgaaaaacagcacaagaacttcgtgaagcatacacaagtatcaatagctgaatcgactgagtggaaaaaagaatatcagagattgaagatcgacttaatgaaataaagcaggaagacaagattagagtaaaaagaatgaaaaggaatgaacaaagcctccaagaaatatggaactatgtgaaaagaccaaacctacgtttgattgacgtacctgaaagtgacagggagaatggaaccaagttggaaaaaactcttcagtatattatccaggagaactttccccacctagcaagacaggccaacattcaaactgaggaaatacagaaaacaccactaagatactcctcgaaaagagcaaccccaagacacataatcatccgattcacaaaggttgaaatgaaggagaaaatgttaagggcagccagagaaaaaggtcaagttacccacaaagggaagcacgtcagactaacagcgggtctctctgcagaaaccctacaagccagaagagagtgggtgccgatatctgaccttcttaaagaaaggaattttcaacccagagtttcatatccagccaaacgaagcttcataagcgaaggagaaataaaattctttaaagacaagcaaatgctgagagattttgtcatcaccaggcctgccttggaagagctcctgaaggaagcactaaatatggaaaggaaaaactggtaccagcaactgcaaaaacataccaaattgtaaagacaattgatactatgaagaaactgcatcaactaatgggcataaaaaccagccagcatcataatgacaggatcaaaatcacacataacaatattaaccttaaatgtaaatgggctaaatgccccaattaaaagacacagactggcaaattggataaaaagtaaagacccattggtgtgctgtattgaggagacacatctcacgtgcaaagacacacaggggctcaaaataaatggatggaggaatatttaccaaacaaatggaaagcaaaaaaaaaaaaaaaaaaaaagggttgcaatcctagtctctgataaaacagactttaaaccaacaaagacaaaaaaagacaaagaaggacattacataatggtaaagggatcaatgcaacaagacaagctaactatcctaaatatataagcacccaatacaggagcacccagattcataaaggaagtttttagagacccacaaggagacttttactccaacacaataatagtgggagactttaacacccactgtcaatattagacagatcaacgagacagaaaattaacaaggacattcaagccttgaactcagctctggaccaagcaaacctaatagacatttacagaagtctctactccaaatcagtagaatatacattttctcagcacattgcacttattctaaaattgaccacataattggaagtaaaacactcctcagcaaatgcaaaagaatgaaaatcaaaacaaacagtctctcagtccacaacacaatcaaattagaactcaggattaagaaactcactcaaaactgcacaactacatggaaactgagcaaccttctcaatgactactgtgtaaataatgaaattaaggcagaaatacataagctttttgaaaccaatgagaacaaagacacaatgtaccagaatctctgggacacagctaaagcagtgtttacagggaaatttatagcactaaatgcccacaggggaaagcaggaaagatctaaaatcaacaccctaacatcacaattaaaagaactagagaagcaagagcaaacaaattcaaaagctagaagaagacaagaaataactaagatcagagcagaactgaagaagatagagacacgaaaaagccttaaaaaatcaataaacacacgagctggtgttttgaaaagattaataaaatagtagacccctagccagagtaataaagaagaaaagagagaagaatcagatagacacaataaaaaatgataaaggagatatcatcattgaccccacaggaatacaaactaccatcagagaatactataaacacctttacgtaaataaactagaaaatctagaaaaaatggataaattcctggacacatacaccctctcaagactaaaccaggaagaagtcaaatcactgaatagaccaataacaagctctgaaagtgaggcagtaattaataccctaccaaccaaaagagcccaggaccagaaggattcacagccaaattctaccagaggtacaaagaggagctggttccatcccttctgaaactatttcaaacaatagaaaaagagggactcttccctaactcattttatgaggtcagcatcatcctgataacaaaacctggcagagacacaacaaaaagaaaagaaaatttcaggccaatatccctgatgaacatcgatgcaaaaatccttaataaaatactgccaaaccgaatccagcagcacatcaaaaagctcatccaccacaatcaagttggcttcatccttggcatacaaggctggttcaacatatgcaaatcaatgatgaaaaacacatgattatgtcaacagatgcagaaaaggcctttgataaaattcaacaccccttcatgctaaaaactctcaataaactaggtagtgatggaacatatctcaaaaaaataagagctatttgtgacaaacccacagctaatatactgaatgggtcaaagctggaagcattccctttgaaaactggcacaagacaaggatgccctcgtgctcaaaataatattggaagttctgggcagagcaatcaggccagagaaagaaatgaaggatattcaaataggaagagaggaagtcaaattgtccctgtttgcagatgacatgattgtatatttagaataactcatcgtctcagtacaaagtctccttaagcaaataaacaacttcagcaaagtgtcaggatacaaaatccatgtgcaaaaattacaagcattcctatacaccaataatagacaaacacagagccaaattatgcatgaactcccattcacaattgctacaaaaggaataaaatacctaggagtccaacttacaagggatgtgaaggacctcttcaaggagaactacaaaccactgttcaaggaagtaagagaggacacaaacaaatggaaaaacattccatgctcatggataggaagacccaatatcatggaaatggccatacagcccaaagtaatttatagattcgatgctattcctatcaagctaccattgactttcttcgcagaattagaaaaaaaactactttaaatttcatatggaacccaaaaggagcctgcatagcccagccaatcctaagcaaaaagaacaaagctggaggcatcaccctacctggcttcaaaatatactacaaggctacaataaccaaaacagcatggtactggtaccaaatagaccaatggaacaggacagaggcctcagaaataatgccacccatctacaaccatctgatctttgacaaacctgacaaaaacgagcagtggggaaaggattccctatttaataaatggtgttgggaaaaccagctagccctatgcagaaaactgaaactggaccccttccttacaccttgtacaaaaattaactcaagatggattaaggacttaaacataagacctaaaaccataaaaaccttagaagaaaacctaggcaataccattcaggacataggcatgggtaaagacttcatgactaaaacaccaaatgtaatagcaataaaagcctaaattgacaattgggatctcattaaactaaagagcttctgcacagcaaaagaaactatcttcagagtgaacaggcaacgtacaaaatgggagaaaatttttgcaatctatccatctgacagagggctaatatccagaatctacaaagaatttaaacaaatttgcaagaaaaaaaaacaaccccattaaaaagtgggtgaagaatatgaacagacacttctcaaaagaagacatttatgcagccaacaaacatatggaaaaaacctcatcatcactggtcattagagaaatgcaaattaaaaccacaatgagataccatctcatgccagttagaatggtgatcattgaaatgtcaggaaacagcagatgctggaaaggatgtggagaaataggaatgcttttacactgttggtgagagtgtaaattaggtcaaccattgtggaagacagtgtggcgattcctgaaggatctagaaccagaaataccatttcacccagcaatcccattactgggtatattcctgaaggattataaaacattctactataaagacacatccacaagtatgtttattgcagcactgttcacaatagcaaagtcatggaaccaacccaaatgcccatcaatgatagactggataaagtaaatgtggcgcatatacaccatggaatactatgcagccataaaaaaggatgagttcatgtcctttgcagggacatggatgaatctagaaaccatcattctcagcagactaacacaggaatagaaaaccaaacaccacatgttctcactcgtaagtgggagtggaacaatgagaacacatggacacagggaaggggacatcacacaccggggcctgttggggcgtgggggggctaggggagggatagcattaggagaaataaatgtacataggtttcacaaaccactatggcacatgtacacctgtgtaataaacctgcacgttctgcacatgtatcccagaacttaaaatataataaaaaaaattatgagcataatggtacagtctctctattttgtttaaggggagtatcaagtcagagtttagagtgaattatttcttttaactgcacagtgtgattcgtgaaggtcagagttgaggttcagtgcagtcaggctggaaaggtagctcctggcaataagaagagtgtgtgaataaataaaagacgtgagctgtttcctaagtttacttaatattcagattaaatgaaaattatgagcctgaatgtaggagtctggaatgaatatgagtcaaagatcacatggaattaatgtattataaaatgatatacaagataggtttaattaatcttcctcaatcattcttatttttcagatcttcaggaattttactgggataattatccaaataaattgcaagcattctatccaaatggtaagcagaacatcttattatgtaatcatatttgtttatccataattaatataactttctgagtattgaaatgagaaacttgatttactcttcttcactcatgttttaatttttttataagaaaaactagaatcactaaagaatttctttttattttatttaaaaattataatcctgagatgcaaatatatgccatgtaagcctgggaactatttaatcactttactctaaaatctggtaaaaggtaaaatttctgaaaataggtgactggcaaacattttgtaaacaatatataagaagaattgtatatcaaaatatacacataaaactatcttttcagataattatgtatcatttattttcttatagcgaaattataaaaatacaacctatagccttccatagatacataattaactatgttttgaaatgatatccaattcagtaccctcatacatttgaaactttgataagctggtctatcttcactttggggatcttcttcattaagagtttgttttctcaagttttgaggtaggatacatgaagtcattcttcttctttataattatgtggcaggaactatctccctgaaaactttatgcttaagtttttgacaatcacactgtcagtcagatggtgcaaagtcttttaatactttttaatataagagagttgtctaaaatacagatagttctccatctgagctcatgacccaagcaatgtgcttcaaaattgcatttattgtatttttcttattacaaatgatactatgttcataatggatagataaattagatacacataaatacaattaaaaagcatattctcaccacctaatgtaacctgttaaccttttgtataaattggtgaatggtttcagtatatgaacacacaacctactgtaaaaattcaagaaatgagtgtgatgatgatgtaaaatgcaggttcaccttctctgtccccacttcctctgcagcttgggtataaatgcctgctccaccacctgttctctgtgtgaactttggcaaatcctttacactctctgggctgtcctttctcatctgcaaaatggagctaataatacatacctagctgaaggggttgtcttgaggatgaaatatgttaatacaagttaggtgtatagaacagtgcctagctcataagtgttagatattacaaaattacctattgtatttgaattattttttagaattcttaagatgtgcctattttgtatacttatatctcatttagctctttattaatggcaattattcttcagttagttattttgtggttccagatagaatatcatattttctaaaaacaataacaattttagatacttttatttttttcctttttagcatcatacttttttctattttgagttcactacttattgccttggctatgtctttcggtgcaacatgaaataactgaataattctttgttctttctgattttattaggaattactttcatgattataatttgagtactgtgttgactatttgtataagttttattctttttcttaagaagtaattatattcttaattaactatatttgatgatcagaagttcctgttgatattctataaatctcaattaaatataaattaatgttttaaaatctgttgagaagatgacttggttctcctctctaggtcagcagatttgctaatattatgttactcttgcatagctggaagcttacttttattacataccttagctcaattcctttttgtttacttgagaattctaaagaatattccaaagtaagaatgatatatactattttttattgcttgatatctatgtggtactattaaggacgttatatccacattgaacttcacaatattttctgtggagttacatatatgtaaaaattacaaataaaataaaaaccttactggtagaatattcagaccacagaatctattttggaggtgaaatttagaaaaaatgttttattaattgttctttgaattttgtaggaattctaccttcattgagttaatttctagtctgacatttaaaaagtattgctcattttgttaagtttttcattttactgccacatatttataaactatagtcttttggtttgcaaagttattgttgaataggtttgatagactcctcatcatttctaatttttatgtgtttttcttcatttttcactgatatttgtgtcagaagtttccctgttttatagcttctctcaaaaagccaaaagtggaattatgtacttgtttgatatatttatcttcctgatttattaattctgcttaatacctagtgtgtgtgtatatatatatatatatatgtatgtatgtatatacacacacacacacacacatatatatatatttatttatttattattttttttgagacgaggtcttgctctgtcgcccagattggagtgcagtggcgcaatctcagctcactacaaccttcgcctcccaggttcaagcaattctcatggtgcctcagcttccttggtagctgagactgcagatgtgtaccaccatgcctggctaatttttgtatttttagtagagatggggtcttgccatgttggccaggctagtctcaaactcctgacctcatgtgatctgctcaggttggtggatcaaagtgctgagattacagacatgagccatcatggctgtccaaaacctagtctatttctaatgccattttttaaattctgagatttatttctatgaaaatatttctaagtgtatcaggttgtatacaccagggtttgaatatgattgattttttaaatgttttggaaatatttgaaaacagtatgtaatccttgtcatagacttatttggatatagttctatcagttcagcacaattcatcataatattcaaatttcatgttcttatattctatttgctggacagagatgaggctagtttgtgcaaattcttaaaatgcccaagtgatccatttggatttatacagtaggcataaaactattgaatataagctggtgagttatatgagtagaccctatataggaagatgaatctttgggggtatgaaagatcaactacagtggcgtacaactaaggccaaatataagatttaaggatctgtttatttcagcatttctacttttaggaatctgaccttagaaatatcttccagtctttgaaggaagggtttagtgttcttaatctttcccaagccaattcccgccatcttctacttttccttcatccagtccatttcctccatcagctttccttctcagtccttttgtgaccttctgtgacatcaacttcttaaatgtaaaatataatgactttcttgtctcatgaattttatcccccacttttatttttagaaactttgatatagcttgtaaaagccaagacaaatttctaccagaattagagatatggcattcatccagccagccatcaaacatttttgaaaaccaactatctgctaggcaccatgctaagaggtagaaaaagctgcctccctacaagagatagaacctttaacctccatacgaaagagctcttaatcttttgcttgaattctccaaagttcagcatctccaactgacattaatatatttttgattcgatgacctgaagacaaccaaaactttaatgagctcagtctttatccctaacctacctctcctactatttcctctcctggttgatggctgatattaatctgtgctagaaacttaataggctgtcaatatataatctttatttaattaatattttatgctgtatctttactctgtcctatccttaaccaaacttcataaaagtcctattgatcacatctttacatgtatcccaaacttctctttacctctgtatttattacctcagttttaggaccacaacatatgctttttgattttttataaaccactaattatttttatatccctacctcttttgtccgtcagctacactcctaccagaatttgcatattatcatgacagtcacccattgaaaagtttttatgattttcgtttgcttagaggaaaaaaccaaaatcctcaggatgcattcagttttcttcacaacccagtaccaagtttatctcttctcaatttattccctttctccatctccatcatcctcattcccctgaatttcatcacatctaattaatgtgcatcatggcttcttcatacttagaccatgttctcacacatagtgggtattcaaccaatgtttgctggtcattattttgaaaaggcaaagggctagattaagcaggagcatatgatcaatcacctgagtgggtcagactgagaagacagtttagttgtttagttgataacttattggaactcttgaagttttatattagaataccatggaaatggaattcataaatacaacttagaaatgacctagtctaagctatgtttcctgaatgttgagacctgaagtatcagggacttgttcagaatgatagttgcagctgtttaatactatgagatttactgctcccgaatctgcggcaactgaggtaaacaatggtttgagtcctgagtaggaatttaagagacatgatgaactgtaactattattgatagaagtagattattctgacttgattccaaactgattgcatacatgtaatttacctccaagggtgtataattatgattttgcctgaggtatctatatggaagtatttatgaggatgcaattttcagggttttttttaaaagcatgtaattggatatttgatttgtaacctctaaaattaaggttagaaatagagtcatgagtgcttcatggaagacttcaaatggagagagagtgaattaatttagtagctgcttcatacaacttggctcaaatagagattgtagtctttctcctagtctttatcatatgaaaagcagccaggatagattttccttgttatatttttgtatagttgaaagttttgaatcaaattttaagtctttacaattgcctttttaaaattttaactgtttgttcttcgttacttctttctaaatgtcaaggtatatttatttactcttaataatgtgatatgtagtattccacaaacattgtcagtgacaaatcttttgaactaaagaatagattgtttgaccattccagtaattaaggaaactagattaaatatacaatggttgcactggtttttcaaacattgatgaagtaaacattattctcaattgacttagtagccagacattcttctcccaagtcttgaaaaataaaatattcaactttctgttcaattgagtggggagagctataaattttgtttcatagctttgtttatattgtctgcatttctctagattttatagttttagaacattataagccttagaaattcaaatgccgttttgcatttaaacttatgaaaaataatttaggcccacactgaagatctgtgaacacttttcttccaaagaggggtcgtactgtttaagtttgagaaacactgtatgaaactagtagcttaaaatatcccttttctaaatgttaagatggttcctattgtacaagggcaagtttctgaatatatagttataaagcctattgatatattgggtagtgtttttttttgtttttttgagtgcatctaacccaatgtccacattgtataaagtgccagagagattgaatgaattatcaagttcgtggactagtcagtgactgacaggacacaactatagtgataaatatatacaaataaacatgacaaagtcattcataataactttaattataacgagagagtcgggtctaatcaaattacatacaggaagagttaaaataactatctgaatattaaaagtaagataaaattttgcttgatgtaggctttctggaatatttaaataaacaaaattctgaaataccctctaataagtatttctctatagagaggtaattatatttaacagcaaaattaacattgatctatattcactgtgatatattttaaatattgttttgaaatactattgtatttatacaatgcaaaggaaagatcgctatttttattaaaagaatgttttcaaaaaatattttaaatttttatttcaaagtgacagttattcaaatgttgaatatgataagtgttttgtcatataacaatgttgtaaaatataaatgatttttatatataaatagaaatatgtcattcatcaagttatatgtaattggccacagctaactctaagtgggaagatttttttctcatcctattacttttttcctgagtatctcaagacataatgcttgtttctgtatttagacttttttagtttcccttgtattttagttagaattatctaattgctgctctcacacaaatgatgttatgtgactagagagaggaatcacgacttacctctttatctccctgtagccccctgtttctcaactttggctgcatgttagaaacactgcagaagattaacaaataatcatgtatgggtgataaatcttgattttactgatagctttacatgtatccacaacttctcaaattatacactttaaatatgtgcagtcttaaaaaaaaaaaaggaaaacatacacttatcatatgacccactaatccccctacttgggggtgggaaggggaaaagtgggagggttcaaatactcaggtcccatttgcagatattctaatgtaattggtcttaagtgaggctcaggctctgatatttattagaaacttcccatgagatcctaatgtgaattcagcattgagagcttctagtgagtactttgcatataagttctcaaaaataattgttctcatgtttttatatatataatgtgtatatatatgtgtgtgtctatatatatatatacacatatatatgagaatatatatctatatctatatatatatatgtgtgtgtgtgtgtgtgtgtgtgtgtgtgtgtgtatatatatatacatacatttttttttagacacaggttctcactctgtcacccaggctggagtgcagtagtcagaccatggctcactccagcctcaaccttctggtcccaagccatcctcctgcctcagcttcccaagtagctgggattataggtgtgatatgatatcacatctggctaatttttattttttgtatagacagggtcttgctatatttcccaggctggtcttgaactcctgtcctcaagcaatcctcctgccttagcctcccaaagtgctggggttacaggtgtgagccaccatacctggcctgtcctcatattttaattgaatatgttttttctttaattacaagtaatgtaacttgggcaacatggcaaaaccccatctctacaaaaaatacaatataattagccaaccgtggtggtgcgctcctgtagtcccagatacttgagaggctgaggtgggaggatcacttgagcctgggatgtctaggctacagtgagccataatcatgccactgcactccagcctgggcaacagagtgagattctgtctcaagaaaaaaaaaattacaataaagccttgaatacatacattgaaaagccttgagatgtataaattatgccagaggaagtccagtaaaagaagtactcccaaatagctttttgcaaatatagacatgccacagccttataggcatacatctttactaagacacatcataaaaacacatctgtgtggtacttttggtgcattttgaataaggactgaaaaaagttcacaaagattggtcagtttgaagtatggaatttaaatcacagttgtcatcttattaatggctactatttttcttgaaatttccattttatatgatatagtagtttgcaaatcactttcatttacatagtatacggtcatttgagtcatatttatttgttttgaacatggactttgatggagacattcccagttttttttaatataaaattcatttctttaaacatcagtttataattgaaaatttcagttttattgaagtttggttccagacagttaaggtttagtagtgtttgcatttttgtctttgtaaaaatatttgcacatttaatttatgattcaatttaatttttctgttatgaacatgagtgggtagcagaaaaaaattagagtgtagacattggtagttagaattgtgggtctcaaaaatggggtataattgagttgacaatctcatactttgtatctagaagagaaactgtggcaagaaacattttatatttattttttgttctttgggtataacctttataatgttaaccttttggaatgtatatattttgtgagtcagaatactatagactatgctgtagtaataaaccatccccatatttcactgatttatctcaacaagggtttacttttcctttctttctttctttctttttctttcttttttttttttttttctgacagtcttgctctgttgcccaggctggagtgcagtggcatgatcttggcccactgcagcctgtgcctcccaggttcaagtgattctcgtgcctcagcctcctgagtagctggtattataggcgcctaccaccatgcccagccaatttttatatttttagtagaggcagggtttcaccatgttggccaggctggtttcgaattcctgacctcgagtgatctgtccacctcggcctcccaaggtgctagatttacaggcgtgagtcaccacccccagcaggtttacttttcatttatagagcaaggggtactcagcatgttatagttacttggagcccagactcagggaggcaccgtattgactcatgtgacagggaaagggacactgatgaacagcagttcactgttaacacatgtcacatgggtacttctcattcaaaaggggtgagaaagtacattcctactatgtgcctgggaggagaggagaattggagtgtttgtaaacgagtcctagagagacccacaaacgtcttctgatggatgagataccggatgacagcgtatctttttcttctcaacataagcctgtattgtaaggaaggtagaatcttatcattgcaccttctcagataggaagttgagaatcagaatgcctggacagcgtcactatacacccacagctagtgagtagagggatcaggtttattatgtctttacagcataattatgtctccatatatttcattgatatgaaacctgtactgtgttctgctactttacattctatgatccttttatataattgctactttattttataatcaaacaaagagccagtttatgataagcatagattcttaggtttaagtgtgtaaatttataactattaccatcggtttgtcttttatactttcctttaaataatattttttagtgttaaaaattattcctaccttcagtccacctttacattttcgctaaaaaatattctgttaagttgaaaaacgaagcaaatcattgccactggacaccatatttatatcactgggaatgatgttgtttctcaataggatttgattttatctgaaattccaatgtttccaccgacaatataaagaaaaaacaaaaacaagaacaatctgctaatgaacagtttctgaagggacagaagggaagttttccaaatgcaaagctcagccaaaagggagaatttattgttgttgttgtttatttgtttcctgagacagagtctcactatgttgcccaggctggacttgaactgctgggttcaaatgatcctcctgcctcagcctcccaagtagctaggattctaggcaggtgccaccagaccagctcaatggggaggtttactaatgcaattttgctacaccaaaatggtggcatctatttatttacttattttaaataggaagaagtcagaagacttaatgaatcaagcattacttataattatattttttaatacaacgctttgagcatggacttaaaaatgcagagatgaaatataagagcttcttggaagcaaacattgttggacagacttataatgtgtcaggattttcaaactcattttctataactttccaaagatgctgtcaaatgaaggatgagtcaggttttccataaaaacatcattctaattttgtaaaacggtgtggctcaaaactataaattgggctgccaaactatttctctcaaatgtttgatggtttgggaacatgtagaatccattatattttcttcattaaaggactccatataataaagtgatttattgtgacaatttaatttattgtgataatttaatgtttgtgattcaatggaaaaacatcattcttttcataaatgtgatgtaataacataatattcatcactgggtgcacaaaagaagtttatggatatatgactctgctgctaagctatcagaaggattcgtgcccctgtcactccacacacgctttagaaagataacagccatgatttttgatatgtaaagtcccaaccattgtgtgttcaggaatctgtctgcatcatgacacaacggtggaactaagccataatgaatgatttagctctgtttcctctttcttcacaatgtgcccatgattctcataccaatatgcctttcttggacttatctctgaagtctgtaggagataacttcctccccattactagccagcagggtggcctgagtttccttgtctggagctgcaggatatttgttctatcctgtttacagccaatggggggccctttttcttccctacagtgagccttttcatctgcacagagggagatacaaaatcggaaatgatcttaattaaatgttttccgtccagaaacaactagtccactaccttgatctggcggaccttcttggaggtgccccttcccacctccctctgtggtgagattgcaggtaatagaccttatgacaaaagacaaggataaatatttatcagggcaccgaagaatttttgagtatctacaattatttacattcattcctgtgaacacatttaaccatgtgaggtgttattagtactccccgctgacattttttcctttataatattttcaaataaaattgtatcccctgaacaaattacaaaagtgcctttaaatatccagaataaatattttgagaatattcattttaaggttcaagtttctaaagtaccctattcgatgctaagttattgcaatatctgtcgtttagaggaacttgtaggtttattagctctataatgtcaacattcgcagatatgaagcattttatatttcttagtgatgtataaatgtatgaggaatacatgaaaatgcaacaagattttggttggcttaataatgagtttctttcttaaagatcaagataaaaattctgaatttctattgttctgtttttaaaattataaacttaaatgtatctagctccaatgtaaactctacattgccaactttttggaatatgaatataatgaaagtttatatctggttagttgtgaaaaaaattattattctatcatgtaaagaacatagaatttattaaggagatattacttaattggtagattattcacaagttttagctgaattgatttttttaaggaaaaaattatgtgaggaatttaacatatttgttttggtagaaacatgttttgacagaggaattttatacttagataaaatatcagtttcatataaacaaatcataacttttaaattataagtacatcttataatttttatgttttcacgtccatagattatttattgatagataaatagatggatagaaaaatttgcaaagttcagatttttttagtgataatctaattttttaaataaaatgatttaatatttgcacagtaaatgtgatgaaaactttgtgtacagatataaggtcctgtggtttggggtttcctttttgtccaaaaggcattgttctatgtgaattagacataccgatttaatattctaattcaatgcctataaaaccaacctttatttaattctctgctttctgcaattcctcaaggagtgaaaaaatagactgtgacttctttaaaagaggcattttgttaaaagaataaaatgtcttttgaaatattagtgaagtactagtattttaatacccttttttaaaaaaaacaattaaagaatcctatgattatttcttttccctatctcaaaaccaagcatattttcaagtaaaattaaatatatttgaatctacactttataatattacaataaaggaaagaaatagttatcattactacatttggagatttttttaaatgtagtttctcgttgaaagaatttactttcaaccacaagaagttgattattctgtgtgtttttatcagataggctttatataatttcttgtatctcataaggaagtccatgcataatagacaaagcatccaagaacacaaacttaatgaaaaaccagcttttgttgagatggtttcactccagtaaccttggaagtgttggcgagtaatttgagttttagtgacaagattctgttgctgctagggatggttttggccatttgataggctgagtttttacaagaataatttactgtgtttacagacagcttaggtcttattagggaatattaacccttcccccaagtttaggttctatgtgtgcgtaaattaagagatctatttctgttttggaaagcacacagtatattttaaatataatttttaaatgtaatttttaaaagaaaggctctattttagccttctaaattatatcttctatatacacttggtattgctgaataaccaaaattagctttcgcttttcttgctggaaatttgtaattttcttaacatattctttctgttctgagtaaaagtaaataaaggtaattaaaatacagtatttttttaaaaacttttgaaaaggttcatcttttaaattcttcaatgatatgtaaaagtttctacctatgaatttattttttgttactgataaatttgtattaaataattgatgcctaaaatatatatttagtagaataaagaaattagctataaaacaaaattagaagagccacaaactagacagggcactgtggctcatgtgtgtaattccagcactttgagaagccgaggcaggtggatcacctgaggtcaggagttcgaggccagcctggccaacatggcgaaaccctttttctactgaaaatacaaaaattacccaggcatggtggcaggcatctgtaattccagctacttgggaggctgaggcaggagaatcactagaacccgagaggtggaggttgcagtgagctgagattgtgccactgcactccaacctggtgacagagggagactctgcctaaaataaaataaaaataattaaaaaaaaaaaaagagccacaaactaaagtctggttgggttgggttccattgcctttgctcagaatgtaagctgctactatctaggtacatcagctgtacatatgtcttgtagccctttagggtctcagaatttgtctctgaaaataagaggattggataaaaaaaaaaaaaagctcagtactattttataattccagatgacaagctgaaggatcaagtctttagcttcttaaaattgttatagaggatattgaaaatgttattactaaatttggagtgaacatacatgaaaacattgattctttttatttttgttttgaaaatagttaaaaataaaaacaaggggaatttattatgtcaatctcacaatttataaagcttgatattttgagttgcaagtaaaattaaatataaaaatctttattaattctgtcacattagtagaggtctcaatgctgtgaaagtccatgtctaaattatgacaaaattattttcaaccatatcagcattgtttcagaagaaaagatcacaactaaatttacttacagcaatcttacaggtttaagttttattgcgatttcaaaaacaaaataatttcactatcaaattaaaaacaattcattcttttatccagaaagatagacattaatttgaattaataacatatttctgttttttatgttgcaatttctttcctaaagatataaaatcttgtgccaactgtcagaaaaaggaaggatgagattattaatatgtgcaatgtgaatcaaaaatgattcaagagaaattatatgtatatcaggaaacttcttgttctttcttattgatgctaaagcagggtggtgatgacttgaggtataatttagttaacactatttagatatatattgtcaaatttagaaacacatttgtagtaatataatatatcatatatgacatgcttttctgagggatttgtgataatagtaggtttcatgaaaatctctcaagaagacattgatttttttaccaaaaggtaaggctttatatctatagtatggggatgtaaacataattatcaaatgaatatttgattcgaatgatttatttgatattcacataaatcaaatgatttatttgatatttatgaatgtgatattcatattcatcaaataaatttgatattgatgaatatcaaataaatggcaaagaaaatatttatgatgagatgaacttttttttattcacatcagatgttctatacctagtattattaccttttgtcactcatcaacaaaaggtagtattgagttgttttcttactggcactttaaaatattatgcactattaattttcttcagtaaaatttaatctacttaatctgctcttataattatattctgtgatgttttccaatacaaatagttattccaaccacttttagaacttgtttcctttccaatgtcctttcatagcatcttttagtataaaacaacctttgggataaatattaataacatcaagtcaacacacagagtgcctattcatctttgttcattatatcacttgctctatttagatgaaaatcatataatcaaaaatgccaatatattgtctgtgtgacaaagtgtctccaatgacacatttagtataaaagccatgttgtactaatctgagaatagaatagatctatatctcattctaataataattctcaatgaatagtgtggctctttcaactgatgcattaaacagataaagatatttcttggagagttcagtcagttggctatgccgccagttataacagaaaccaattttcaagccgtgagttcttgttttttgttttttaccaaaggtactgtttccgtacactggtattaaaaaaatggattattctttttgatataactaagatgaaacattttttcattttttcctgtgattttcagtttgtcatttattattatatttaccagttttcgtttctatgtgccttacacacaactctcacaaactttgtttctccatttgctttactctttttttaatcaatctgtctagtttgtcctgatgaaaccaagtaccatagacagggtggcttataaacaacataaagttatttctcacagttctggaatcagggaagtgcaagatcagggtaccagcatggttggattctggtgagggtcctcttccaggttgcagactgccatctgctcattgtattctcacatggcagaaagaggactggagggctctctggggtatctttcataagagcactaatcccactgacgagagctccactttcatgatctaattaccccccaaaggccccaactcctcatatcagcacattggaggttaggatttcaacatatacatttctgggcaatgtatacaattccattggacagtcttacaatcttttcagtgtttacatgcataatttactgcaagacttggaatgaaacttcttagctttgcttggtctatataatatgcttcatcttaagcaagctctacattactagtgatgttaaatttcagtaaatggaaaaattccttgagaatactatattctctttcattatccaaatacctctaattttacaatttgatcagtgttcctgcccgtgtacaacccaattgaattacattggatgtaattgccagtttttaaaatatatctttggattaaaagataaatattatgaaggaccctgtctcattgtgccatcagtatatcatggctgagactatctcagataagataatgtattagtcgtctgcttcctaggaaaatgaacactaaaatgaaatatggaagaaatggattctgagtgttaaatgtgagaaacaaggtttatactgaacattctaagccattgccaaatgtcaactttaaacttcagatcaagagattcagaattctacagtgtcaggtatggtagatgttctcacaccaaggtgaacacaagaatcaaccgagtgatttatttaaaagagagtcctgagtgccacccccagaaattcagatttttaaatttttaaataaatctgagtgtgtcttttaaacttacattttgtaccagcaactccaagttattctaatataggtaatccacagataaaaaatatttgttagaacgtattttttaaaaatattgtttagaccataaatattttagccttttcttttttttaacaaaatataaatttatactttttagacagcaaaaaaaaaaaaaaattgtttaaagaaactctggccgggcgcggtggcacacgcttgtacccagcactttggaaggccaaggcgggtggatcacctgaggtcaagagtttgagaccagcctggccaacatggtgaaaccccatctctactaaaaacacaaaaatcagccggccatggtggtgtccgcgtgtaatcccagctactcaggaagcggaggcagaagaattgcttgaacctgggagacggaggttgtggtgagtcgagatcgcaccactgcactccatcctgggcaacggagagaaactcagtctcaaacaaaacaaagcaaaaacataaactctaaattccattatgtatgtatgtatgtatgtatgtatgtatgtatgtatgtattttttgaggcacagtcttgctctgtgttgcccaggctggagtgcagtggtacaatctcagctcactgcagcctccacctcccagattcaagcgattctcatgagtagaatgcctcagcctcctgagtacctgcgattacaggtgtgcaccaccatgcccagctaatttttgtatttttagtagagacggggtttcaccatgttgaccaggctggtctcgaactcctgacctcagatgatccacccaccttggcctcccaaagtgctgggattacaggcgtgagccacctcacccagcctaaattcctttaaaactatatttatttcttaagaacctgatcactagtctttctgtcagctctttctctttttattttttatttttggtcatttctggtttatattttagaatgtgctactatagatttgctgggatgattctgattttaatcaattttttttccttcttgtaccataaaaaattgaaatgtcccagaaattttgaatacatctagaatctagactgtatctcccagattcctattcatataaaaattttcaggcaaattgtccctctttggggttcacaaatcatgattgcaagagctagaagtaaaccactgtagaatattttagaggctaatagtttagaggctaaagatgtctcagagaatattggtctacccctgtcctatggatgaattcactgtttagcaaagcactggacgtgtattatgtcctagagtatcccaaaagggtatactgaatcatttctaaaaacagtcagtgtattaggaatccatgtgcaagtaacagaagtccttagtacaggagcataaatagaagcatatttacttgtctcatactacaaggagcctgagattaggccacaggctaatatagacactcaagagtgccttcaagatttcgggctcttttttttttttctgctctgtattgcgctgactactattaccctcatgctaactccttcttaggtagatgattgctacacttctaggtcccatatcctcaggataactacctgggaaagaaggaaagaacaaattagcgaaaagcaatgctctgtttttcaatttggaaagagatggccctttcaacttcatgttattacccaaaactgtgtcactttatctgctctggctttatgagaagctaaaaaattgagtaattttacctgggtacattgatgtcccaaactaaatcagggttctgacaggaaaaaagtaggaatacatactgtatcagaaactggaattgtttgctacagatagtatatctataaagaaaaatgtgtaagaaagactcagaacaattaatgtagacataaagatgtagattattatttgcctgttacatgtattaaccgtttggtagactattttttgggagacatcgttgtgagtcttcataatgctcatctcactcacccatgacagcaaaatgggggttggtcgctaattattaggtaaaacattctaaactaacaggaaaaaggaatccttgagttaatcttgggaggataacagtgggtgaaagacgatgataaatgcgcaaaactgctaaagtttaaatgattggcactttcaggatggtagcagtcaataagaatatgactgctgtgtagttaacctctgcactttttttcttttttctttttttttttcttttcttttttttttttttgagatagagtttccctgttttcacccaggagtgatctcggctcgctgcaacctctgcctcccaggttcaagtgattctcctacctcagcctcctgagtagctaggattacaagcgcccaccaccacacccagctaatttttgtgtttttagtagagatgaggttttgccatgttggccaggctggtgttgaactcctgacctcaggtgatctgccccctcagcctctcaaagtactgagattacaggcatgagccaccatgcccagcctctgccctgtttttatcagtttacctttatgactgactgaggaagtcctgaagttgcagctgctccacttctgagtgatcctggtttttttatttcttgttgtcccacagcagacagttattaaaatattgaaataatgagaatcctcaacaactctagtcacctttggcacctgcaaaatagaagttttgctatagtggtctagggtgagaggtaccccaaagaggtatattgaatcagttttaaaagcagtcagcttgttaggatttcatgtacaaataacagaaatctctgctacagtggcttcagtagaagcatactcacttgtcttatactataagaagcctgatattaggccacagagctaatacagaggctcaaggatgtcctcaaaatgaaaggtttcagtgttcactggcagagtttcctctggcaagcctggaggggatgggcagaggctggagtggaattcagattactcagaattaatcaggtcagaattaatcctggttattactttataccatggttcagttacttttataggtgaagatgtattttgtgcctaatcctacaaaaacatccaccccataatatgtcaagagcctgcatttattctgggaagaataaccataaaacctctcaagagaaattttccactataaaatacaaaagtaattttatgcgatacacagatcaatattacttgataaatatattacacaatggtcttgaacattgaaatatatgttaataatactttggtgtacataatacctgtatttcccatatgtattaacatcattttatagaaaagatcataattttaaaaaaagggtttgcaggaaggtacagttgggacctgtgcacacattgcatacatacagggtcttaatggaaagataattcaatacctgctgaaaccataacagatcattaagaacttttaaaaagacccgtgtctgtattgaaatagagaacctagctcctacttcaaatttacaccagaaaatggaacaattgatattatttttccattctttaatttctttttgcttaattgatttttgttttgtcttagttatcagtttgtcagatagcatgtggtttgttatttttagagagctcagattttccaaaataagagtaagcttctttgtcattattttatattaccatatatatatatatgcatatgcacatagatatatatgtgtgtgtctttacacatatgtttactataaaataaagaaagcaatattttacataatagttttaaatattctgtaagtaccatttggactagaattggtaagatttttttgtttttgttttgttttgttttgtttttttgtttttaatttgagacagagtcttgctctgtcgcccaggctggagtgcagtagtgcgatctcggctcactgcagccttcacctcccgggttcaagtgattctcccgcctcagcctcctgagtagctgggttacaggagtccaccaccatgcctggctaatttttgtatttttagtagagatgggtgataagcattttaaacatatttttaaaaaattatataaatttaggggtacaaatggagttttgttacatggatataccgcatagtggtgaaatctgggcttttaatacaaccctgtaatatcagttttgtcaaactcttatcagtcccacagtttatgaagagttttgaagttttgttatggtgtggattacagaattgtaatattgtcgttaacacctatgggtcttttcaatgaccataaaaaagtttggaacctgtattcattaaggaagaatttcactaacctcagaaggaatgagatatggttctgagacagagagaccctgatgaactctaatacacaatggtagttccagcataagcataatcatatatggacaagctaatttcattccacccttatggaaatctgccaaactccactatactttcaattgcaataaaatagcttcaggcaaatctgactttttatctacttctttgtgtactgtaaaaataaaactaaaacaagtttttactctgaaaagcttgtcgtttcaaaatgtatagtattaataactatgaagccatacagttatcactaccattacttggtgtttattttcatttattttttcctgggtattgattttgcatagttggaatcatagcacaaaataattttgtccatttttatataaaagggctattaacctttgttaatttcattccagtttggtaattggcttccacttcattactgttatatggatgtttatataactgtgataattgcttgcgtgcaaggacagagtaaagaaatgagaagttttacaaatttgtaaaatttgtgtcagtgattgagcctaaaatggaatctttacttcagcatatttgacccttagactttttaatgtttatgaaaacaattactaaaattatccccattttctacttgatccagtgtacctcatggaaagttaaatatgtttgaaggtagtgaaagtctcagcaagacaaatgccataaaatgattctaatattgcattcaaatgtttctatcatgtatatagatatgtatgtgggtggtctgaatgtatgtgtatgtatatggaaagagagaaatgattcataatagattttacattgaaatgtactaagcaaaataatagaaaagcatgctgcagaatataaaagcaatagagacaagcaataaaaaaaaaagaaaatgtacatatcagaaataaaacccactacatgcttctgtatatttgtgaataaccagtactcactgtcatgtaccaattaaaaataataggaaattttataaaccctataaatattgtgtttaactttttataatataggacttcaatagaaaatagactgcataaattaccttttatagaagtttagttgttaatgatcatttttagggtctcatccagagaggttcaacacattgttatggctgatttaaattatgattacaattatgaaatattgtgtctgtgaagttcaaaaatttacataccacagtcagcagtgaaatctattagaagctctagtgcgtttgtaggtctaatgtgaattgatatactggttcaattttaaaacatgttaattcagtcccctgtgccatgccactgggattaatattattataatatgtcatatcacttaaaattaaattatggtatactcttttgtgataaaaattaactaaagtgcatgaaattgtttctgagtctctaacaaaattacacattccttcgttttacgtaatttaaaataatatgaaaaatgtcaatatttggagctaacctcacatcattcaaattatagctaaaaacatagaattgctacattatttcttagattaaacatacttttccttaatgtgaaattgatattgaaatgtcatctagacaatgctatggatatctacagctttttaagtttgcatccgttctaatagattatttgaaatgaataatcatcagcttctttgagacagtaggggaaatcagaaacttcacagatgtttagtgatcttccaaggacaaaataatagaagtaatttaaattgctaacgtattggtctgttttcgtgttaccataaagatactacctgagactgggtaatttataaaggaaagaggtttaattgactcacagtttctcatggccggagaggcctcaggaaacttacaatcatggtggaaggggaaggggaagcaggtcacaccttacatggtggcaggagagagagagaaaaagacggcagggaaacctgccatttttaaaaccatcagatctcatgagaactccctcattataaggagaacagtatgggggaaactgcccccatgatgcaattaccttctgccaggttgctcccttgacttatggggatgacaattcgaggtgagatttgcttggggacacagagccaaatcatatcaactagtttgtcatttggattatagcactcattgggaggcacagtatattatgtaactttgaagtataactttcagttaatttttttttttatcattgcatttgtacacatttttgccagggaggctaaaacataggttaggtaccaatatttaaatctatggactgctttccactgggggatacgtattttcaacggtaaataaaagaaaataattttcatttcatagtcccttaaattttacttggagaatagattgcctggtaatcactctatcactcctgtctcttttcttagaagcaggcaaagttgcccagctaccatagtgtggaccttatgggacagctctggatatgtatgtcactgatacccttgttcactgtcaggttgacagacctgatggaggtactctgtaccacctgtatcacaggattttcctgcaaattgatatcaatctatcaattgaatagaattgaatattgaatatccaattcccctccctaacataataaaatacactagtaacggaatttcagtccccctggaagagagaagacattttggggctggtattatacttaggaccttccaccaatgagtccctccacgttaaaaattgtcagtaagagtatcaaatagatcacttatattagcatttcttcttccttctactgtgtaaagtcatcaaagatcattttgaagactgattcatatattattaaatgtagtattattttactattttttactaaatttgggaaatgactcagaactctttaataattttgagaggtatgaaaaataaaagtttttttccccatatttttgtgttggtagccctctttaaaatagaaagtatgaatttatttaagccagatcaacccagcaaaaaacaacaaaaaaagacttttgactttatcttgtgttatttttgttactgctggtggagaatttgtttctcaattcttccacttatttttataaacatgaataaattcctcattgaaaaaagttcctgtatttctattttttagtgctaccacgtaacttattttgagtgtgacatttgccaaaataaatagttccaataaagttccaatgaatacttgttcacaagtatgtccagcatgtcatctatgctaaatagtttctttaaatgtcatttcttctccaatcatactaggtactaaatcatctctattttctactgccactggaataagttacatgtacttcagtttacatctatctggtatattattaatggcaattgatggcttaggaatgaaaagttttgtgattaaaacttaggtttagcccgatatgagaggcaccaacatgagtgttaatacaatagataggttatcataaattattgctcttaaaatgtcaaatttgttaattccatcgaaagaaatagcttgaaaaaaagaaagctagccaattgcctttcactgaaatgtaatggtttatctgtagaataaacagaattagtttcccttcgtttgaagattttgtgggaaatacatttcattcattgtgtcccatcctgaagtatgctagtctatgatttttattatgccaccttacagaaattatagaatacaaaacagatataatctcctttttgtgcagagaataaatagaaatgcatatagaaatataaatattaaataatccagaactacataaaaagcaagtccaattcattcaacatacttgtgtattactcactgataatatccatgaattggactatttttctccaactcacctgtctcatgctacacaggagcctattttgaatgtttcccgtgggaaagaaacctcatgcattcatttcaattaaggcagtgattctcaactgggggattggttgtatagtttataatagtaatggtacagagaatttctactatacagaaatgttagtgatagaatccttaatgatgttaaactgttgatggaagtatgtcatgtctgtcaggattctgagatggaaaaagattggcaaatactgaactataatattggtcactggtagtagcttggaaaattctcttctaggaattttgcatttgatagggaatcattgaatatccaattcccctctctaacataataaaatacactagtaagggaatttcagtccccctggaagagagaagacattttggggctggtattatacttaggatcttgccacccatgagttcctacatcaggtacatgtttacttgacattcagtcatgagattcctgggccaatctccacactaacatgcacagttgtgtgtatagacgagacacatacatagtaggcttaagagcaaatgtctaccttttcctctgttttcaactcaaagtgttggtcctgggtaaacaaaagttttgattatacagtttttatcagtagatacccccaattttttttccatctcatctcaaatgattcattgcctaccaataaaaatagactgtccactggcagtaacttcagatctaatatttatcaattgtttaacagtgttgtgggataattccgccgtattgtttactatttctcttttccccaagatcagatatgtttgtctctagttgcatatatt

SEQ ID NO: 2489 - DNA, 11733 bp, Homo sapiens
tacactgtgagttttttcaaattgtcacaaatttcacaaaaaaattcaaatgtatctattgaaaaaaatctgcataacagtgagccttcacagttcaaggctgtgttattcaagggttagttgtatatgttattaaaattcacaatctcacaaggagcttatgctgctttctgacagcccaagaatgcttcccatgctagctcatgtctttatttgatagtaaatatgttccccacctaaaagatgtctgaagcccattagctttactcatggtgccagaagtagtgtaatattttttcttctcttagtgaatttcttttccagaaaaaagagttgaaacttaataagatcaatatagaaggccaaaagttgtcctgagcaatggggttatttcttaaccagatgcttgtctcttctccccagctgcaacattcctctgtactgaatttctttagtgccaagggggataagtggaaagagatgaaaatatagctgctgttgcatggatgaccccattcactctgactccttcagcaagtttcatttttccttataattctcggaggaatgctttgcctaaccacctaccccaacatctaggatttacttttaagatggtcagttaatattgcttgaacataaacttttggccagagtaactggaaatttaagtttattaaacttttacatacttaactatggtctacagggtattttaaactctgccatttgggtttagatctgcttttttacccccacccccaaatgtgcagcagtgtgaaatgtatgagaactaattggataaagtaatttttttaagaccttggtatcttatttctgccagataatagagaacaaatataaaatattcccatgattaaacacaccagatacagcttgaatttttagaatattaaacaggagtgataatgaggaagaacttaggtccctaattacaaaaggtttacacacacacagacacacacacacatcatattaagaatgtaagtaaatcaagttacaacacaatatatgcagtaagatttcctttcttataaagccaactatatcaagcaaattaaagtcacatatatggaatataatttaatctgttttacaagtgagggctgggggtggtggctcaagcctgtaatcctagctctttgggaggctgagacagaaggatagcttgagcccaggagtctgagaccagcctgagaaatatagtgagaccattgtcttcacaaaataaataaataaataaataaatttctaaaaattaaaaatagggtaggtacggtgggccacgcctgtaaacctagcactttgtgggggccaagatgtgcagatcacttgaggtcaggagttcaagaccagcctggccaacatggtggaacgctgtctctaattacttgaacccaggaggtggaggttgcagttagccaagatcgcaccacttcactccagcctggtcgacagggcaagacccctgtctcaaaaataaattaatattacaaaaaaggtacaagtgattatgtatttttcatacaatgcatatttcctgaaaacacattcagtttagtagttacattaggggaacagaatactatcattatggaaaggaaggcatctttattttatgctttgtatgcttctgtatgactagattttttaaacctcatgaaggtattacctttccaaacagtctgctatgatatttattgaacaagtattcaaatgtttcctttgcatagtttactacttggtggtattctgcttagcaatgtctattggaaggtcccagtatatccaatataaataaatgaaataacattgtactatattattagactgtattattggattacataaaagtttttttctgataagaatgtctgttatatttttctcttcttatttcacagtgattaggctgactgactttctctttcacttgctgttaggatttctggggacattacttcccatctcccttatctagtcagttcagttcaccattttgcaaccaggactatcattcacaagcctggcaaagcctgactgtgaagtctgtacctctactctcgcctactccttagatgaaatgacctggaagtaacactacttcttattgatcctcctggctatcatatcccgttcaccttcttccaggtttatccaagataccctaataatgtttcctatgcaaggtaatcttttaacacaagtctaactcccactttctgatttcacaccttctactgagactgagcttctgatagtatcaatactcatatataagttattttaacatgcatacatatatattcttggaggagtagacagtacacattttttatagactcatgcagtggggtttaaatacaatttagctattatgtaatttttggcaagtttcttagcttctctaaatcttagtttccaaatatgttaaaagaaagtatataaaaattaccaacttacaatttcattttgaggatgaaatgaattattgtacccaaagtacttaaagcagcacctagcacagaaaaatatgaaataaagatagaccattttgattatttcatagaaagaaatgtcatggtattacttattattaatgaatatgttgaaggaataattagtaaaaatgaatatatgatatatattgcagtgctttgcattgatggcctgatgcaaatagcagtaattacttacacaggatggctaacatttctgggaaagacattctaatcaatagttgctatctgtggtaggttaagtgtttgaattaaaaaaaaaaaagcagtaattcattgtgatacttccaaatgcactgttcacattttaagttggagacagattattacaagaaataggaaagataatcctaaatcttagtcaattttttttctcattacagattttaaaaagtgactagtaagggagaattttgagagtctagaaaacctggagggaaagaaaaaagagggaaggaaggagagaaaaaaggaaggaaagaaggaagaaaggaaaaaaaggaggaagggagggaggagataaaggaaagaaaaggaaaagaaaaaaggcagaaagaaaagagaaagaaagaaaaagaaatagaaagaaagaaggaaagagaatggaagaaaaagaaaagaaaagaaaagaaagaaaggtagaaaagaaagaagtaatggaagaaatttgagtattaacagagggcactcaggtttccaattcaatacatctcctatgcatattctacaaattagattgtcaaatattcagcttctctcagaaatttaggctattagccatttacaacttactttgaattaatttaatcagattatcagattaggattttgcttagtgactgccaaaatcagccaccctgaggaaattggagttttgattgaaaagtggaactgacaggaagtttggtttgaaagcacagggctcttgctggaggaggagggattgtgggtgttcagtgagttagaagagcctgagatagccagagggaagcatgagggtactggatgcctgggcaaagattaagagaatttgccaagaggtgggacatttccaagacaaacagcatactttacactttggctaaagtccctcatggcagtactcatttttgatatgtgctctcactacatttaatcgcagtgacagttgtgagattagaggtaccgctttcttcaaaaggatcattgaaagttgtgggtttatccttgtgtttctgtttagttttttatcatactagttttatttgtaaaccaaaatgcattatattttagacctttgctccaaaaggctaatgtaataatttttttaatggacttaagattttaactctaaaacctcatcaacattccatatattatgattcacatgggacttgtaaaagacagactccacacttcagaactgcaatgggctttttgttcccactgctgagtatttccgacttcttttgaaggttataaatttacaacttagtatgttttatggtgtggtgaatattgcggagaatgatctggccagatgaaaatgggattctgttggccctcaatgttcttttcttgagagacctactctgcattttaatacatgttatactatcttcaagttttaaccaaaatgttaatttgattttttttttctttcagtcaggaactttttgatgacatatttgtattccacatttcttcacttgtcccagtgttttattgggaaagtgttgaggtgtcttgggatctcttctgactcgttaagcatggagaatgattggttgttaaacgcagtaggggaatattagtaggaaaaaactgttttggttttatgaatggagatgggtgcctgtcgacatttagaaataaggttggagcactatactggtgtatgtgctgaagatttggaggtcatcaaacaacctatatgtaagagtcaatgagatttaaaagaattgaaaagaaaatcagatataagagaagaacaaaacaggagaaacaatgtcatggaaactaagggagtagttttactactttaatgtatatttctcagaaattgctttttggacattacttccatacttgagaaaatatttctgtaacatacctattcaagtgtttagattaattatttttttctgattaaaacattttgctcatgtatcttttaatttttaattttagtacaattgtatatttacaaaattattgaaaagataatacagagagctccccacactcagtttctcaaatctatcatattagtatgatatatttatcacaattaatgaaacataattgatacctggtaacacaccaaagtctatatgttatttaaatctcctcagtgtttccccaacaccctctttctattccatgatgatgtgcaggggtaccacattccatttagtagtcgtatcaccttagtctattcttggttgtgacagtttctcagacatttcttgcttctaatgacctttataattttgtggcttacgggtcacttgttctgtgtaacattcctcaattggaatttatctgatatttatctcaggcttagactggagtcatgcattttaagaggaggaccacaaagataaattgccattctcatcacctgttatcaaagatgaatactatcaaaataacttatcattattgatgttgacattgatcagctagcttgtggaagtgttaatcagatttccccactgtaaagccaattattttctttctgtctctttcaacatcgtgcttttatatatatgtgtgtatatatatatatatatatatatatatatacacacacacatatatatatatacacacatatatatatatatacacacacacacactatatatgtatttttattacactttaagttctagggtacatgtgcacaatgtgcaggtttgttacatacgtatacatgtgccatgtatacatatgtatacatgagccacgtatacatgtatacatgatacatgtatacatgagccatgttggtgtgctgcacccattaactcgtcatttacattaggtatttctcctaatgctatccctcccccctccccccaccccacaacaggccccggtgtgtaatgtcccccttcctgtgtccaagtgttctcattgttcaattcccacctattagtgagaacatgtagtgtttggttttctgtccttggaatagtttgctgagaatgatggtttccagcttcatccatgtccctacaaaggacatgaactcatccttttttatggctgcataatattccatggtgtatatgtgccacattttcttaatccagtctatcattgttggacatttgggttggttccaagtctttgctattgtgagtagtgccacaataaacatactgtgtgcatgtgtctttatagcagcatgatttataatcctttgggtatatacccagtaatgggatggctgggtcaaatggtatttctagttctagatccctgaggaatcgccacactgtcttccacaatggttgaactagtttacagtcccaccaacagtgtaaaggtgttcctatttctccacaacctctccagcacctgttgtttcctgactttttaatgatcgccattctaactggtgtgagatgatatctcattgtgattttgatttgcatttctctgattgccagtgatgacgagcattttttcatgtgtctgttggctgcataaatgtcttcttttgagaagtgtctgttcatatcctttgcccactttttgatggggttgtttgtttttttcttgtaaatttgtttgagttcattgtagattctggatattagccctttgtcagatgaataaattgcaaaaactttctcccattctgtaggttgcctctttactctgatggtagtttcttttgctgtgcagaagctcttgagtttaattagatcccatttgtcaattttggcttttgttgcttttgttgttttagacatgaagtccttgaccatgcctatgtcttgaatggtattgcctaggttatcttctagggtttttacggttttaggtctaacctttaagtctttaatccatcttgaattaatttttgtataaggtgtaaggaagggatacagtttcagctttctacgtatggctagccagttttcccagcaccattaaatagggaatcctttccccatttcttgtttttgtcaggtttgtcaaagatcagatagtttagatgtgtggtattatttctgaggcctctgttctgttccattggtctatatctctgttttggtaccagtaccatgctgttttggttactgtagccttgtagtatagtttgaagtcaggtagcgtgatgcctccagctttgttcttttggcttaggattgacttggcaatgcgggctctttcttggttccatatgaactttaaagtagttttttccaattctgtgaagaaagtcattggtagcttgatggggatggcattgaatccataaattaccttgggcagtatggccattttcacgatactgattcttcctatccatgagcatggaattttcttccctttgtttgtgtcctcttttatttcattgagcagtgttttgtaattccccttgaagaggtccttcacatccctggtaagttggattcctaggtattttattctctttgaaacaattgtgaatgggagttcactcatgatttggctctctgtttgtctgttattgatgtgtaagaatgtttgtgatttttgcacattgattttgtatcctgagactttgctgaagttgcttatcagcttaaggagattttgagctgagacgatggggttttctagatatacaatcatgtcatctgcaaacagggacaatttgacttcctcttttcctaattgaataccctttatttctttctcctgcctgaatgcctggccagaacttccaacactatgttgaataggagtggtgagagatggcatccctgtattgtgccagttttcaaagggaatgcttccagtttttgcccattcagtatgatattagctgtgggtttgtcataaatagctcttattagtttgagatacgtcccatcaatacctaatttattgagagttttttagcatgaagggctgttgaattttgtcagaggccttttctgcatctattgagataatcatgtggtttttgtctttggttctgtttatattctggattacatttattgatttgcgtatgttgaaccagccttccatcccagggatgaagcccacttgatcatggtggataagctttttgatgtgctgctggatcccgtttgccagtatttattgaggatttttgcatcggtgttcatcagagatattggtcgaaaattctctttttttgttgtgtctctgccaggctttggtatcaggatgatgctggcctcataaaatgagttagggaggattccctctttttctattgattggaatagtttcagaaggaacagtacaaactccttcttgtacctctggtataatttggctgtgaatctgtctggtcctggactttttttggttggtaggctattaattattgcctcaagttcagagcctgttattggtctactcagagattcaacttcttccttatttagtcttgggagggtgtatgtgtccaggaatttatcaatttcttctagattttctagtttatttgcatagagttgtttatagtcttttctgatggtagtttgtatttctgtgggatcggtggtgatatcccctttatcattttttattgcgtctatttgattcttccctcttttcttctttattagtcttgctagtggtctatcaattttgttgatcttttcaaaagaccagctcctggattcattgattttttgaagggctttttgtgtctctgcctccttcagttaacatcatgctttttgaaaagaggtcactacactcagccgccagttaacaaacaagtgaaaaattatgttctacctctttaagaatatatatatatatattcctaaatcctatatatcacaatcatatatatatatatatatatatatatatatatatagagagagagagagagagagagagagagagagccaggtgcggtggctcatgcctataatcccaacactttgggagagagaggtgggtggatcacttgaggtcaggagttcaagaccagccttagcaacatggtgaaacaccatctctaccgaaaatacgaaaattatcggacttgatggcaaatgcctgtaatcccagctttccagctacttgaaaggctgaggcaggagaatcagttgaacctgggaggcggaggttgcagtgagctgagattgcaccactcactaaagcctgggcaacgagagtgaaactccatctcaaaaaaaaaaaaagcaacaaaacaattttctgcatggaatatctgtttattctctgtatgtttattgtttattcatctaatcatttacttacatcagtatggattcatggatatttattttatacttgggttatcaaccaatactactttactttgttgtttaaattgtttcagcattagtaattgggacttctttcagctgtcacttatatgctttttttaaatatcccaccattgtttatttttattttattttttagcacttactttctttgtggcactatgctccaggtccaccttatatatttcttgtcaagtcctagaatcaagcatttctctaaggagtcctagtgtctttgattggagaatggtattagaaactaatatctggtttctaggtatgctcacttccacggtgctgtcattgcttctagaccttctcagctgacagaacatgaacatagatttattttgatcttctttaatttttttatcagtgttttgtagttttgcacatatacatgccatacatattctgttacatgtatatctaagtacataatgtttagattctattatgaataatatttttaaaatttcaaaagtcaagtgtttatttctggtaaaggggaaagcatttgactgttgtgtattaagcttgtgtcctaaaaccttgccaaattggcttttttttttttaatttctttgggattttctatatagacatatcatgtgtgactagacagttttatatattcctttccaatatttatgtttcatttccttgtcttgtattatttcatcagctaggactgctggtatgatgctgaataggagcagtgacagggaacatccttgtcttttctctgtcttgggggagagtatctagtttctcactgttaggtatgatgctagtagctattttgtagatgttcttcatcaatctgaagatgttctcctctatttttagtttgctaacagtttttatcctgcttgagtgttggattttgtgaaatgttgtgtcttgtgtcaattgatatgatcatattttgtgttgactttcaaaaattgaaccaacctcgcatatatgaaataaagaccacttggtcttcgggtataattatttcaatacattgctaaattatactggctaatgttttattaaggatttttatgtctacctccatgaaggataagggtgtacaaatttcctttcttgtaatatatttatctaattttggcattaggagtaatgctggcctcattcaatgcgttagaaagcgttcctctgcttttatgttttggaggggattatgggaaactgatgtgagttcttccttaaatatttggtagaactcacctgtgaaaccatttggatccagtggtttctttggggaaagattatgaattattatctcaacttattttagatatatggctgttcgtgtcatcaatttctctgtgtgtgtttagattgttcttaatctttctgaaactaaaaaatatatttgataaaatataaaagtgcctctagagattccctcaaaaaaaaaaagcagatttataggcttagaaaatggaatgaagctggtaatgtttaaaaaaaattatactgagaatgcaaaatcatttttgaaattctggtcaaattaataagatagatatcttccctccattacttcaatgtaccatatttttgtttgtttgtttgcatgtatctgtgtgcctctctgtttgctaaattaaaaaaatttctattttgacaattacatgtcatattatgttttattttaaattatttccatatgacctttgtggagaagatttacttaatcatttaagcttattttctttataatagtttgagttgtttcatgatcacattcaacttaatttaactttatttgaaattgtttctcaatgtattctggttattctcattaagaaataggtgttcaaaataccatgtcattattagcatatcttgcttaaagtgaaagccattgtagcatggtttgcaatttactttggagtaacaatggggttttgtgaagaaagattatgtctcagattttattttaaaatgttagaatttcaagagataaatagtcttcttggtctcaactagcatgagaagtagaggggaaatattttcataaaaagtaaaagagactaacaattgtagtttcacgcaaccaatattatattagttgttttaagacaatgacatcatgtagctgtaggatgacaaaaaaaatggcatttttcaaatagcacctttctccataatttgtttattataattatttgaatatgtgataattactaatattgtcataatagtctgccacatttacgaaaacactggacgtttccacctcagcattttaattgctcaccacagtgccattttctttaggactggttgttttgctttcagtttgcttcctagactatcatcatgagatcaaaagctgtgttttttataccacatgacagcccgatgccccacacagggtcagcattaaactgaatttttgataggatcaggtgagccaaaggatgaataaatgagtactcacgttcaggtggcatcaggtgggaattgtggctaggtaaaatggcatcttgttacaatggtaatttcagtcacctattccttacctcttctgggcaggcggattgatttgcaattggcttcttttcttctttctcactctactaatactagatggaaatctcattgactcttaacaacaaagcaattatcttaccatattcacaggttctaccccacctactagggaagta

SEQ ID NO: 2490 - DNA, 11568 bp, Homo sapiens
tactatgcctatagtggcaaggaagtgtgtactctgctgaggaagtcacctctgcagccaccagaatgacatttctgaagccagtgagagcaatatcagagagcatcaatattgtaaatacgttttgatcttatagataacctgaattttgctgtgtgcgctattaataactaatatttgtaagaatctcaacaattttcaaaatgctctcttatatgttaacaaatgtagccctactacaatcctgtaacatagtatccttacccacccccccacacacgcacacatacaaagaccaccacctccaccccatttttcagatgaggataatggggcttagagtatttgggtgacaaggctaagctcacataataagttttacaggctagcaggaataacaccaaagtttcattttatttgcccactccaaagaactgataatgacagccagccaggaagctacttggaggctgtgtctgggttcagtgggtaaagagtctttgagagattagcaatgtctgccgggtaagaccagatacactggatacccttggatagattccaatccaggtagcctaatttccttttccacatcctttagcactccacatagagttgtttctcacaagtatccacatttaaaagaggtaacctcccagaacagaaactagctgacattttggaggcaaagtctgtttctcttgcgcactgaagacaagaagagtcaatttgtgatacgtgttacagagataatacacatctaaacagcggtgataaatgcatgggaattacaggcaaaaccaaggtgatacaaagtttccaaagattagatgtatctcagattaaactctccagattatactaatcaattacagaaatggggctgagtgggagtagtcactgaagccaccgttgatgtactttccctaaccattttatgcaggcattccttcatgggggtctcctcaagtcactggagtcctcagcaggggaaaggaaaacagcaatagagaaggaggttaggatcttgggcttcattttgggagtcacagtactaaaacatcacctcatgattagcagataaaaggtgctgccctgggctcaggcaattacaggaagaaacaaccctaaagcagaattcacaacatactgagttcatgaggagggcgatgaggctgatgtggggactggcttttcttcttggtgactcaaagacaaagccagcagtacttatttaaaacatgccacgtgctcatgtttatgtgaggagtagaagacaacggctttggtaaaggagaaaattcactgcataattgaatctttgaaattccagagggaatggccttttctgagaacaatgtctgttattaacagaagaatttcgaggccaaatgcagagttttccaccaggttgcatagtgagagtcatattttgaatggatatatagttttttaaaaaaagaactctgaagagttatggatgtttctcaatatctttctcaagaaggcaacagattttggactcagcagataaccctttatcctatagctgtagtgatgatgacatgataagctgtgtagcctgagcttagatgcagaagtgaattctgggcaagggtcccactaacctgtcttccctgggctccagacccacatccctagctccttgttgggggctccaacttgtacagccagcacatcaggctcagtaggtacaaagttgacatatcaattttcccatgaaaagagatcttgttttgacaacactagtctttcagttacctagactcaaaatctagaagcagccctgctcaccttcatctccttcacagcctgaactgagtcaagggtcaaatcacatagctgggttagagatatttttgacacaattccttccttcctttccacccactttgagttggcacttgcttaaacactccctgttttacctctggatagttacagtgcccctcacttgtttcctcatctccagtaattatccattccaacccatcctttaaacccatgccaaaatcactttcataaagcttacctccacattcaaatctcagtactctaccaggcacatggtggctattcaggtaatattttctggatggatggatgggtagatggacaatgtatttactcatcatttactatatgcctgacattgtgctgggtattaaagacagcaggaaacaaaccaacttctaacaaaacacttccctgctcatgagccttgaatggccaattaacataaatggttcattccagcattcaagcccttctgcagcacagccccattctaattgtttcactggtcacctactctcccatctgtcctctagccaagggtttctgaccttagcactattgacattttgagccagacaattctttattgcagctgctgtcttctgtattacagcatgttgagcagcatccctggcctctacctacttgatgctagtggcacacagccccactcaagttgggacaagcacacatgcctccagacaatgccaaatgtgccccgggggagaagagtcgaaaagaacccaactgagaaccactggtctagggtggcgcccaatttacacccactgtcctagggaaattattaatagtactcccctttcactttcacatgtgttccagtttagaagacaaactagattggttccctgcttaaatctcccgagacagcaaccttgctctgttctcatgcagattgaagaggaaagcaacaaattagtatgaagccttcagcttccaagcaacacttttttttttctggtgaaccggtctcctctttaaagattcaacttctctcttcttctttcagcacatgcagtactgggaagtaaaactggcccaaatgctctgcagggaaatgtgaggatcataagctatcctcgcctctcaaaaaagaatcacaaaaatatttacagcttttctcaaaaagtttcatgttccaaagatccccttctacgtcattctaaccccaaatgcctcaaaaagaagttcaaagctctcaagtccatcgatccaacttcttctctggccaaaaaacaatttcgtgccatgtgttaatgcaaagggctcatgctgtattcacgaaatgccaagacacctggttaaaaagttcaaaaaagttaaaaattgatccataatttcgactagcatggtagttctcaagctttactgtttcagaattccctggagtgcttgctgaattggaggttactgagccccagtcagcagagttgcagatttagtaggtctagggtgaggcacaataatttgcatttccaagttcccaggtgatgctgatgctgctggtccagggatctagaagatgcccgctgctccctgcttattccctcacagactgaaacgtacgatattacggggttaggacagtgggcttgggaaagaagggagggaggtcaggagacttcatccggctgcttgcttaggttttgtgtttttcattttttttttttgccagttagtcagaagaaaacgattttaccctggcctgtgctgggcaccatgctaggcactagggatgcagcaagaaccagacagaccttgcctcctgctgttttcccctttagagccacaagctcttctatgggctccaattccattccttctagcactccctttcagttcatcagctgctaatcagcaccttcaatcactctccaaatccccacaagacagcttccatttttcaaaagcaaagccaaagggaaaatcaagagtttttagaagcatctcctatttcggcaagtgcttccctttttgactctgatccatttcatcaaaaacccttattagagtggtccttcccaggtgtatctttttagttacctctggagataggaggtgcatccagtttattctttctgctttgtttcctgtccagaggagaagagtgctttgatccaacactgacaaccacgtctgcaggggcctcagacttgcttccagggaacaatcactcagcctatgattttgaatgcttcttttgtcactgtcaccaaagcctgagggaaagcaatctacacgctggttgacctctgaggcgactgccagaggtgccagctgtttcccctaaactactactcactgttgaatgtctaggtttccatctcccagggaagacattgccccagcttacctcttcatcatcatttgggaaggccagagaagtgtgggcgaagccatcctgcctggcgtcctcaagactcttgtctgataccagggctctctctgggtctataatctttgttcagggaatagggaaaatgtcctgtgatttgttaatccctcctgtgcagtgagggggaagttttagagtaactatttatatttttgtgatatcaggagcatctagatatctttgcttacaagtttttttttataattttagcaaaggaaaattttatagtttttagcaaaggaaattttacctttcatcataataaaaaatgtattctagaggccattattcatgggttaatattatcagggagctaacgatggcttaacaagagatgggaagccattttggaagtgttctattatggaaagagggagggcctgtgacatggattcatatatcatattcatatggattcatatgccagccatgcgtcagccatgagtaacatcatttcttaagatgtcagagtttttcccaagcacatatgccctcaggatgagaaacaactcgtctgtttgataaaaaaagaaaaaaaaaagaaaaaaaaaagattttagttcaagaattttatagattacaaatttcagagattctttattccagtatagagacacagaaatcaaaaagaatcatcactcaaatatacataggtctattaggtggggacacctggtagatgtaattatagtttcatatgcctgtatttaatgccactgaactgtactcttgaaaatggttaaaatagtaaattttatgttatgtgtatcttaccacaaatatatatatgtatatatgcagaaaaaacatatataaatatatattcattaattaggtatctgaatagggagctatgatcttaaaaaagattattttttcctaaatggcaatgtgaatttcatgtggcttaaaatcttctagtatggatttttggtgtttgataagctacattatttaaactagaataatctggaattatagagaagtatttggcttctggggccactgggacaggggcagggagggagtgtgggagcagcacccctccccagcccctgctgctgtgggagttgggatggggatggcacttccctcaaaggagaccaatgttccattgtcagtcaacttagggcacaaaacagtcttcaagagagaagaggtggaggggactcatacctttggtgggagataagcccctgctacagggtaacacaggtgaaggtcaaaatgactagtagagaacacctcctgccactaaggggtaagagtagtaacatgtaaaatccagctttaagctttactttcctgtgttagtatcagacactgctggttgtctacctactttctgttcccccttcttacctcactaacgtaactccaattttgagaggaagctaccctttttcatttgttcaacttcttcttgggaagctaatcttacccttgacccaactggcctaagccactgataggaataggaagatgatacaattccggtcattcacatgctcagctagctgaggagacatctgtgaaacagttccttgtccatcaaaagagacacataagaagaaatgagaatcattcttttccaactgttaatgggtctagataggatggctatactactgtagttattgtgtgaccatgaagtgtgctaaccttgagccagaagccaatgcagggaaattgaagagtagaaagaagggaagatgttatattcttgagtatgacatttatgcaactgatgtaaccattcattatctcaaaggtggaactatcctacccttaaactccttactattggaactttttgaatcatgatttctataatgtgctgccaaaatcattctacttaactggttcagaattgtaattctttcaggtttttcctaaagccattgaaaaatggtttgtcataaatgactgtgtagagttgacagggcctttggaaaactgagtgggtgctgatgaccatacagggataaagtggtcatggaacaacctctgcgacatgaagatatggctgcaagcagcaagagataacaagcaggaaggcccagagcagtgatccatagcataaagtgacaagtgacaggagggacaggcttgtgggacatgtaaacaagccctatggttcttcagaaatacgagtggagaggaggtcatttaagacattgaccatgttcagacatgcagagtagaggcttgggctatgatcatcagataccaaaagaaaaagtaaaaagatgaagattttagagggattcagataatactggctataaggaatatcacaggatctcctgccaagaaaatgagattcctatatgatttcttatatctctccatatgtttcctataagaatactagccatcaaaatgacaaattcaaattggtatattcagacaaatagaaagaaagtatttccctatccctcaaatgagttggataaccatgaatggtgagtcagatgagaaagaaaatgcaacagctctcactcagacctggacaaaatgttaaaagatttagtaggatggtcaaaaacatagttttcaccttaactgcttactttcaactcttcattggaataaatgcatataggccaaattaataaggaataagtagttatattttaggttaatagttgtaccattattagaaaaaatctgcctcatataaatgcagccatgagcacttcctcccctttaaaaactagtataataaaaggaatgactgattgtacttggcatatttcccctctctgtggttgcatttcactgcagttatgaaaacataatataatttttcccaaggccatggttacctgacagaagcatttaaaaaccaactacactttggacttccaggcacgtgtgtgtgtgagtcataagacagttcagaagagaaattcatatttgacatccagagctccatcttcccgcctcaagtgtctgtgtggatgtacttactccagtcttacctgagtttcaataatatgggtttgtcacaggttgttatgggctctaactaacagctgtccactgcactgagaactattattttcagaggcaggtcagaagcccatttctgactctcacgcattgtaaagaaatgctgaccccaaagtgggattctttctcaaatacactcaccctgtaagcaccaggtagagccaggagctttcaaaagtgctctgagtttaaacatttcacagcatgaggaacacagccgaagagaaagtgcaagaaaaacaatataaagacattattaactgtgtgatcacacaagagtgaggcctccagatgggccacctcatagttattgacgagcgtttagagaagaacattcattactcgatattgacgctaacgagaaagggtttgagagcaagtttaaaatgtagaaggaggaaacacccaaaccccatccccatggcagctaattcactgttcccaacaattctgcatgctattttttttactccccttgttcatatcttatactgtgattaaacccaagcattctgactgtaaaccctttttttctgtctatttcgcataggcttggtgtgttaatcaaactgtcagcaaaggaaaaaaaaaagaagaagaagaaagggcacattctatccaaatgaagaaaaatctgagctttctacaacaaacacattttccagtggatgagcttctcacacagtaattatttcacttctcccagagattactgattacatcacacagaaaaactaaatgagggctgttttatctttctcatctctctgtggttcttgtgcaaacttatacttgttatcatgaaaaatgacaaatttgccatctgatcaaaatgttaacaaggtaactgtcagtgagatggatctctgactgtcactgcaagccagaacatgaggatacattgatatttctcaatacagcccctgcttccccaacgttcactaactacatttccacagtaaggtaataaatcactcagaaataacgagctatataggatctctggggtatgatagatgtgtcctaacagcactatctgcaagatagaaaacaattgataatgatctaaagaaaaccctaatcaactgccattttccataatggggtagatgaagcaaagatatgaaatcttaactatgtgatgcatgttatgacaaaaccggactgctccaaaaaaaacccacacagccccaaacaaaacacaaatgacctaacattacgtagggtcgaataaatgaaaaataaagttaataacacagtctggatacaaacattatattggacactggcaatgatgggataatcacagcaattgctgggtccacaaacagctaaatagtggagggttcctcatataacatgaatgaagactctggctcagttattggtttaatgaactctcctccaatacttttatgttctttaagactctttgggccacattatttctgagcctttaattcaatggtttaaccaatcatttcccccacccccccccccccgccccttagcaacgtggccaagtgccacatccaaaggaaccaagagagaagaggagaagtccatatggaaataggaggtaatcaaagacagaacacaagatagaaaacttctgcaagaagatcatggcttcagatcacagggacaaagaagcatggcatcaaactgccaagaagctgcctcataacgacatccctttaggttttaaggttaagaagtctcacatagccacagttggtctcctgcctgtcccctctgctcgtttgtctttggccattcctgcttctgctgtttgtagaatactccaagcgccttccctccccaagaccttgtgcctgctcttctctctctctcagggatctctctcctccctggctccttcccttcatccagcttaaatcttccccaaggaacctgccttgcccttcggtttcaaagtagcctctactaccacccctttggtctctatcagcttcatcgatagcagaaagaaccatgtctgtctggaccactgtaatttccaggcttctagcactttctcttctctagtagggattaagcacagtcccaatcctgggctctgggatacaggactgactagccttgaatctagtgccacaactaagtacctgtgtcccactgtgcaagcactcaatttctatgtgcctcaggtccctcatttgtaaaacagagagaatagcaatgcctataaatgacagcgttttgaagactaaatcactttatcaatgtaaagagcctgagatagtatcaggcatacaggaatccatcaatcagctgctgtttttataagagcaagaacagaggtaattcagacataaagtgaattaattcatgattatagacgttagatcaatgagtcaccttcatcattccaggtttttattttaccattagccaaaacagtattgtgctccttctaattccatattctcagactacatggaatgaatgggtattggtctttaagcctctttgagcaatgccaataaatacagtcacttccaatttgagggcacttggaatagcagtgctattgttcctttgacatctcaacagcacttgaaagtgaaagaaaaaaaaatagattaatggatgtattccctaaagcaacaaacatgtttgatgtataaacatatgttatgggcaatgacgctgtacctttggtgccacgtctcaacaattctcttttcatctatcccctaatcatgcaactgaatgcttccagtaggccacacagtagggacaaaatgatagtaagaccacctggctatagatacctgcttctagagaggccaggttccaacccattacaagctgataaccatatgtatgatttttgctacactggccaagtatttggatcttttttaaacatatttgattatttaccctttgattagaatttgtgaataaaaatgtcttttaagagacacaaaggaagggggtacgggcaatagctcattactaaaaatcattttagtgtggaaagtgggcttcactattcctataaggcagtcattttcaaacttcagagcatcacaagccccctgttagattctaatagaaccctgaggaaaatgcacatacacataaatgttcacatataatttctacaggttgaaggacctcccaaaacaaaacaaatctatcaaccacaaactccagtgtaaaaaactggctctatgaagacttcaaatcaccctcacttcctttgcatataaccatttttttcttcagacaaataaaaaatacaattaagtttaatacaagaagaggctaaaaacattaggatagaatattagagtttaaagatctttgcctggttatggtctaaagatatttgctttgattaatatatggtgtaactcattaattaaatgcaaattgaaataagataaacctgtccccatatcatttctggtagacaataatgtgccagttttctctccaataaattagatgaggcaagctttctgttactaaataatagcaatatgggacaggagaaaaaaatttaccatgaggtgctttggaattattcacatgaagaactttttatttcttactttctttttcactaaaatagtactttttctcattttcaaccaatttttaaatatgaggtgtttacattgcttactgttcaaattagcattgcatactttcaggcacagacatgctcaaaataggagtcttttgaaatgcctgcattcagtataaaacacactgctggtaggaaatgcaaaatgtaaaagtcttaaaatacatttagatatggaaaacaaaacatttaaaacatattcacactttaacatgtttggaagtataaagttaatatcgtttatgaaacaaatttcaggaatcatactattgaaacaccctcacatcttcaattagctggattaaggaaaaaaaatattaacaatatttaaatgcagaaaacagattatcaggaagagagatcgttatagcaccttgttttcactaacaagcagagcagactgtaattgagttttagaaatccctgaggtggtaactcggtagagaaatccagacttggcaaggaaatcaagtttccctttaattacattatctcaatcaaagagataactttcacatccctacaaagcaaatgttttaaggagaagtctggcaaggaaagtaggtggaggtacagaggggttaagagtttcaaataacttcatattggtaggaggaacatgtagaaaactgaagtacactgtgaggaagaagacagatgccctggcaaatggtgctgctcccaaaaacatatgaca

SEQ ID NO: 2491 - DNA, 182663 bp, Homo sapiens
acctattcttttgactgagtcaattccttaacttctttcatattccctcatttatcaagtgggcataaaaccagtatcccaacgcataagacttttataccgattatgtgaaatacataggtaaagtgcttaagctaatgctgcacattctgaatattcagtcaattccagcagtgactatattacaggacattagttttaaaaataattttgacaacctgcttctgttctaaaccagaaggcttaattctacggtgagccttgctgaatgtattctacttcatccagaccatcaccaaccccaaagctgtgtgttctacatggctggatttcgcctttcttgatttggggaggcctcatcttctgcaactaagtcgagtcaagggtcagcatgaaattactgacagccacttagttctaaaataaatgtcactggaagtaatgccacttacaggactttgaggatacctcagcatgatcaactcaagaatcaaattagtggcctgtcaaaatgcacaggcacactgatggtttctgatgctactgtcaatgagctccttcacttagaatattagcaatgctcaggcagttggtatgcctttcaggaaacagaggaaacatagtgcttttcatgtgttcaaagtgtcccaatcaagttgggaaacttcgaggaaaaaaataaaataaaaaaaaattcagtttaaacaaaaaaaataaacagaaaacacctcctagaatttgtggagactctgttgagtttcgtggcttaacaattgtgtttttaagccatacatcactggtggtgctccaattgtgagttataataatatatcataagagggatggtgatctcctgatatatgggtgccatacatcatctaagcaccatggctttgatgatgtattgctccaagccacaatgagagtttaaaggagcttttagcagccagacagctttaaatttcaaattttcaaaaattaagatcttttcaagtaaaaaaaaagcaagataatggaatgtgatgctatataaagtgtcactgaactctgagagcctgggtatatgccttttccttttggctttgagctcacaaggtggaaatcattggcaagttcttcttcaattcctcctccatgagcacagaggtgagcaagtgtcaatgcatccattttgccaatcaatttcccccatcttccacactgcaagcctgagtagctcatcatcatcccaaagactggatcacataaaatgctgtgataggcactggataaacccaggagaagttattttttattttttattttttggtttgttttaaagagctcttccactgagattcagaacaaaaagaacagataaaaagtagatagacttccttcctcattgctctcaaactcaaaacagggcatgtaggaagaaaacatgccttgtctagcatttgtctttgtaaagcaaaggaagcattgattgcagatgaggagaaagaggggaatggcatatgggcttctcatccagactaggaaagggagctgttgtcatagttctgtcacctttcctattttaacgatgggtttataagacggtaatgtggcttaagagaatgtacccacttcgtttaaaagccactcacttttgggggcaaagtaatcacaatcaattaagaaaacaggtgttgagagaactcctccctttttttttaaatcctactgcaataaacagaacaaaatgagaaatcttcctactgtttctgtaatagacctaaacaggaacagtgagagacgattacacttcaagtggcttcttccattttcctttactaagtgaattaaaggaaagaataagagtagttactgccatgtggagggaaacatctgggcataaggaattaacagtcttccctcccattctcctatctctaattttttgctccttgggcttcctccagtagattctaagtcccaaattactgtagatattttgcacccggctccctccttgaccacttccaaagggcaaaaacatcttatttccaccaaagaaaaccaatggctgtctcaaaaagaagtcccaggcttcttttctcctgtagtagtaagttaactatataatctgggtaacaaagacatggaaataaatgcatcacccactattctgaggctgtcagttgaaagatgtgaatgaggcaggctttgcatctagagaaatgtgggttctttcacgggctggtaaataaatcccccaaattcagtcctcttcttctctataaagagaatactgacacaacacttaattatttctttcacataagccaaaaagctttacttacgtatttatagtaatagcacaccattcatccacccaccatttttaagtcattatcagttataaaacttgctgccatttacataagaatattatatgttggaatggtacttagtactgtatattatcacatcctcaccaaaacactaaaaaatagaaactgttgtctccttttttttcagtaagcacactgatgcttactggaattaaataaattgtgcaagctcaccaagctggcaaaagtggccgagttaagattctaagtcaggttgataggatgtcaagcgtaatctgtattttgctatgctccttcctgagtaaataactaatgtctgggtgaccatatgccccagtctgtttggaaccatccagctttaggcctgcaggtatgaacaggccagtgtaataacaaacagcatcttctttcactctcctaagttctgctgtggacaataaattatatggtctccctaactagtagtatagttcatgccaggaaattttatttctgctcattctaactattctcatctgcagatagcaggggaaaaacaaagaagaaaggaaagaaagaaggctctgtgaaagtttttaaagaatgggctactaactcttatctatcaatacctttcatgaaacctccaacatgttcagagtagagctctgggagggaaaagaaatactttagactaaaacagggcccctcaagctctaaagaaaaaacctcaagcatgctagaaacctctccagttgagcattctttacttattatcatcacaagaggcaacggtaatagctgttgctatttattaagctcttactatatgccaggcaccatatgccaggaactgagctaagcactttctttgtaagatctcaattatttatcataaaactgcatgatagatataatccaaattattatcatcattaatttatagatgaagaaactaaggccgaggaacgtggaatgaggaggtctgcccgattccaacatccaagtgtgatactactatcaacactctggtacagttgaacacagcctagtaaaagttctaagcccactgcccctgcaccccctgctattcaaccttatgacagtaagctcttctgcaagaggggcccattagagagaatggacttctaacaaattgagatcaatcttgtacaaatattctgtattatcttttggcttctgattggttttcagtgacataacagctttaaattcttaaagctatttaatgagaagagagtagatgtattagtctgttctcacactgctaataaagacatacctgagactgggtgatttataaaggaaagaggtttaattgactcacagttccacctggctagggaggcctcaggaaacttacaatcatggcagaaggggaagcaaacatatccttcttcacatgggggcagcaaggagaagaatgagtgcccagtgaaggggaatccccttataaaactatcagatctcatgagaactaactcagtatcatgagaacacgatgggggaaactgcccccatgattcaattttctccacctggtcccacccatgacacatggggattatgggaactacaattcaagatgagatttgggtgcggatgcagccaaaccatgtcagtagaatttataatcactgcctctagagaagttgacaaacctaaccaacagctataaaaccaggataactccagatgtagggctctcagatgaggtcatctctactgccttgggttatggacaggtagaaccctgggaagaccattccaagatagagtcttcctgttcagttagacatgcaggagctcagaggttcttgtaaaattggttctgcttgctgctgggtgggaagggacagtgccttagtaatgtctccatctgaaaacgtatgaaagtttcaaaatgacttttaggagatacagaggatgtttcaagatttgtcacccttgtgcttctcagctgttgttgtagtcatggagtttatagtacatgtgcttggtagaaaaaattataagtgttcttccttccatgtggagttcctttctctttccttttcttcctctgagttttaaagagcatgctcaaatgccacctcctttgtgtactcttcagactctttcaggcttttctgattcattatacatatgtccatgacagctttttaccacaaagtataagtaattacaggttttctcttccactagtctggaactctgggctatttattacttatttttcccctgattatttcttttccctaaccctaggttcctaggttagaagacatattttctaaatgttgaatggatggatgaatggatggatgggtggggtggatgggtgatggatgggtgaatggatgggtggatggatgaatagatggatgagtgggtgggtggatgggtgggtagctaggtacatgagtgggaatgtggacagataggtgcatggatggatgaatggatggttaaaaaatagacaactacactgctcttaatttcttagcttgcttaaaagaagaaatatatgcactgattttcttcgccattcttgtcattttcttttgcttgaaagttcttgtgcatacaaagatatggtctatgaagagccattatgatcacattgtacacacctttcttccccactgaaaagtatctttttaccaaaatgtaagtttgaagttcttgtgtttctagcctcacataaatcccttttaaaaaactcctcagatatgctcaagtgtctggagaaatagcttatcctaaaaacagtcagcattgcaagggttgccaaggggatatatttgttcttcagtattaacttcattaagagctactgtggttctctctcaggagagaagaagaaacctaacctttctttggatatcttctgatctttacaaattatttccagggtgctgtctttgttagacaaaatatgaagaatatctatttttttatttatacatcatatcagaacattaatttgtagagtgattccctctgggtgcctttctgttgggtacacaaaaaaggatttggatgcaaatgaaacaatgatagcatttttccttgtcttactcattttgtgacaaatgcacattgctttactgtttgctatacacataattacagttctttaatttatgtttcaataaaatgtataataataaacatttactgctccatgaataaacattcgagtgaagcctctaatggaggttacatgtttcgaggcagctctgtggctttttcagaaatctgccttctacttaatgagcatcatttccataatctgtgcattattgcttaagcctccctttaaaacatttcaaaatgcaaaaatttgtgaaatatgatcagtccaaaggggaaaaaatgttaagggaattagcaacttgtcctgttaaagggacaggacaagctttcatgtccctccagagacagtaacatagtaattatggagacagcacttcctaattatctcactagctgagcgcaatactactgtggtttttgcctctaagatctggtttaaataaaagtgataagaaacctggagaggtcagccatgaaggacaagcttgtgctaattctctttccagtgctaacaaagaaaccagaaagtagaaccagaaatttggggaaggtcaagatacctgtggtatggacattcctggatgtagagacagacaaatggtttgattaaaacggtcaccccaaagtaactgaattcagacaaaagcctatgctgagctttatgtcgatggtgtcacacattattttcagtgtgttatttcttaggaaaattacttacataattttatgtcattatcactttaaaaggttaatctatttcagataatctttgcaaattgtgttctaaaaagcaggtgcttttaaaaataactaaaacatgatgacatatttcttttttctttgtccaacagccatggctgggttgtttaactagagagaaaaaaagatgccaggagaaatgaaggaacaaaggacccttcacagtgtgataagatacagatagtcagcctctgcagagcggtgatgaaatgtgttaaaagtgatggctgtcacttcatgacatgtcagcgtgctttattggtgggttggcacaatttatttaaacatcgtcaggagggactcattttggtgtagttagaagttgtgtttctttagtgtgaataaatatctctgggcccacgtgcaacattttaaaactgtgctgttgtttactgtgggaattggagcaaggagctaagagttccaaagtgaagctctccttctcccaccattttatgatttgctataagtaatttgctccttgctttgaccgttactacaaaatctttcaaaggaacattattctccttaacaggggctaaatttaagatttttcatcattcaatattgctattttcacatgtgacttcaacaaaataaaacattcggcataaatagaatttagtgtaatccaaatcctgcttttctcttggtacatatgctttgttgcttcttgacattcctgaattacaaagtattaagcagaatcatctttttaagggttacattttccttctaactcaagtgagcaggtatttacgtcaaagtcacacatttaaaaatgacatcctcttccagcatggggcaaatctcaacctacagggctgccaagtggagctgcaactttttgcaagggttctacccagatgtgctacaagtccatattacctttgaaatcaccatcttgtaaagatatctgcaccctcatgtccactgcagcattatctatagtagtgaagatatacaaacaatgtaaatgtccatcaaaggacaaacagattaaaaaatggtatataataaatacaatgaatattattcggccttaaaaattaagagattctgtcatttgcaccaacaaggatgaacctggaagacatacactaagtgaaataaaccagacacagaaagaaaaatatcacatgatcttacttaaatgtggaatcttaaagtaaaatatatagagatagagaataaaacagtggttatcagactgcggtggaggttgggagggcagaatggggagatacaggtcagagaatagtaagcagcagatttgtaggaagaaccagtctagagatctaacatacaacatgaagactgcaggtaaaactgtactgtatttgggattcctgccaaatgagtatactttagttgcccttgtcacaaaaacaaacacccaaaaaagtgagtaactatgtgagatgatgaatatgtgaatttgcttcattatagtaactattttactattttgtatatatgtcttaacaccatgttgtatacctcaaatacacacaataaaatttatttaaaaaccaacgaaaaagcacattcccttcataaatgagattcttttcaaaataagtttgaaaatatacattgtaaaatatactagaaaaaccaccccctaactaactccccacaacccaggagctctgatttgatagcttaagacaggataaatgactccgattaggacaatgagccccagttttatggggacctcctaaatcatatctcggtttgggtctagaatgatggtgctgggagcacccagagagctgcatatcatctcagcctggcttccacacagggagccagagagatttatggggccctgtctggtggctttgaggcacaaacgatgaatactgctaaagcaataacaataaaagaggcaacagacagtgggggaagccccagcaccaaccctcatttttctcataatatactctgttgtacaatgagacagagtgattccataggtaccagccagaaattacatgaaaaattgatcatgtttctttttctgggtgatatcagtgattgaggcccttgatttatgctggccaaactttttcagtgcagaatggaacccttcctaacttcagtctccgtggctcacacagactggccattaacagaagacacactgcatcataccatttagtcaggaccctacactaacagagggaactgcagcagagtcttaatagcaactccaatttgccaggaatctcaccacagatcagaaatttacagtggcggagaccttttaggaactttcagcatggatgctccctcaaggtgtgggtcagaatttgcggcgcaggaggtgaggtgaggtgaatagtttataatgatttttctatgccttttaacctttggaattaacatttggtcaagaaagccaattgaaggctaagtgtgtacttgacatgtgaaaaaatgaatgtgtcttctaggcgttggcttaggacactgctgagccctggctacagccaactcaggcttaactcattaaggtgattagccaacaatcaattctttaaaattagtaacataaaacaggccataccaggctcatggatataaaatttgggtatcaagttttgctccagagaaatgtcacaccctcaccggcaaaaagtctatagaggtagggagtgtcacaggtaaggttgagttaatgagacatcctctagctggcatgaatgtgtaaagtgcgctccatggtcatacatccagcaagtcaggatttcacagcaagcatagctttcactttaagctaagtgacatggaaggttcaggtccttaaccttaggtcacgggatgacaatatacagaatctgcagcttgacagcctgggcttaattcctagtcctgccactttccagctgtgggacctgagatagtcaacacctcagagcttcagatttcttgtttgtaaaatgaacccatctcagagggttgctgtgaggatcaaattggttagtactgcaaaatacccagactagtacttggaacttagtaagcatagatgtaaggtgtttgcagctatcattgctgctgccgctgccacgattattagtactacaactacttaaccacaaaatctgtgctacttgaccacaacatctttcagttaaaaaaaattcacaatttatttttttaatttaactttctcttaaggactttaccattgttttaaaaattactctactgaagtctaatttactaaatgggaacaggtagaagaaccattctcctaaaaactaatgtggagtcaatatacttatcctgggcatgaagaaaccctggagcttccaaagaacacagtgtgaaaaactttgcttggggagggagatggaaggcagagaacgagggtttctcccactggggtacaaatccttaggaagtggagcttggtgattaagagcatcgagctctaaagtcagatgagctgggatgaaatccccaccccaactttcatttcctgtgtgacctgtgaaggcagtcgaatatcttaattctttgggttctatatttataaaatgcagataataaagtctattcttcaaagggcttctgagaggattaaatgaaataatacatgaaaacctcttagcaccgcccctggcaccattagaaaatgccttataaatgtaagctgctcttctagttacttttacccagatctctgctcaagtgttacttccatagagaggacttccccaatttctatattacatataaacagttccggtcctatctcaaattaaaatctgcatttattcactttttcattttttgttcccatactcacggccatgatcccagcatctgtgactatgactagcacttagtaggcacccaataggtatgtgttaaatgaatgagttaaaaaggagagacaggaagtatctctaactcaatgttaagagactgcaaaaactctattaggctgaaaactaggaagtataattcttcaaagtaataacagaaataaaacttgaagacatgttcttttgtgtatgcaatagtgtatgctgattgttctcaagctgccaactacccttaacagtgctctgctgtgaagacacaaaaggggcaggagggtggatcagacagacttcatatgagccacaatgcaggtccagccaaagtagcaaggatacagttggaatataaatgcctttacccacctctcactgttttcttctcctgaaaattgctctacattatgatctctctctctttctctatctcttgtctcatacttggctttcctctgtccatgcaaagggcctccttgtgatatcccacattctcttttatcctgacacattgcatagactcctgttgtgggtactgtgtagttatataaccagagttgggatgttttactgccttgatgcttgcgttgtgggtctgtgtaatctttgcattcaaagtgtgataacagacactggacatagcgcataacactcagagctgcactccaggtactaagatgtcatgaggcccacgagagagatgcacatttctgcaagggcgtcaagggacccaggagaggaaggtaaaagccactacgaggtcctctgagggcaaacgctccctgctctctcctgacaatgatccccaatgcatgaagtaggatatagtgtgttaaggtgataagggctgaggatgaagtgggttggctcaactggcaaagcactgtgaactggaaatgtgttagtgtgtggaaaagcaatgttaccttggatgagagctcactcctctcgtgaactagacttttccctcaagtgccttcccccataatacagtcagtaaaatcttctaaagccctgagaactggaatcatctcacgatctatagtaacccaaagtggcctagcaactaggggtggaccctgttaactattcacatcgccaccctgacaaaagtcttcctgctcccatttcaaggctctctccacacttggtttctctgacctttctgaacctttcaccgtatcttgctctctggactgcagcccctggctgtgaatacatatttagtctctcagcctgcccttcctatagacatattatttgatgcttatgcaaagatcacccttagccttcatctttccatgcctttgccatacactaccttcctcctccccacactcctgtagtcagatgtgatgcttcaaactcagcttgagcgcaggtctcattttcaccctcctcatacgcctgtggacaagtttgtcagaccattggttaaatattcgaccaagagtgaggttggtaaaaggaaggcatatttacgagacagaacaaaggctttgcattaaacaaaacaaaatggcagttttccttcttgctgaaaccctcacttggatattcctccagaatcagagctttccaagactccacatgattcatcccctctcccatacttagctgtctggattacagcccttagttctttttttattttttagagacacggtcttgctctgttgcccaggctggagtgcagtggtgcaatcatagctctctgcagcctctacctcccaggctcaagtgatcctcccacctcaggctcccaaaaagcttggactacaggcatgcaccacattggctaatatttttttaaattatttgtacagacagagtctcactatgttgtccaggctgctctcaaactcctgggctcaagcaatcctcccacctcggcctcccaaagtgctgggattacaagcatgacccactgtgcctggcttcctagttctctataggagtctctaggttgttctgcctgagagattctgatagttcagctagtttcaaccagaatgctgaacccattattttgagcatgaatctgctctcctgttatattactaagaagaaaaacaaggtattccattaaatctgtgggcacatcctcaaaagcacatagttttgccgagatcttacacctgacaatggaagtgcttgcacgatgcaggtagtaaaacggaaaataggaatcaggaagctgatcaggaaccagctcagggctttgaaaaggagaaggccagtgagcgcccaccatttgcaggttgacagagtcaattttttttttaaacctgggctcaaagagagattaggcagctggatggggagcagactaaaaaatatgttcacctttaaataaatcagcaacgaaattggaggaggattatacctcagggacaaaagaggaagaagaacatgaatacctgctttacttgaaatgcctcccttctcccagcctttcctgcatggagtatgacaagagaggcccttggtaaccttcactttaattagaatcattaactgcaaatggaagtaagaacaactcaactctccttgtctaattacaggggctaccttactcctgtctgtaaaaggcaccaatattgtcctatgaggccctggcatgaagactttgctactctctcaagtaccaagaacagccttggagtggaagaaagaacatatttgactctaccatggaaattcttctatacctcaacatcattccttcatcatactcacatcctggcttgacagaacttatgtatccctgaaagccaaaggcagcttaagggacaggatagtggagaaaaatgcagccctggaactagactccttgtgcatgcatcctcatcacaccactgactgctacctggagcaaattacttcatatctccagattccagtttcctcatccgtaagaaaggcacaacaccactgtctacatctcatcatagtttttccctgacaattaataatacattacataaaataaatctttaataaagtcctaggactcagtactaggtactgtctaaatactagctatgatttaacatttttattggtaaagttttagaaacacttgctttgagattatggattcaaaggaaggtacaaaatagtacagagagatccctggtagtgtactcttcatctagtttctcaaagtactatgctgacatagtttataaaatataacatacctatagtacaatatcaaacccaggacactgacattggtacaatgcgtgtgtatagttagttcaatgccattttatctcatgtggagattggtataactaccattgcgctcaagatacagaatgaatccattaccacccaaatcaccattgtaatcctttggggaggcactcctgttccttctcctccatccattacaagactggcaaccccacaaccactaatctgttctccacctccacactttcgtttatttttcttgaatggtgcaataatatgctgccctttattaaacatttttttcttttttttttatttaaacttttattttaggttcaagagtttaagcgcaagtttgttatatagggaaattgtaagtcacaggggtttcgtataaatattttttcatcacccaggtaacaggcatagtacccaatgggtaattctttgatccgctcccttcacccaccttctacactcaaatatgtcctggtgtctattgtttctttctctgtatccaagtgtactaaatgattagctcccacttataagtgggaatatgcagtatttggttttctgttcctatgttaatttgcttaggatactagccttcagctccataaatgttgctgcagaggacatgatctcattcttttttgtggctgcatagtactccatggtgcatatttagtacattttctttgtccagtctaccttggatgggcttttaggttgattatatgcctttgctattatgaaaactactgcaatgaatatgtctatgtatgtgtctttatggtaggatgatttattttcctttgtgtatatactcagcactgggattgctgggctgaatagtagttctgtattaagttgagaaattgccaaacaaccttccacaatggctgagctagtttacattcccacaagcagtgtataagcagtccccttcctccacaacctcaccactacctgctattttttgacttgttagtaatagccattctgaatggtatgagatggtatcttattgtgtttttgatttgcatttctctaatgattagtgatgttgagcattttttcatctgcttgttggcctcatgtatgtcttcttttgagaagtatctgttcatgtcctttgccaacttttaaatagggttgtttttgcttgttaatttatttaaattccttatagagtctgaatcttatacttttgtcagatgcatagtttgcaaatattttctcccattctctaggttgtctgtttactctgttgatagtttcttttgctatgcataagctctttagcttaattaggttccatttgtctttttttttttttggtcacaattgcttttggcatctttgtcatgaaatattttccagagaccgtgtacagaatggtatttcctaagttatcttccagagtttttacatttaagtcttcagtagttttaggttttacatttaagtctttaatccatcttgagtttatttttgcatacattaaaaggaaggggtccagtttcagtcttctgcatatggctagtcagttattcaagcaccatttattgaaaaaggagtcctttccccttttggtcagctttgttgaagatcagatggttgtaggtttgcagctttatttctgggctctctattctgttccattggtctgtgagtctggttttgtaccagtaccatgctgttttggctactgtagccttgtagtacagtttgaagtcagataatgtgatgcctccagcttcactttttgcttaggactgctttggctattctggctctttttagattccatatgaattttagaataaatttttctaattctgtgagaagtcacgttggtagtttgataggaacaggacagaatctataaattgctttgggcagtgtggccattttaacagtattgattcttcctatccacgagcatggaatgtttctccatttgtgttgtctctgatttctttcaggagtgttttataattctcaatgtaaagatctttcacctccatggttagatgtattaggtatttttttgtgtgtgtttgactattgtgaatgggactgcattcttgatttggctctcaccttgaatactgttggtgtatagaaaaagctactaattttttacattgattttgtatgctgaaaccttgctgaagttgtttatcaaattaaagagcttttggacagagactacagggtttcccaggcataaaatcatatcatttccaacagatggtttaacttcccgtcttgctatttatatgccttttatttctttctcttgactgattgctctggctaggacttccagtactatgttgaaaaggagtggtgagagtgggcatccttgttttattacagttctcaaggggaatgcttccagcttttgttcatttggtatgatgttggctatggatttgtcattattattttgaggtaagttcattcttccaatgcctagtttgttgaggatttttaacaagaaggatgtctaattttatcaaaaggcttttctacatctattgagataatcatgtggtttttgtttttagttctgtttttgtgatgaatcacatttattgatttgtatatattgagtcaaccttgcatgccagggataaagcctacttgatcatagtggattagctttttgatgcgctgctggattcagtttgctagtatttggttgcggatttttatatctatgttcatcaaagatactggcctgaacttttctatttttattgtgtctctgccagattttggtatcagaaaaatgctggcctcacagaaggagttagggagaaggtcctcctcctacatttttcagaatagtttcagtgggaatagtaccagctcctctttatatgtctagtagaatttggctgtgaatctgtctggtccgtggctttttctagttgttgggcaatttattactgattcaattttggaaatgttattggtctgtccagggtttccgtttcttcccggttcaatcttaacaggttgcatatttccagaaatttatccacttcttgtacgttttctaatttgtgtgcatagaagtagtagtaatagtctctggggagttttttggtatttctggggggttggtggtaatgtcccctttgtcatttctaactttgtttatttgaatcttcttttttccttattagtctagctagtggtctatcaatctgattaattttttcaaagacccaatttatggttttgttgatcttttgtatggttttccatgtcttaatttcattcagtttagctccgattttatttgatgctctgagggtttgattatggtataagaggttcagttgatgagcttcatttctggaagatttcagggggccacggcttagctcagcactcctgggggagtatgctgcaaccctgggggggctggtaccagtcccccagctttgttctctgcccctcaaggttaagaacctgctgtgctggaggggcataggtgttccccatcttctggaaacaacactctgacagaggatgctggccaaagcacttcactggggcagtggcagcaggatccatgcttactagcatgtgctggcaacagtggcagaatggtgggtgtatgccaattttgtttttttgaaaatctatataaaagactcctatattatctgaccttttaaagtgggcttttgtcatttaacattaatgcccttgagatccatacaagctgttttgtgtattaatagtttgttcctttttattgctgggtaatattctatggtatagatgtaccactgtttgtttaaccattcacctgctgaagaaccttttgactgtgtccagttttcagctactataaactacctgtgaacattcattcatgtacagatttttgtgtacacataggtttccctttctctgggataaatgcccttgggtgcaattgttgggtcctatgataagtatacgtttggtttttaagaaatcactcggccaggcgcagtagatcacacatgtaatcccagcactttgggaggccaacgtgggtagatcataaggtcaggacatcgagaccatcctggccaacatagtgaaaccccgtctccactaaaaatacaaaaaaaaaaaaaaaaaaattagccgggcatagtggcatgtgcctatagtcccagctacttgggaggctgagtcaggagaattgcttgaatttgggaggtggaggttgcagtgagctgagatcatgccactgcactccagcctgggcaacagagcgagattctgtctaaaaaaaataaaaataaaaaaaaataaataaataaaaaataaataaatcactattttccagagtagtagttgtcttctatatttccatcagagagatttggtttctgttaccctcaccagcatctggtgctgtcattttaaaaattgtcctaatgtatgcagtgataactcatcatggccttaatttgcatttccctatgggctggtgacgttgagtatcttttcatgtgctacgtgccaccctttattatcttcaatgaaatgtctatttatgtcttttgtccactctacttgtattgttcattttttctatcataaagttttttttttccccacagttccatgaatactatagactttttttcctttttcaacttttattttagacttgggggaacatgtgcaggtttgttacctgagtaaaggtaactactgtgtgaagctgaggtttgggggatgaatgatcctgttacccaggcagtgagcataggacccaatagttggtttttcaacccttacctcctcttcctctccctctactcaagtaatccatagtctatattgttaccatctttatgtccatgagtacctgatgtttagctcccttttgtgagaacacacatataccagagttttgagaattcattatatcttctagatatgagtccttcatcagtaactttttaagtttcagagatcctctctcattcccttcaactacgagtgatctcttctttccctaacttctttacaaattttcacataggaccttttatcctgtctatcttgagtctgccatagatggccctccctaactgcctcactcatctatgaacaggctctatttctgatttgtcatcactcagtgtcttgctaacatttgggcacctatctggcattccactaatgtccaccaagtgactgaatcaactatacctggattttcattcagttactataagacttcagcctaaagcaaaagccacggttaccatggatacgcaggcttgggatagatatgtatcctaagcatttaatactttggaaaggataactaattacaaaaagaaatacacacactcagatgtgttagtgattaatttcttctcagctaccacacttctagctaacgctgtgacacactaacgtttattgaggagtttctatttacgccaacctggggctcacatttggctaattaagaacacatacatttcagaacttgtgatctgtgggctgtgtttacatatgaacatcatattcaatacacaggcaattgtttagcacctctaacctatttctagccttatatttaattagtgagaattgctgatggggaacgcagggtatgactttgcattaaacaaacagctatcctccttacaaatcacaacaacaatgcataattaaacaatgagctacctgagctttattcagtctttcttccaaaggaattaaatctctaatgaggaccaggcctcaggaggaactgcagaaggaatagaggtaaggagacataggggtcaattctagccctgcttcctggcctttctgggtcttaatgtccttattgtgagatgaggaaatgaatactcctccctggctccccatccttctcttcttctctctggtatgcatgttctaaagatcacatgcaataacagaggcaaatctctttgctaaagtaaagcataatataaaatataagaattgtcactgctgtgagttaagaggatttcattatttttacactggagaagaaaaacaattgccattaaacaggttctccatgacctgtccccatctcttccctgccctcatcacctgtccttcctctccctgttcacatgtaccagccacctgaccttgctttgctccttcccatcatatcaggcacatgccagccttgggcaaatccccctcctcatcaaagcctttccatgaccgatcctccaattgaaactatcactcactcccctcttatatcacttcttttaatacagtcagagtacttgccactgtctaaaaaaactgtttgtttacttgttttcttttcttttcttttctgcttttcctactattctctcctgcttttcctactactctccaccagaatcaggagcagtaaactcaatggctctgtcttacttccatgctacaaactcaggtgagttcactgtagcctccaggagggaaatgtacattatgttctctgggacaaagctcccaggcaacaggcaaaaatgttccttttattctacacaactttggaaaacacctctgaatccaacgttgagagccatcatccttatgctgagtactcaagagctcccaggattctacagcccataaatgagacaatttgacaagagtcactagtggtgaccacagtaatagtattaggatgaaccacatgaaatcactgagattcactgttttggccctaaccactttcatatggtttggcatagtaacaacaatggcagcaggagcccttgctacatgccaggctttgtattaaggctttaatagatactagttcattcacttcccaccacaatcttataacctaagtattaattacctatgtgttatgcatggaaacagcaaggcttaggaaggttaagggatttttccagaggagaggtggtagcatcaggtcacaaacttaaccccgtattatcctggaagagctaatgtgtgttcccttcctagggaccaccatgaacccacctgggttctgtgcatggaaataacacagaaatggaagttgctgttttttgctttattgcctccacgactttgtagccattgctgttgactgggaatctctaaattacaccaacactcagggtcatctgagttgacaactttcatggccacggccactacgcccaagaaaaaaataagttggaggtaaaatggggtataaaactatcttctagcactttctgctaattgtcttttacccagacaaggaactctgaaggactctgacatcagtttgcgatgcctcagctacctctgtcctttggccatctctgacccttcagccaacttgggaccctcagtcctggtaagagatcatcaggccttgtgccccccaccccaccatcttggtgagctgactctttcttgctcacaccatacctaagttccaaatagaactttagggcatctgagatcccacacaggcctccccactgctgggatcaatgataaccatctcatggaaagcctcttcattgagatgtccccagttacatcaccccaccagcccagcattctcctggctcacctctctccagccacagaatttgcatctcacagctgagaaatgggattggtcttctcctctctccatgtctctgaaaacatcactcaaccaccttggctcaatagtctcctgcttcaaccagtgccactgagcatgccaatctctttttgtcatgttgacatcatgtgtggccttgatttgcctcccccaaattcctcctaggatggcccttctcacagccttgatctcatcctgggcacctaaaggggtactgagaatggtccctcccacagctttgactgaaagttcttggattccttctatatccagtcaatttcactaccttctactttagctacttagtcttgcggatgtttgaattttttggacactggatttttttcatcgtataaatgatttcacatcccaaatctgacattatgtaacacctctttcctgaacaacctgccgagtttgtctataagaccacccacactgtgcattaagttcaccaggtataaaacataggtggccattgcaccaccaaagccagtatcccagacacagtgggttggagaccctcgggacatgcagacatctccccactcccagtcagccatctgactctgtggagtctcctccctctcttgttaccattcctcagttgtgccaatgtgacacgccacttccagactctcacctcccctgaccaaagctagaggcatggcctttcaatgatctcggcttgtggtctcaccatagagtctatatgccacattcctgctcaacatctagaggtgtcacttcaagctaccctcccattatagggtattaagctctgaagttagccagtaagggggaaaacatggttaaaccactctggaaagatcccttaaactgaccaaccttcaacaaatctgaaaagtctaatttctttttcttggaaccaagcgctggttctgcatttgaacacaagttggagtcctggttaggatttggagggctagagggtgcaaaaacgtccttatccattagggtcacactcatcacagcaagatgctccccttgtggacagctgtgtgggacggcagccagtgaagaggagactagccactctgaagcctacgttccttgagtagaatggtccacaatctaaatctaggggttcactccttctctccctctgcatttgtctctctttccatgtctgcttgtgtctgtctctccaccccccgaagtgtgtgtctgggtgtttctctctgaatctcggtcccctagcgtatgttgtgtctgtctttatgtacgtatctgtgtgtacctggctctgtgtctctctcagcatgttactgtgtttccatgtgtgtaagggtaaatctcccctgtctctatctcttcttgtctttctctgcatctgtccctgtctctacgtgtgtacctctttcttggtttctctgtggctgtctctctgtttctctctcggtcttgatgtctctctgtgtgagtgtctctctctccttatgactgtcttcatgcgtgcattgggtccttgtgtgcatgtcctcctcctccagtgagtgtctccctatgcacacatttcttgaggtgtagggctctgcaaaacacttagagttgacccatttcaaatatgttagccgcacatgattcccggccaggtatgccagcgctgccctcttctgcattgccacgcagacgcctaccttggtcgaaacacttgcagacatatctttagcaaggtatctttcctcgtttttccccaacaaaactcatgctgtaggaatctccaacatatacaatgaaagagtattgagctgccatagataaattaagtactgtgctcggcctcccactcagcaccaagaggccaaacagaatctaaaaccactgctgacacctagcacaccaaacctttccagcctctgcaactggcattctctgcatgtcaaaaacctctgaatcattctgggtcaagcacacatgcctcctttcacaaaggttctgcaaacaggtagcatcctgtaccccgagtgtgtgcctggtacctactggtgtacccccttctcattgagaggtcctgatgcctgtggtgtgagtcagtttgagtgtgttaatggagtgttctgctttcaaggccaaactgcataagcagagcccatccttttcccttcttttgtgcccagatgggaggaatttgtgaaacttgtattccagtgttaatgctgaagttgggaaatggctcaatcaagcaatggcagtttaacttgaagagtgcaaaggagaagagcagggagaaaaccaacactggaagcaaatcagaaggccagaaaccttcatgggcacttgcactattgtttacagccacaataatcatgtaagggaacccagcatttttcagaagttattttgttctgtttttttttcttttttttccaaatgtgtgtttgtattgctttgtttaaatataggcctgattcattcaggcttgggtctgaagatcccaggctttcagaactcaacaaagctttcatcatttgcaaataattcaactcaacaaatatcatttgagaaaagctctgtgctagtgcttcttgtagagacacaatgaagaaaaaatcacggtccctgctctttggagacaaataacttaggggaaaacacacacacctctcaactctcacctaaggagtgctgtgcaaagtgctgaaggagatggagactcctctcctgggaaaatctgcaattcgaaactcaaaagaagatgaggctaagggccctccaggtggaggaacagcctgagtaaatgcctagaaaggaatggcacatagtaggcacttgcaatcaaagctttgctaaatgaatgcatgttgaacatgttccagaaaactcaagaccagagtagcactgagaagtagaggtgtttcagggcttccttttagaaatttcttatactgaaggtttcagaatgctaggagggaccagggagatggtttattccaactggtttcttttgaaaacgaagaaaccaaaaacccaagcttacatgctagggccagaaatgagatgagaactcagaactgttccagaaggtaatcactttgaatttaaatgcctactcttctgatctcaatttaaggaactaaaacaaaatcagcagtactgtttgctagttttctgtgaatcattcagaccctggagaagccagcttcacttttgaaagctgagctgatccacttacaactgtgtggctaggttcccattactgagtctcagtcttcacaactgtaatataggaaaaacaacagtagctatcgtacagcgtagttgtaaagattcagtgagatcatgtacaaaaacagctcttaacaaggtcatcagtgaccttcactttgccaaactcaatggacattttttgtccccatctcactagacctctgggcagtggcatctggcacaaaggggctgctccttccccaaaacaccccggcaccggctcctgggatagccttctttcctgctattctttctttctggatgttcctcggtctccattgccaagtcctcttctatccaatttctaaatgttggcaaactgcaagagctcaattctatatcctcttatcttccccagcgacacacttttctcattgaacccattcagcccctccgctttacacaccatccaaatgttgctggcacacacttttatatccctagctcccacttctccgctggttgtcagactcaaatatcaaactacctgcttgagatctccatgtggaagtcatagaagagtctcaacccaatatgtcaaaaactgaactctccattgccccattcccaaacttagtttttcctcacctgcttaaatggtattgatactcaaccatgacttaagccagaaatctaagagtcattcacagcacctcctctccccctctcccaacatctgccatcaggtcctaaatttcatttgtgatatatatgttaaccgtatacgtttttctttatttctaccaccagcactgtctctcatctgaatgacggcaatcacctcctaactccactcctgtatctccacagtcagttctctgcccagcaaccgccatggtgtgtaacaaatgaaactgatcccagtactctgtgttccatccatcagtggcttcctcttgttcatagaataaaggatgaaacctgaaatacttcttcaaacttctccaggatctactcacaaaaatcctctggcacagctctcttcttctatcatttggctgcatttctacttgcctatttttcatactcggaacaatcatgctttttgtagagccagggccctcacatgtgttgctcaggtctttagtcagcaaactcttcttccttaatctagtggttaaaagccccagctctggagtcaaactgacaggggctgggtgactaaagacagtcttctggccaggcatggtggctcacatctgtaatcccagcacacagcctcccaggaggatcacctgagcccaggagtttgagaccagtctgggcaacgaagcaagacctatttgccaaaaaagaaaaagaaaaaaggccgggcatggtggctcacgcctataatctcagcactttgggaggccgaggcgggcagatcttgaggtcaagagatcgagaccatcctggccaacatggtgaaacctcatctctactaaaaatacaaacattagctgggcttggtggtgtgcatctatagtcccagctacttgggaggctgaaccaggagaattgcttgaacccgggagggagaggttaccgtgagccaagatcgcgccactgcactccagcctggtgacagaacaagactgtctccaaaaataaaaaaaagacaatctccttagtaaaactatgtaccttactttaatcatctgtaaaatggggataagaacagtagccacctcacatagtggtgaatattcaataaaacaaaatgtgtgaagcactgaaactactacctggcagaagaaaaacactcagtaaacattattgtcaaaaatccctatcatcctttagttctcatcttaaatgtttctgcttaaagcactctccattactctaaccctcagttttaatccattttatttcctagtactaatctaaattggtcatcaaatattgattttgagacttattgtccatttctgcctctcaaattacactctacagaacagggactttgtctgtgtttccttcagtcctggaaacctggcagaggagctgaggaactgagctttacaggctgagttctgtgaccctgtgattattatgttgaagccctcatccccagtacctctcaatgtgactttaattggaggcaggggctttaaagaggaaagtaagttaaagtgagaccatcaagttaaaattatgccctaattcagtctgtctggtgtatgtataagaagagagggaatttggatacacaaagagaaaccaggggtgtgcattcgagagaaaagattgtgtgaagatagagcaagaaggtggctagctggatgctcacaagaggggcctcaggggaaatcaactctgctgacaccttggtctttggcttccagcctccagaacggtgagaaaataaatgtcttttgtttacaccacctaatctgtagcatttttgttatatctaccataaaaactaatgcagtcagtaaagactgatgagtgaatggatgaatgtgtcaacccagtgctcagcacaaggtaagtatgcacaaaggttgactcctattcctgaaataatgatgatgaatgtaataacatctcaggagcaaatctaaccaatgcacattgaccaagtcactgagaaaaatatgtctcagtggcacttacagtgcttttcacctgtaatactgaagtgaaatgtgattagctatgaagatctgagaccttcctttaggagccagcacatactactctatgacttctgtttacttaatttgtacatgttggaacttgactgttttatggtagactcttggctatacaacatggaacactagacatttccatactcagtaaacaaatatttctcagacatgacagcaaaactagaaatgagaatattagattaatacttccaaaataacagcctcatcgttttaatcaacatgtccttgaacacgtttgaatgtgtgtgtaactgtgtgggaatgtgagctacatgtgtatttttccactgaaggtgaccataccatatgcaagagcaggatctcaaattagatattcagcataggtagccatattatccacatctaccaactgtcttcaaattaaagcccttctctagctggaacatgtatctgtcactggaaagtaggcagtgttgaaaatcatgacaaaattggcacatatcttgatagttgcatcatcttttctgtggcagtccccagtaatagagcttcatctaattcagcaaactattagctcataataagaaacagcatgtgtattgattcttttaatagatcttggaattaatacacatgattcctataaaaggactgtataaaaaaaatcaccaagttgattattgcacaatgaggtctcactcaaatggcataggctacggcagaaaggtaggcaattcctcttttgaaaaaaactctccatcttacagactgattctctcctgaggaagaaaaaatataatgaagtgctataattaggtatctcacatgtaagggaagataacaaaatcaggaacagcaaataggtttttactgagtgtcaactccattcaattagctgcagctacctagagggttgtattaagaagcccaaggtcgacagtaaacaatgccttggtgaaataatgatgttggctagggttgcaaaatgatgagtagatggccgctatgtaatttctactctgaaacagatgtcactaaagtctcttccggggccaaccttctatgactctctccttttttctcctcttccctcactcttgctcttggagttgggatgaataagttagcatctcctgagaatcccaactttctcctcttatataaagtggtcaggctcagttttcagtatcaggattcaaagcagcaacctctgtcattacaatcatgtgtcgctttggtataggcattgaaaagctgtaccagggtgctgactgtcacttaagtaattagactaaactataataaacaagaagagatcactgctggagacccacatttgttaatgacctccagggtcctctcccctggcaagagatagacagatgaggtaccaggagtgcaggcctccttgcacgtataatgacaacagccagacaacaatgcaacaaaaatggtcccatgtcctgttctgtgtgtatagggagagtgatgacaatcatcattaccaccagaactaccaaatttcctctccagttctttgatgcttctcaatcattgtcggagctaccctttaaagatgtctcaccatgaacagttactatgacaagatactaagaagagagtgtttcatttaaccccttccatcactacccctatgagacatgattgcctttacttgacaggaaaatgaggttcagggaggttaaatgtatgtagaagattttagcaagaatattctgacttgaaatctatgttcttaatgatttaggataccagctcacaactcaaagcatgaagcatgtggcaatactataggaggtaagagatctcatgacaggaaactcgggttattcattcattcatccatctagtcattcatccatgcatatatccatctctccactcagtcactgtgtcaacagatatttaccatgtaactatctctgtacttggtactggggcagaggtgagcaaaacagataaagcccctggcctcacagtgttcacagtctaatgaaagcacaaacatcaatcagtgacattactgtgcaatcacaaattgagataatacttgaaaggaaagtaatgggagcctatgacaaagatctggatttggggtagggtcagatttaagaaaatgagacctgagagctgaactgataggcaagttgacattaattaggtggaaggcaggtgaaagaatggggctagagaactaataaggagataataacatatgtagaggttcatggaggaagggaatataaagtattcaaggagctatgagccagagcacatcgagcaggtcaatgagggaaagagtggtatgagaaaaacctggaaaggcagagaggaggtggaccatattaaggtgcatagggtggcagtggaaaccactgaaaaatttgagagagaggaagacagtgggtggaagaaaggggacaactgtgattgttcagacttcagtgaccacaaacaatacagggagcatggtgagatcagaatggagatgcagcaacctgtaacaggtcacttagttcagatcagagacacttggtagctttgattaggtgatggtggtagagatgagcagaaatggatggatttaagaaatattgtggggtaaaatctaaagcacttactgataaattggatttgggaagatgaggaagcaggaggcaaggataatccctagatttctgacctgaccagatagatgttgctactcactggctggcaacttcacaaggtggccttgttgactttggaataccttttgggcatcctagtggagtggcctaaaagggagttaggttttacatgttaggagttcagaaaagaggtctggggtggagacattatcttgacagtcagttttatagctagaaatggttgaggctttgggatagatagagaaggggtactttggaaaacaatgttcatggaaagcaataaacattctcgtcaatcactatattcttctaatacacttcttccttttgttatgagcatctgcatctttcttcctcttgcgtttcaataaaagcttctatttttaattacacttcccttggttctaatttttaaaagtattttgcatatctgttttatactatgtatccctataaccactccaacttttgtagaatgaggagagaggaccaattactagttttcagaagatccacatgagactccaaatggtcaaattatcctgacagcgaacccagcaaggaatagattaaatttgaatagtgcactcaaaaggactatctttgagactctaagacgattcttgattcattcatttcgtgaaagccaaaatgtccgaaagtggtttgcggatgaggggactgaatcgtgaatttgaggcctaaagaatttcccaatgttcagccttatggtggattaaatttaccatgactaattggaggattcaaagctgttaggaacactagctattagggccatttttctcatcttcgatcttactgcttgactgattcatagctggaactgctaggccgttatggaaatggaaatgcagagatgaagcagttcccaatgtcaaaaacttccagggacatgtaaatacaatacacgtaccaagtaatgagtttaattacttaattattagatactgagcactaaaatttaactaacacctggttccataaggaaaaaaatacttcatttcgctgtacttatagctctttattatgccttttgaattatctgaaatccactgatgtacgggtaaaaaactcctgcagctagctcagtgtctgtccaaatggccacccagttttgtgcttgaaatccaggaccccactggtgtaggcatctgtggggaatctcctggtctgtgggttgtgaagaccatgggaaaagcgtggtatctgggctggagcgcaccattcctcaaggcacggtcccacatggcttcccttggctaggggagggagttccctgaccccttgtgcttcccaagtgaggcgacaccccaccctgcttcccctcgccccctgtgggctgcacccactgtctaaccagtcccagtgagatgagccaggtacctcagttggaaatgcagaaagcacctgccttctgcattgatctcgctggaagctgtagcccagagctgttcctattcggccatcttgacagccaccaccccatttttcaattttttttatgacaggctaactgtgggctttcctaagagacatgagagtagtatccttcccctacaatcctcaggcctagcatggtgtctggcatataacaaataaatcaatgcagcctctcaaggaatcctcaaaatacagcagaatcattctagaaaacaattcatttcgattaaagaaatgaacaccatagagatgttccattggaagacttttgaaccaaaacatttaattcgccagtcctgaccatatctataacaaaaggaactatgtctttaacgtatttttcttgaaagccagttcatatggttgagagagcttataaggaatactaaaatagggaatataatcagccttctgtttttgagcaaaagtgctgtcaactagagatggggctcttggaaaatactttatactgcctgttctcagtttttttcttcttaagagctacttcatttcattgttcaaagtttagtgagagccaaaagaaaatacaatctatttacaataaacctatactttccagaatcaccttaaattatttctgctaactctaagcataaatcaaaagttctgaaaagcagaatggcctaaagaggaaatatgtcatttgtgtagttttgggaggggagggagtctgttaggaaagataaattattattgtcctaagcaaaaggacagctaatgaattcctaaatgacagggtttaatcctcaggcttgttgactacaaggttatagagctttcttcctttccattgttaaggagatatttaaatgtaaacatcttttctaaccttggaaggaaactgatggaaaacagtgagtattttcttggtgcaatttaaatattaaattcaaacttaaagcaattgttcacacatgcatttgctagctcaagaacacaaacataatctgtgggaataagaatcacaataaatgaaataataatagaacaactgaatccatcaatttttctagcatatatacactaagcaaatagtttgcactttgcataggattcagcattgccaatattttatttctaataagccaggtataataagaaaagcaaaatgtattggccaggtgcagtggcccatgcctgtaatcccagcactttgggaggccaaagcgggcagatcacgaggtcaggagatacagaccatcctggctaacacggtgaaaccccatctctaccaaaaatacacacacataaaaaaaaatttgctgggcatggtggcaggcacctgtagtccccagctacttgggaggctgaggcagcagaatggcgtgaacccaggaggtggagttcgcaatgagccgagatcacaccactgcactccagcctgggtgacagagcgagactccatctcaaaaaataataataataataataataaaagaaaagaaaaatgtattgttagtcttaaatattttctggttttaaattgagtcgaaaactcatggctcaagttcatttaaagtccaagtctgaattctaaaggttaaatgctagtaccgttagttcctcaaattattcacttgttttttatttttgttacatgagagagagaaggaggaggagagagagagagagacagaaagagatatcacagaattagaacttgaatctcattcagtggatagggatgagaagaaaaatgaacattcacagagcgcctaacatgtttcacgtatccaagtatcacatcaggaactttcatacttatgatttcatttattcctaaaaattaagtaactaagtttcagaaaaatagagtgacttgctaaagataattcagtgactgagtggtggaatcccagttttgaagatagagctctttgactccaagaagaattctcaatccataaagctttactacaaattagggaaaatggcttatctttaaaatagcgtgtgaataaataaatgagtaaagtttccatggggacataggcagcaaattaacagaacacaatttaaaatgttggatgtaaactaataaacagatgcatgtcactaaaacgtcacatttttcatcgtaacagtgtattatctgttggcaaagacctcagtaaagctgtttttatacaacagaagcacagctggctaaaaacagaacaaatgtggtcaaccaactaaaattttcaattcgttcaatgccaagaatctgcatggaatgacgttttaaataaaacaacctgaaagtaagctgacccataacaatttggtttttatctttaataactttaaatttttggttaatgtctctataaacagcctacatattattcagggtaaaggctcaaatatattatactaaaattgcttttagacccagaaaattcctttgcatggaggtatgaaaaaggaacatttgaaattagcttgaaatttgggtgtatttcagatatgacatgccattcacattcatgtgtttccattccccatgaacaatgggctgcgtgggccagtatcaatcatctattaatccagaactttccatactacctattagttaataaagtacattgacatccattaccccatgtgatgggatatttaacacacttccagaacatagaataaaaataaaggggtttatactttacctagaaggctagtgacttaagaattttggtgggaagtttcatccactagaggaaaagtcttatgattatgtggaaattatttatcacatgcccccaacaaaccccacaacatcacaatagacaaatagtggtgctcaaatagtgaacattatggaaataagggagaacatacatctctacccattcccaatagttttgaacttaggtatttataaaattaatttcatgatgctgcacataaatcttaattctaatgtgcataaacagaaaaaagcaagttgtataattattctgtgttattatttttaaaagccctatatatcaaaccaaaacaaatcaatataatgccaccaatgtgaatatcattaggctcagcatcttaaactcagcatgatatccatcgggccataaatttgaaggaaaatattcaataccagtttcataaatcatattaacattaggagaaaatctattatagcacaaagtcttattcaagggaaaatcatgttcataggaattaaacaaacaaaaaaacacttgtggccctctgctctattatccttaaattttaggaaataactaattataggagagttttcagtcatgtaaatcagagagttagcaaaacaatggttatattatgacagcaatcaataatagcatgcatttttattaaaacattactttctaaatttgtagggctttaaattgtctagcagaacacagcttgaagtatgatatatggatggaggttcatagaaaatatagtgtatgggaaatacagactccactcaggagatatatctgatttaaacacatgcatatatatgtgacaatatatatctaattatatactaaatctcacagaactacataaatatcttcttgcttgctttctacagtttctttaagaaaatattatttaagaggtgacaagtttcttgttgttgttgagcaacttgaattacttagtttcttgcagaactgtgtcttcttccagctagagtgtaaaatcacttggaatcataacatattcaaagagttttgtcttaacaaatccatgagtgatcaacttccttccatcctcaacaaagctgagaggtagaccttgccagttctaacctagcactggagtttaggtttattagatttagccagaaccttcaagtgattcttgaaatgaactttttaaagagaattaattaagcccaatttctagcctacatgattcccatgactatacatttatattagaattgatattcaaaactaactataaatatttaaaatccttttatcaacaaatgaaactagatcagcacagagaaagttgaactcaacttctaatttcctcctcttggctctatcaaacaagagcaaatcaaactggctgctaagagaactgatgaccaagacagactgggaaatgagacttctagggagtatgtcaccgtcttaaaggcctttctagactggatgaatagaaataactggcagataaaactgataaactgatttgaaaacatctaagtaaacatggccacatgcaaaggtatccagagaaagataattctagaatttgcagataaaactgctgaattgctttttggagcctgtgaagaattacagcagaggtattctaacaaagcagaggtattcaaacaaataagactcttagtattcaacctcccattgggcaaaaactagaagctggcacccaagagagaaagcacctctttcttgtcccccaagcatgtggcttggactggattttaccccaagtcccactgtagccagaaactttcatgtagggcataacctgtgcaactcacatatggttgtcctggatctaaatactgtataagaataaatatctctttatcaaaagaactaactacagctagccatgtgttacttaacaatggggatacatgctgagaagtatactagtatatttcacccttgtgcaaacatcatagagtgtactcatacaaacctagatggtacagctctctgcacagctaggctatatgctatacccttcagctcctaggttacaaaggtatagagcatgttactcacttaatactgtagttaatggtaacataatgataagtattcatgtatctaaataaatatagaaaagatacagtaaaactatggtataaaagataagaaatatggtattcctatatagggcacttaccatgaatggagcttgttggattggaagttgctttgggtgagtcagtgagtaaggggtgactgaatttgaaggcctggggcattactgtacatttctatagactttctgtacactgtatacttaggctatactaaatgaatcttctaaatttatgtaataaattaatcagcttactggaactttttaactttatcaactttaattttcttaactttttgacttttgtaataacatgtagcttaaaacacaaatacactgtacaggtatacaaaaatattttctttctttattctatttttaaaaccttttattttttactttttacacttttgtgttaaaaaccaacacacacacacacattagtctaggtctacacaaggtcaggatcatcagtatcactctcttctatgtccacatcttgtcccactgaaaggccttcaggggcactcaccatggagccgtcttctcctatgataacaatgcattcttctgcaatagtccctgaaggacctgcttgaagcggttttaaagttatctttttaaaaaaataataaatacactctaaaataacaataaaaaagtatagtatagtaagggtacaaactagtaacatagtcgtttattatcaagtattatgtactgaacataactgtacgtgtgatacttttatacgactggcagcatagctttgtttacaccagcactgctatgaacaagggaataatgcaatggactacaacgtaaagacagctacgacattgcaaggcagtaggaaattttcagctccattataatcttatagggccaccttcatacatgcggtctgtggttgactgaaattttatgcagtgcatgactactataaccttacaagcttgataaaaggcaggtaaaattctaaaatgcactgtttcagaagggttggtggaagcttggcaaaggtgttcacgaagagccagcatggctcccaaaggcacctcagtttctatgtttgttggataagcccagtagatccaaagaatgctacaaaatacaacatatagtatataaagctaccataattctgctttaggggaggatggagaagaaaagattagatgaacaaaggaagaaaagagtgaagaaaatgaagaaaaggagaaggaagaagaaagtctaagaaacataaaagaaaaaagaatggagaaaagatatcttagaaaatggaaaatgaaggaattaagaagaatcaggatatctgcaagttatatgacatactctctcacaatacctttgcgaagcatgtcattttcatctaacacagcagggctcaagcaagagtaatatagtaatattcaaaaagaccaggggtaggtagtcagttttccacctttaccaatatggaggaacactgatgtaaagaaaactatcacctatctttttagggaggcatttttagtgtataatcaggactttagaaggcaaactttctttaggctgtacccaccattgaccttaactgagaacacctctaccaaggtcagggggccaagactctccactccaggtgatgaaatcatacagtttcgatatgatttcacaatatgaactgtagatttttgataaagtaaaggcctggccagaaaaagggcagaaacctatatgaactttaaggtggtcagaaagctcagctctacttaagaaacacttttagactcactttagtaggctatcaaaacaaaaacaaaaacaaaaacaaaaaaagacacaaaaaggaaaaaaaaaatagttgtaccttcaagatatctcttgcaggaagcctagtccatcaagaaataaaccttcatctcccgattccaaaaatcagataccagcagttctcacaatgcctctagtggtaattctgtggttttatatcaagttctctatcctccccagagactcacagaaatggcatctcagcacttttaatccattactccccattaagtccattagttacataagcctagaagataccagtataggtcagcatgtgccaaagtgtgtttccacaagcactcaacgctgctagatgctaaaacacgctctgtgaacaaaagcgcttgctgtcaaatgcttttgagagatgctagagttaaacaaagctaaagttgtttatttgctgccagatttctgggagcctttcagatgccaatgcagcctgtggcagtgcaggaaagagaccaagaatgcaacatttcccacacattcttcactagggtctcttcatcttcgaattttgctgagcatcatcacagtcaactgctctaatgaacatattttgggaaatatacaaagaagaggtcagctaggtcatgtgagaaatccatgtttcgttcattgctcacacattaaattttctgcacaaacacattattctctgtgaaattatccttcactcgtagggaaaacaacaatagaagtcctctgcatctaaatccaaagggatctgagctgttctacgcatatttactgtgttgcttaagaatgtctcatggttctttcctatggcaatctccattccattattcaaaaatacaaattaatcacattctaagcaattgttcagtttccttcatttgtatgtggttgcagtctgtaagtgaaattccttaatttcttttctcaaagaaagcttctatccatacaaaacagtccccaaacccccaaattttgggctctaatatgagttaagtagaaaggtaaatgctaatgtttcattaatcctaacgcttgaatttcaccccaacctctgcagtgttctgctctctctgaagtgcttgtttgcttttcagttccccaaatttggctctggtaaaaacaaaacaaaacaaacaaacaaacactaatgggaacagtaactgtgttttgtataatttggggccattaccagctactttatgcttcatttgcgtacttgcgtgtattagatacattttgttaagttcacctaaggatatttccctcaatgggcacaaattcatggtgcctataaggtgactttagtacagcttcatcatctacactaatatttccagcagcccctcaaaagcgagatattttcttgaaagtaaaataacaaaacttactgtatgtctgatactgcagaggccacttaaattgtctataataagtccaaggaaaggatcgttgaagttaactggccttgggaatttcaagtacacctccctttgaaataaaaccatttccaaagaacgtcatgtcaaatgcacatctccctccagaaaattgtgttttcttttcaccccacccagaacataactgaatatcattttgctgggtagggaacctccctaacctgccttaagtctcatctatttccatttaaccatagttcccagctaacactacctctttcccaagtttacctctggcaagacaaaaaggatggtctttatgaacagatggtcttttcaaggtaaagtagttacatttaaatacagataaatgtactgtaaaaaacggctttaaaagaatttaggtctttaagggggaaaatatgagagcacaagacactattctttaattacatgagatttcttttttcttcccttgaagacaaaaccaattcctaatgaagcataatgaatcgtaaagaggcaccaatgctcatcccaacagatgtttattgattggtgttgactgaacacaaacacaagggtgttgcttactattgtcagtaagtggtgggaagcagcaccagttccccctggttattttacctttcaaagacaagctgacaaatttattttgtcacgagcagctgtgttcttatttttataagggttggcttacaactaagaaagcaagcggagggaacagccttttggtgtccaatgtgttatctggcaaggacagattgttttagggtgcaatggaaaagatttttaatgaaactacatttcaaacgagcagcatatgcttgattttcccttctgctactcatcctgccatttgttaatttttgttattgttgttctccgggactcctaaattttcatacaagctgtctcgtccggcactaacacagcttggggcgaattaatgcttgggatgcaaaaacctgcacgtcccactccagccatttttttttttttcatttctaaaatttctacattcaatcagggtttaaccggtgaactagttgacggaacaagcagggattaaaaaaaaaaaattcctcctctttgtgagtccttggagccccagagccagaaaatgtgacttcagaatatgtgtggacttgtcagcagctcagctgcacacaattatggggtcagagcccagattggaggtctggagaaactctgaaattgggaattaggacaaaatttttttctttttaacaccgtaatgccacatattaatttaaatgattctctcagaatgattctgtggcccagttaaatgaagttcaaggaaatgaatttcagcctttgacactctgagtcctatttgaaagtagtcggctttacaagattaaaaacaaattacagggaatacgaaatctttgattagcaggtgctttgatagctgcaagaatattttttctcaaaaatgtgaacacacatgggagaggcaccactattattatctttgtgtggaaggccttataatgaggattccattgtgtccagagactgaggacatgaattgctatgtctgaagggtcctggttcaagaggtgatttcagtaagacacagctgatagatagaacctaaggtttcatgggttcataaactctctttttttgctaacctcccataatcaattgaagaatttaagggactcacccctttctgtaggattcccttcataactaatgggaggcagaacttttcaacagagaaagagaatgctcgacatttttcaataccatgtgcatcaaccaatgggagaaaagggtcttggaagtttagacagagtctttggtcagctctgagctcaggaagactgaagtccatgtccaggttgccccattcactcattgtatgaccttgggcaagatacgtcaattctaaggagttcagttttctcgtctatactgtgggcatttcaagggtcactgtgcagatgaaacgagttaccacagggtgtggcatacagtaaaaacaagttaaatggcaacaaaatataatcagaaattgcaccaacgtcagtgccttattccatctcatttctcccattcagttagtttccaagttataagggttcaaccccttcatgctaggccctgtgcagacatgccttgctccatcacatgttcagccttgaatggataggaatgtccactgcttggtcactgttacagaactacacatatgagatgctccatcattatgtaactcatggaccagctagcaagatggcactagtgtcctagtgaggatgggtactcagaaccaagatattagagacagaatgtgccctgttaagttcagaacatataaagtaaatactctagagtttcagactaacttgatggaatattcaagaggcttgataagccctgaatggggccttgtgagacatagggccacttaaccttggacagtaagaatattattgccagcaactcaagtgtgtctctcatgaagaactggggctacctgtgaagcttggttcactagccatccccagactattccttggcatgtttggctgggaaggtatccttggcgctcactgtagtatcatacatttcagtagctctatgggtcagggttgatattctcaccaagcctccagcctaaacctctgagggtgcctattcttcattcctccagtgtcacctgtctcacacggggccagtcagctttttcctgcaggttccatcctgccccagattctgaaccaatcaaactccctgacaagtggaatccaagtcctatgagttcacagcttaaagtcttcacagcaagtcagaccaatgcctgaccctgctctgctcctgcaagtggcttataccctagtttagctcactgagtttctcttgtcttattcagtacaggtctcagtagtactcctgttcatttgggattggttttctaccttgtctcctcgaggttctctggaaaacagaagcaaaccagtatttgctggcccctacctagtgctttcatcaaattgatctacatgttgctcttcagtcacaggctccctcacttccgtatttttgctcctgacttatctcttcctcaaccccattctcaatctcagctcctctactgataaaatccctcccagttgaataccaactcttccatgaacctcagctagacagggtgtgtctccctcctctaactcttaaagtacttggtttctcaattctggtgcttctcactgcttcccatgatggcaattactgacatgtcttctctttctggttaaactcttgactgtcttccaaatgcatcttgccttatccactcgcatttcctctaatctgtcttccatcctaaccgtatagtgacgctcttgaaacacaattctgattccctctgtttctggccttcagtcatttcctaccatattaaaaatagagacttggatcccaaacgaagcctagaaggctttagttggccccattatctttactgccttatcttgcatttttggtcttctcttgccttgtgctcccaccacaccaacctctctcttctgccacaggccctctgcacatgctgtatccctccccaacctctgtctctgccttcactgacacctattcatcccttacaacccaattcaatcatgttttaaagaagatctcttgtggtctttccaactaggccagttttccctaagatatcctaccacaaacatgtcttctttatagcataaagatgtaattttaagttttttattaatttcctgctatcccactagattgtaacctccctgatggcaagaaccatgttagattttgttcaacatttcatccccataagttctgagaatatttatataatagttgctcaattaaatatttgctgattgaagttattttgggccaaagaccaggtttcatttttcttctcagcccactgatttctggcacaaaggagaggttccataactaactgttcaccaccaatgaaaatacaggtataatgtttaaaagcttcctatttcttcttgtggtactattaagtaggaccagagcagcagtacttcacaggggtagtgtggcatcttcaagtacaatgatttgtaggggataaagaaaagaaaaaaaaaacccacaaaactagtttgtgccacatataaggaagaatatggttctcttgggcaaaaatggcattgttttcaacaactgatatggactgcctcataattgctatagccttagcaatctatactggccataaaggcaagccaaagggaactgttatgactccagagagttaccattgcctgtctattaggccaagttgtaccccaaccccaaaatgacagatgatttgctacacagtgcccaagagaaggaagaataataaaagaaaagccgtgttctcattctgtgcatagttttgcctcacttcgtacagtaagtccaggagtcttattttccaaagtaaaaatggtgaaatttgtctttaaacactgcttctaaatgtgttggttagatgcttcatttctacaattaaacacctacctactggcttcagcaccaggtatttaggccatcctggcctagttccactgactattccagtgtctataaaacaccttcaccaagcatgagaaacaaacacagactttattttctacctcatctgtcttgcatttccttgtgcttaatactgtgacatttaagtggcagtgacacaatcagcaaacctagtgaaggatgagtctatgtaaaggcaaccatgtttgcgggcagagaatatcaactttatacgtacctaaatgactgctgtgtgcacagcagccaagcccaataaatgttaaatcacaaaactcacactataagctgaaagtgcctttaggtgtgtgaattccagtttcatgttgcaaagctacctaatattctaaggttgtcgggggagatatggaaattgagtctatagtagagagaaaagttctacaccaactccagaccttatcagtggtcaatataccaacccaacaaaagcaggttgcattctaccacggctattcattacaaataattttacttatattcagtgccaatgcccagccttctctagtccctgttctagctttacttttcttcattgcactaatcgccacttaacatgtgcatattttacttatttttttgtgggccctcattcccctcaaccaaaatgcaaactaagaagacagagatttttatcagttttattcattactgtatcccaagaagctaggatacaggggattctctctgagattatttgctggcaaatgaatgagattcttggcatttgctaggcactgttcctttcgctttccatgaattagaagaaggcaacataaatgaatagccaaaagcttgggcctcagagtgagataacctaagtcccaaaccttatgaagtgtttatcttgggcaagtctcttaaactctctgtgtcccaagtggctacctctaaaagggagatgataaaaaggacactacataaaagggctactatgaaatgtaatgagattataaatatactgtaagatgctttgcatagttcctggccacacagtaactaaacaacaaatgttagccattatttttattttctttctattatttttataattattaactattaaaataaaggtaggaactattatcattctctttctacaattgacggtacaaagaatgcttctgcttgaagttgcaaaatgttacaaatggttaaaaaaacattagagaaagagagcaggagagaaggaagagtaagaagcgttacaggaagaatcaagagatactagcctagaaataaaaagactcatcctggagaacttggttaaggtgggttctgtgagcatgtgggagcctggtaggtccagaatagacacttcttatagcagatctagaactggcaacgaactgtagtaagccaaagagtgaggtaggacctaacagattggactaggaatccaacctacatgacctagatttctgattatctggctccacttcctttaccgtcacagagagtaaggtctccagttcctcccctgtactagaatgctcccagacaacctaggtgattagtgagagtttaagttctctactctgaaggacttgggttcagacacaactcaatcacttataagcttagtgaccttggactgacccttaatttcttcatttgcaaaatgaggaaactaactgcatcttatcccatagggttgccatgaagataaaatgagatggctcccaacaagtactggatgctgtctggggggtaaaggaagctttcaataatcacataaacagaagtagcattcaacctggctgagcaaatgctttagataaaatcgaagttctttctcttccctgccctgactccccagaagagaataatatatggtataagcaaatccaaaaatacccgctaaaggaagttaacaatcagcaactatcattcttaatgtcttgggcaaatcagcatacttttcaaatacaaaaaacacaaacaaacaaacaaacaaataacacctcaaataattaagtactttatgaaaataagtcaaagtttctttagaaactttgtcttaagaatcagacaaaggccagcccaccacctatgtcatggaggggtcataaggaaagagaatgaagaaagagaaaaagaaaaaggggtgaaattctaatatttaacatctccaggcacacgccccagcctctcacgcagccctacctaccacaaccaaccaccacatttgatgcttgaaatctacctaaatcaaatcgatatttgccttagcactttccaaatatctaggcttcccctagaaatacttacaagggagatgatattcagtttagactcaaaggccagttgtttcaaatgtcaagtgaaataatatctcctcctccttcatcgtgctcataaacttatacaacaaagacatcctgaccctcagaggtcagagaactcaagcaagagaacgagaatgcaagatatctccaaggttattttggaactaggcatggcttgaagacacatctaatggtgaagggcttttaattgagatgctgcacaccacctggttggggttggggtctctgggtgggtggatcaggcagtgggggacagtgaaaactggtgaaattatcttggaatgtgcttttatccatagagcttggatatacccttccttagctgatcagagagggcccgggaaccaaaagacattaagatcttagaatgcattttctactctctcattttatagatagcacaactgagtcccagataaaataaaagtgtttttcccaatatcatacatctgctgatggtcctgacttagccactaggcaagtcccccagactccagcctgcggttgcttccatctatcaaggcctcttttcaagctacttggaaggctctcctagcaaagatgactacaatttatgctcccttcacaacattttgattgatttttggtggaaaagtaggcatccctgaagcatttctttaaaataaatccagcctgccaaaccagcactgatgtacaaccctagtagaagaatccaccattggccacaataatagcaaaaagggtaatgagaaataaacgtatttaagtttacaagcctcgaagaggttatcacacacaatgacaggaatctttgtgtcaggactgaacaagtaaccctgatttaactttacattttgatagagtcagccgcgttgcagtcattgtttcgtctaacaattaaaagcggaatttgaaactattcctgtccatagttccccttaaaaaatctaaagcaaagagattctctcatgccaggattgaatgaatttataattatctatctgtagctccaggacaaaagacttaaacacaaaaaagccaaataaaccaaggacaaatttctgatagttctagttaccctgcctattaaatgatagacacattaaaagaaagagagtgatatttggaatattcagaagttggtggtccatttctcatgctttgttttagtatcactctttcttagacgaaagacagtcatgaagttgtttgtgaagactctcatcagacaagagtacagtgttaataaatgcatttagcaagcatttactatgtgccaaacactatgctatgtatgggctgtcatgtacaatctcagttcatcctcataataaacctgtgggtaagtattattgctaatttcagtttaaagaaattagcaataatacttgaggaaactgaggcctaaaacaggcaaagtaacttactccagttgcatggctaataacttgcaatttggactcaaattccaaagcctgtatgtttttactcgctaaagtttgtggtcttggccagcaaatttcaagaaggcctgtcataaagccgtgctgagagggccaccttacatgccaattacaaccttatttaaaatttaaagtacgttatttcttcctgaaatggaaaataaaccattagatatctacaatattactatgctttagagtcccaaaatcactcatgtataattagttatacccatgatgtaaatattttaaatattattaaatgccttactataaatattagaggctggaatagttaaacagccaattaactagctagtggccatctctttacctctcagcatttctactctgttatctgaaacaacccatacaagtatctaagtagaagtttagaaacaacggggctttggggagctgctgaggagggacactttgcaacctccaaaattactgcaaaactatgtgcatatgcctatccaatagtttttcagtaattttggaggtttcaaagtgtccctcctgcccagctccccaaagcccatacagaaacctatttgagaagctttcgatctaagaaatgggatctgggaccttaaaaaaaggctaaaactcaatggtctggatatttgtgagactatattccaaccagtacaccaggttactgcttcccagactctgttcttcaaaagacaatgtgtcaagtttccaaattatggggggcaagggtagtgaaaagtgagtgtgaacctaacagacaactaactgaatacttccctctgcatctggaggcttaggaattcagcagacagacataagcaaaccattctgtgaaattgttagggtgctattctttctgacattgtgttggtttcctattgaacatctgaagactgttttaacatgtgtgcctaaaaatgtcacactgaggctgagagagcacagagccaggggccacccagactttcaaatcagctctcagaagcagccagggaaattccaaccttggtcttgtggtcctcaagaactacagaagcatggcagaattttagattcacaggttgtttgtacagttagtgcatttatacctaactcctcaaagccagagatattttttataactcagcattgccctcattgctttcttatcacatattttgcatgtgtttccatctccaagattcagggaaaacaagatacttagttgggaatgtctagagtggagaccttataaaaattacttgacagacttgggagaggaaagcattttgcaaaacaccagctatgagaataaacaattttagagaatcccttggggacattttttttcctatggatcccaaaatcttttttaaatagaaacatctcaggcaggggtaagaaattattggttaagcccatttagaacgtgtacgctgtcatggaacattcctatcaatggggcacattgaaactctacactaagatatggtggggctgtggtgctttactggataaataagaaggggtttggtcgctatactcccaccctgcccataaatgagtaagcccgtgtgacaagagtacatgttttcgaaaagaaagaaactgtgaaactgagcgtcaccatcctgccacataaaaagcaacagaaatgagaattaaattcagcactttcttaatgggagactgaggaaatctgggagatgaaacagtagctcttctccagtccttcccagcataataaggtcagctgacaacactgttcgacagagaagacttaatgtgtctgacagatggcaaatacaccatattgacttttcttcctaatttaacaaatttgaatcttttgtcaattttctttccccagtgaaaagatattctaaaacaccacttaagcttacattgctcttttccccctctccctcttacacattaagtttgacactatctaaagaaactgaagctaactcactaaattaactcacctttccagctcttcatgatcatcacaaatttgggcattggcatgaatgttaattcctcatctctgccaactgtaaggcagatactcacttcaggccagaggaaggtggctgaatggacaacaaggattccttgaactcttaaaaataacacacaaaagtgtgcatctatattcttcatacttcaaaactatgtatctatgttcttcaagagtccccagttttgcccagttcctgaaggtataatgcctctggctttagctataggttgttataattagccctcattctacagtttctaaccggactttggaattttatggggtttgtctatataagatggatgggatgatagcagagaagagcttcaaactagtggagctcctggatcacaaagctgtgtaagtcatcccaagtgtgactcaagttcagcctggagaagccatggccaggccaaggatagcttgtcccacaaggaggcaaggggccgtttcccaccactgcctcatcccttccaccatgtgaggacacagggagaagatagcatctatgaaccagaaagtgggcattcaccagacaacaaagctgccagtgtcttgatcttgaacttcccagcctcaagaatgtgagaaaaaaatgttggtcgtttataagccacccagtttgtggtattaccttagagcatcccaaatgaactaaactactgttttcataatttacaatgtgtcctaaaattaattataatcctaactatgaacatgaaattctgccaatgtgaaaataacattagtttctcttgacaacctttgtagttatgttacccaaaagtatctatagacaaagcatctgaagattttagtggttattcactattataaacaacaaccacaaaaaacccaccaccaacaaaaaaaacactgggtccatggagaaataagtttgaaaaatatttcattatgcaaagtaaaatggatttattacaaaaaccttcttagagcatctcatggaaatggagtttagaagaatactatgctttagattattcctgaatccagacacattttttttaaattttaactcaaaggattaaaatttccacacttggaatgcccctgtatgaggaagaactgaacgctgtcctgtcttgtctaagtttcagagtaatccctatgtttctagctgattagctggtttcataaggcaaagggccttctgaaaatgggccattgcttctgtgacaaattcaatatccaaattctattgctgcccttgaactgtgctctctgatttcctgctgcaaaaatgtaggccatcagtggggacgtgaaaaatttgttcattacacacagattcccacagtggcagtgcctggccacattaccgaacctatagataacatcacagcacctgacatccagcccacatttcctcagcctcagagtaaagaacataccacggtgcccgcacattaacgcagagagatgcccttgataattaacagttcttatggagtctctcgaatgctaaatggtcaaatagagaagttaaacacacataaaacatttaatgtgaaatgaggcaaatatgccaaattaacctgaaatgcacacaaaagcctttcagctctggaatcgatattaatcattttctggaattcaagaaaaagtctgatgtggttaatttaaaattgtattttatgatagagaacaaaaatatcccacaggattcaaggtatcagtttacactactgccactcctttttgctgccagggtcagcaaaaagaaaaaaaaaattattgatctggtattaaaaatcagttgacttcacttctttctgaacaggtattctttgaccactaagcactggctagtcttacctctctctagtgacaacatgaagagataaatagactattcaaacagagctcttcgcgttacattagctgaataaatagtgatgtatggtctcttttctcaagcactgccttagcttgtgaagatgagagtgaggaagatggggcttatgaatcctatttgaatatttaaataaacacaaaataacatccctgaagatggttgtttaagtggaaaaagaaggtatgaaaatctgtcttttaattgtagcttttggggcaacaaaaaatcccccaagaaacttttgagattccagtgtcaagtgaaatcacagaagaaaaaaaaaattaatttgtggttttataagcagtatccagaggaaatgggatgccagtcccacagggttttcaaaggctgcaaagctagcacaaaccaattcacctaaagtgaagtatattatcaataactaactgtgatcactttttggccttccagctaagatcaagtgtaataactaactttactttgggaatatttcacaatgaatttttgccctctttaatctgctttaagatttctgtgctcaatttccggtatatgccgtacttgcagaaagggatgaagttctgagctaggttaagtgcttgtggctaactacaaatgtgttaacacaatgtaattaggtcatcaaacagcatcatgtttattaggtaccaatagataaaaaaagggagcaggcctagaccagcacatcagccccagtccctactgtcttggaactgggattctgagacatctccgtggcttctacacattactggcataattactaaatccaaagttttctatttgtaaattagagattctagcaaggaaaagatgaagtcctatgcatcgtgcattagccaggattctttttttgattttttttttcattctgttgcccaggctggagcacaatgccactatctcagctcactgcaacccccacctccctggctcaagcgatcctcccacctcagtcttccaagtagctgggactagaggcatgtgccaccatgcccagctaatatttgtattttttgtagacatggggtttggctacgttgcccaggctggcctcaaactcctgagctcaagcagtcggcccacctcagtctcccaaagtgctaggattagaggtatgtgccaccactcccagcaggtcaggactcttttggaacaaaaagaaggggtatatttattggttcacataaacacatcctcaggaatgttaaggcagaaccagtacagtcctaccttcctattggcagttttactttctatggtttcaagttgcctacaatcaactatggcctgaaaataagtgactagagtacaatattctgagagcaagaaaaagaccacaattattaactttgtactacaatatattggtatagttgtactattttattagtagtaattgatctcttactgtgtctaatttataaattaaacttcatcgtaactatgtacatataggaaaaaacagtacaaacagaatttggtaccatctgcagttttaggcatccgctggggtcttagaatgtattccctttagataaggcggactaatgtatagtcctttccctctccagtgttggcttcattctctcagaataaagatgacaacctggctgtggaaggtggcctcaggaagctcccaacctagtaatcagagaagaatgagaggattgccccattagtaccagaaaatccctatattagcaaagacagggacctgatttggtcaagtctccattcctgtattacccctgtggccaaaggggattgagtaactataattaatccagtcatgagggaggaagagttgctgcatagaccaaaaacaagagcctctacgtactgaagtgatagggcaaagaacatatatttacgaattataaccaagtctaaattgtattcgaattcctagaagatcaatgttacttaactttcctgtgaataatactcttgcctcttactaagtagcacactatccctaatattccaaggtgaaactcagtcactgagaattgggcatgctgcaccagactgttttcccagtagtagcaggagatatgctgaacctcatattctttctctttactgctttattatcattaatgccttagactgaatttctccagaactgatcatgagacaggaatctgagtacaaatggattatttgagagatgggcccaggaagcaccattaggggagaagtggaagtaagacaggggaaaaaagaaatctactacaagaaacatttataagaatattagtgcttcaagcaattggggctcaaatccactggggggggctctggaagacagcgtggaacatgctaccctctgagttttcgcacttacgacataggaagctggggaatttatcctcaaattcccactggtattggctaaacattgttcctaaagtcaataattcctgacactttaggcctacactctacaccagcaagagaaagccccagagtgcagagtaaaaggcatgtgaaatagaataaccttagcacatatgagaagggtgagtcccagagaatggaaccaaggcacacagccttggctaataccagtaacacacacttatgaaaatgtgccttcatttattcaaatacttaccaagctcctattaagtttgagttttcttctagatgatgggcatacactgagggacaaaacaaagattattgtcttatttaatacccagcacaactgggcggggcaggggcagattccaggggctacatgtcataatcctcttcacaacagcaacttcaaatgtggtccctaatcttaagagtagcagcagggtcagcagtattgggcttcaccattactaagccaggtgtgttgaggtctatgatccagtaatgaacctgaatcagaaatggaatctcagataggtattggaaaagtgggagagttcccatcgtaggacagtgagttacattttgtttaggaaactcttcagggacatcttctctgtggtggcttgtgtccagaggcactgcagagttgcctgctctaactcttgacagttgagtggggcatgcagcttctggacatggaaaggactaaagttaatttgcccatctggggattgaactggcatcagtgacttcaaatgtgccctgcagagcccaaatgatctccattacaaacacagaatgctccgccttccaaatgccacagaattccattttatctgcactggcagggtaaggcagagtatttgccaaaactccagacatagggggttatttgtaaaaccttagagtattatcaggtgttgctttcaataaaccattacacttgtatagaaagtaacaaactacgtggtctaaggaccagttatccctattccaaaaaataaagtgtaagtaagtaaagcaattttacattgaatcttgaacatctatgtacataatttagaatttgctaaaaggtaattttatctgtgctgattatctttaccatttggcatttcccatctcagggcaatgagtacaacttcacaagtccagctccgcttagctgtgagtactcaatttcactaaagacttaaacagaaaattaaaaatctgtgagaattgggatgagtcctgtctgtcttaaagcagggtgagcaaatatatgtggcacatgcccttaagagacattattaattgatcacctctcactttcacactgagcctaggctgaaccttagaatccgtcacagcgcaggtgtccactcagtcatgactggccttccagaactgggtactggaaatgaaacctacttgacacttaggatacatttatagagcctggtcccctcagtactatactcccctctcacaaacagagagagagaaaaaaaagaggaagaggagagcagagaaaggatgggggaaggaatgagaggaagaaaaaaaactctgaaccaagtatcacttcctttgcggtctgcacatgtcaaggaatactccattttaagcatattataacggcaaaaagaaaaaagcactatcaatagcggttcacactttatggctgctcaccctgaaactgtagcagctaactttcttgggaaaactcagacagactcattctttccaaaaacaaggaaagaagaaaaagaatttcccacatccttaagataactgagaagctctcagtaggagtaaactgtccaaataaaattcaacggcaccccctttggaaggatagttaagaaacaccacatgtacaaagaaggattaagattccaaatactgtcttttctccaactcgatttttccttcttgtgcccttacttctcaaacagttattccctttgctatatcacccagaagtctgtgattggatctcccttggactccaaagggctctgggtatgagaaagtagtccaaaatatatatatatatatatatatatatatatatatatatatatacacacacacacacacacacacacacacatatatacacacacacacacacacacacatatatatgtgtacatatatgtctaggatttactatagaaaatttttaaaatatttttatgtatttatatttataatatatttacatatttagttttatatatatttatataaatatatacatatatttatataaatatatacatatatttatatatatataaatatatttatataaatatataaatatatatatataaatatattttgtattatatattaaaatatatacgtatatatgtgtatatatgtataggatttactatagaaaaatatttcatatttttatatattcatatattttatattatatattaaaaatatatgtacgtatgtataggatttatatacatatatgtatatatgtataggatttactatagaaaaatattttatattttatatatattaaaaaataaaaaaataaaaatataaaatatataaaatatataaaaatataaaatatatctatatatatctatattatatatagatatgaagatataaaaaatctatatattttatatagatataaaatatataattatataaataatatagacataaaaatatatatttatatattttttctataggaaatcctatatatatttatttatttatttaggactgcttttcctgaaactctgtaaaagttttcatcatactagctatttcttgtgatgagccagatcatcattcacctggtataaatgagcttggctgtgaacacggttagaaattagagccaaggatgatctattagttcatcgtgtgtgtctcatgggacaaaagcaaatgtgtttctctaaagagttttcttgaatggtttcccaagtccaacttgaaatcacattcacaatcttgtcattttcctctttcttgcagcacaccagtaattagatgttttaacacgtcatggcaatgatatctaacatgaaggcaaactgtattaagacacagcatcacccagttttatactgtaagctcatttccaaacattatttgtttttataaatttgagcgaggctgactctttcctctctgcctttaattaataaggaaagcttaatatgcacttttttttcatcaatctggcactaaaaatcctgaattccttttgtagtaatttgaaagaagagtttggggctattaggagaaattcacattaggcatttccctacatggcctacttatgtttttcaaagtgaagggatatttcaaggaaagaaagacttggggtactagagatgtctgccccatctaaagtcttatttttctatttcctatatcaagaagccttaggtacattttagtaacatagcttgaaatatattttgaaaaggggaacaagacgtaacctgacccactacagaaaaatgcctcatgtagatccttgaatgaatttatgactgtaaaagtccctctcttttgtttcctgggtaattatttcacacatttgggaggtttatagggaatgcgtatcagcttttcaagtaaaaagtgtgagtctctgactcttcctggaaatctggaagcaacagagaatgagaaattctcaggcagcctccaaaattgagcaagagatactgcaggtcaccttcagtgctgaatattccaaagttaacttcgttaaaaatgcacaaacaacctgataaaatatctgattttaccttttaaaagtaggattaaaaatttaggaagcttcgtgacttactctcgcatctctctttgatatttctttgtttggtatttctctcacctcttatgccctggtggagtctattgttggtttatgtgtaacatgatcgaataaagcaaaattgtaaacattttctttttaaataaatagacttttacctgaacattataatcacagtatctcattcatccattcactcattcattcatccatctattcattcattcacccattcatttattcactcaggtattttctgagttctttctgtgtatctggcgctcctctaagcagtggggatacacatgtcccctgttctcatgagcttacagtctcctggtgaaggattttaatcaaatcatcacacttgtgcctaagggtttcaaactgagataaggatctcaaaataaaggagcaaacacccgaaggatcaaggacgacttccctgtgggggtggtccctgagccaagggcttcagcagaagcagaggttaagtaagtaggaagtaggacaagccctccaagataggggaatgcagttagggcctcgagcaggaggaaacaggggcaaagctctgaaagtaaaggacaggtagtatttgctgagctactctaagacagattctcccacctatgctgacagcatgcacaatttcagctcaatgaatacaaatgaatgctctaagtattttttagattctctagattatgcacattgaggagcagtttggggtagggatgatggaggtctggccattagactcaggctttaaagaggttctgggaaggggagccaatctgaagtacctggaaattggaaaaaatagatgaacagtgattttatctggcttccaatggcagataaatttcctttcgggaaaggcagatattctcatttcaagccaggctcctctgccctcactttagcatatgaggaaactgagctcttgagttcctggaaacctttgagaatatggagacagccttttcactaggtcagtttagcttcagagggaatgagatggctgacttcccccacacattaggactttcattccaaccctcggccagcacctagggaacaaagcaaggccccagctttagttctacttaaagtgagacactgcttgctctttcacactcaggttaacattcactccaacaatgagttcagaagtgaccatgggaagacaagaggctttccaaataactacctcaccatggcacagggtctctgagggctgggcatgttagagtctgagatataaaacacagtataaagaacgttctattttgcaaaacaatcacattctacaatctatacctaagtaacaggaagagagcagatctcattatgtcccttctacaagaagaacatctgcattgagttgggtgtcttcatagggagtcattctcagggaacgtgaagcttcctccccatcaccctgacctcccttcccctgtaaatttccacattgattgattgtaaacaaattgtgttcatctgcccagattccattatatcaaaaagacatactcctctccacaaatatcggagatagacagacagataaagaggattactttccagtagcaggggttcctccccactcttcctccacagagaactttatttctagtacatagtagaagaaagagtcaagagacggatgagaagacaaactcagcaaagccttatttttatgctgctgttgtttttaacctttagtgggaagtaataggagacctcatactttatgaagcctttttgtatctggtggtagtttttaaaaagaccatcagctaaaatataaatataaatttaaccatggatgattgtaatttcctgcattatatttttatgtattttcgaaaagtatctgtaatgagcgagtatcatctctgtaatcagaaaagaaactatgaaaatatccccagtgagatctgtgtttgctcacagggcactatttggcatgatgagagtgaggggaatgatctgaatgttttcagtgccaagcaccatgttggcctcaatcggtagcaattctaattctttttcctgtggatttgtatcagttgctggttcatttaaatcagctattaaaggaataaacatgaatcttaaaaatacatttagagaaagtatattgttctaaattaagcaagcagttggcatttcaaatcatatggaagcagatgaggggaacccgctctcaccagatctcaatccactttgcaaactgcttactccttaacttggctccctaattagggcattttatctttgtgagcatttaccattactgcatcatgataactcttggctagtattctgtgaagaaataattaataataatccacaccagccaaaagtagatagagcaacatgagcaaagaactaggttggtgtgatgtggctcaataaccacttggggaaaaacaatgagagggtttttattgaccaaagtggtttaacaaatgacacttaagtgatctactggcattttagaacagaggcaagactgctcactcattaagtcattttaaaaatagtcattatagagcttttgccataaatcaagaacaaaagattccaggaaataattttttataattcataaacacatagtaatgtggaaagaaggactctatagagttgaacagggttatcaattacattttccagttgtctatcctagagacaacattccttccgtgagttcaaaccttaaacatccagatgaggtattgtgggtaaacttgaggattgacacacttcagcagactaccagctccatgagatcaagggccacatctgttttatttagcgagaagcagaattaggccatgtgtgacagtgggtgttactcagcaggtgctcagtgaataatgaatggattaatgacattgtatagtagtgtctgactttgcaaacagaaaatcacagcctttgtgaatgtaaatttacacagtaaacccaataccatatagacttttagtgatattttggtatttagaaaaaagactaagatcttctccaggtagaaaggtattttgtcaagtatttgctgtgtgtgtttgacttgttttggcctgcaatgtaaatgatcctgatagacatctagttctactgggttccacagcacttctttagccagtggggtcttgtattcaacttgtatttatcacgtccttctaatttcacttgtctcaccctggctgttattataatcccaaacagacagatacattagtaccccaggcttaagtctcatcctattcattgctatcgggttattctctaggaagcatctttcttttcatcttagtcccttcttccttccttccatcagtcctgaatgctttctgagtcaaattccgagagcagaccctggctcctgaatctttttatgctcagaccctgcaactgctcaacagtcgttgtctccctgatcctcttcacacagccatatgtcggccaagatgctcaactcactactgccacctttatacctaggctcatgccagtccctttgcagagaaagagaaacacagagggagagagaaacacagagtcttgagtccctggatcaagccatacctgaagtcagaaacttcccttgaactctttaattatgtgacccaataaatcatccatttactgtagccagtttgggttttctgacacttgcaactgaaagagtctttaacgtatgcagggaagaggagatgaggaagagaggaacataaaaatgaagtaaaacgaaacagaggaagaaaacaatgaaagatttgtccaaggctgtagaactaaacagtattggataagaatatagaacatgaagcccagagcccaagactctttcccctactacttcccttcagaaattagtactattactcattgccacacattgttactttaaacctaaccaaatgagaagtgacctgccatcaagctcccgcaggtttaagacatatatttgtcctgagtaacttatattgttttcctggcgtagtacatttaagaattacttttacaattaagctgcccaaggggtctatagatgcccgttttaatttaaataaatactaatgctaaaatcaatttgtaggatatttcaattggaccgataagtacagtcttcactaaatccaaagtatttccctattagcgcatctttagaagcgtataccaacaacacatcaggattttcagaaacctgctacaaatacattactcccagagactggatcaaacagctgatgatcaaaacataaggcaaaaactagtatttcatctttgaattcggagtacctgatttctactaaatattgattagagtttttcccataagagatcctgctttgtgcctccttaattttcttggtttcaatagtgctttgtgcagagaacagcagaagtaaggcagaggatacagctgtcatctgtgccacagacattgacatgcagcttagtcacagaacagagagaacacgtgaaagtcaccatcacaccctcgcaacagtgtcagtgtaaagactcaggttccagatatgaagacaggactgaaaatgcttctggctacaatgaaatgaatctaccacacacttgccaactttattcaaactgatgatatttttctttaaacaatggatttagttattctacccgtaagaagtccaggtcgttaatgaaatgataattttctacaaactaaaaacaaacatatctcatcctactaatggttcctgcctctccaatatttcacttaggccatctcccttttctcttctggtagaacaacttcaataggtaagaaagttttcttacatccgggaaatttctttaaccaccaaaatccatggtgtttgcttttcatcttcaactcactccttggtcgttacgacatgttgcctcctatttctggttatctatgttagtttcctgctcttcctacagaattgcaaccccggaaagagaggtactgagtctcacacaccttcttcacctggagcttgtaacaacatcctacaaagcaagtaatcaacatgtgttttacagagaaaactggttatccctggactgtattaaaacagtggtatgggtactctaaaataacaccaatgtgagtgtagaatgcatttctcatttaagagaggtgttcattcagcctgaggatgggagaatttacgaaacctcaaaccccaattggcaaacagcctctctaccttcccagtttacaaaaccctacctgagagaaggtgtcttctctcaaatgaagacttccagatcctgttctccacagacaattaaatgtggtttaaaagttgctgctgggagctgaggttattacccactttctgatgaggccggcgccaccaaaaccagcctgtgggagctgatttcactaggactcccccaacattttcttgatgttggaggtgtaacggggtctcagttcctgttcaactctgcctctgactggattctaggtcttgagcaagtcactgcttccctctgaacctcagttaacctcatctttaacatggggataaaattcctggcaccatagctacctcactcaatgctggggaaaattaataatattgatagtgttaataattaaataatagctaacatgcactgagttataccatattctaggcactgtgataagtcccatacctcccttaactcttactattctcataactactctatgacaccaagcaccatcattatgtctcttttacagatgaggaaagtgaagctcagagatgttaaataacttgtccaggatcacagagctaggaagaagcagagcaatatttgaacactggcattgtgggttacaaagcattactcccagaatactgccttacaaaaataagataagccatgtgacacaaaaatcttcacaaactgcaaaatattaagccactgtaaagtactgttaccatcaatgcaaatagatgctcattacatttattgtaaaaagcaggtaaccaccaacccgtttagggaaggtgcataaacctctgtcagcaatactcaatccatctgcagagaaacaattagaactgcattagcacataatcacagaagaagttctcttgacaccatttctgccaaagaactcattcttccctggaatttgaaaaggcaaaaagaaaaaaatcccatgccgcatctgacaataggaacaaactcttcttgcagctctggtaatgcaacacttctgaaagaacaagttaaggaacgtacttccactgccctcattagctgacaacctctgtggggactgcaaaccagccacacattcaaaacaaatcccagggaagaaatcacaccacaaagcctgtttctatttgcaagtaaaatgacggccccaagtgtctttccataaagctgtgtggtaccaaatccaaagcccaaactggttacaaagggtcgccattgataagacatggcatttcaggtccacccaccatgggccaaggaggtataaagctcagaacgtgacatgcaatttttaagccctcctttcaccttgtctatgcactaagttactttgacgccacacctgtttctattctgcctggaagccctgtctgcacaacagatggcagagtgtttgcctaacaaatgttcttgtgggtcagtataagaaggtggtggtggggattgttgtgggtacgaaaggagagaggctctgctagagcagcaaagaaccatcgatctccaacttagctagggaaacttcccacccaatgagggtctgggtatgtctgagctctgaatgttctcacctctgttcatcccttctgacaatcttgtccaggatagtacaaatctgctgctgcaaccggaaattacaaagaaaatctgatgtaggcatttagaaaaaaaaaacaacagaacaaaaccttatcaaatttaaaagttaacttcaaattcaattctaactctatctccaacttagctctcttgaatctaactgaagattcaactttcttaactctaaacttaacccttgaatcccaactcctagctttcacctctcaagtgtcttaactctaacttaaagtcaaacttagtctcttgaggaggtaattaaacttcaacaactaattggaatgagttcttgtgaactgagagcttggcttatcaacacatctggtcttcagaggttaagaaaaaactcactttctgttattgtaaacttaacaccagagtaatgttttatttcagctatgatggtaatattttttaaattatgctattatccacttaaaaaatccatgatgtaaggtataaagtaacataatgctccttgatggtgaaagcacatcttaggcaccatgctttggagaaaaactgtggatctggagggaatctcctcctcccaccctaaaccacacatacctaaaccacacacagcaccgggtatacctcagtcttcaacataaagaaccaactcggcacgttccatttcatttgactcacttgcttagatagcttaggaaaccaatctgctcaacattagtaagtctgggcccattaaaaggggactgacactaaactgaaatccatttcatctcttctccagggttttcctcggactctctgatcagcctttccttcacacaggggtgaggccaaaactactatagatgaagaagaagagagtgagatgatgttctttttgagggccaggatgacactggctttgtccagtgttttcatcacagaaattgaagtgggcatgtagtaggttctcaaaaaaacaaaacaaaactggtgaataaagacgatgtgtgctaagcactaagcagagacctccccattcgtgctcttatttaatactcacaaaatcctaacagcagggggtattattattccaattttgcaaccaaggaaacacatgcaaatagctaacagtggacagcatcagatttaaatacttaaagcatgcatttcccatgagtgagagagacattttgcaaacatgggtagaatgtggctttgtgacttgcctcaagattcaccccatcaatttaggcaaaaaatacaatcttccctgactatttagttggaagataacaagtcagggaaattcagtctagcagtccatgggtaagcctcaggggaataggaggcccctgaaattaaatgcgacattttgtgtgtatgtgaatttttccatggaaaaagtctgcagctttcgaatacttgaaagattctatggtcctcccagcccacaaaatttaatgacttagctgcttttaattaaagttatgcttctaattctcatccccaaagagtccaaagggctccagacaccctttgtatgcctactgaaagaaaaatgattagcatgaaagcctggtgggtattagacatgagaatagtcaaacaccttaggtatggaaagcacccacatagatcattacttaacgaagaaaagtaattgagaatgtattccattgctagcatttgtccacaatgagattgagaagccattctattgctgaccagatggtcctgaggatagtgaaatgacagaacccctgtatcactcatcagattcactgctcttcaaaatatgaaaaagaaccaacaaaatcctcattatgacagtgcctacaaacaagatccttctgaccatttcacattctgcaaacttcatctgcaataagaatgtccagacctgaggctctatacttggtgaaaccatgctcatgttcaaaaagcatttattgagagcctactatattctaagtaccgcaataaatacttgttcctataccatctggatgccctcatgtgattctaggcaacacgtttaaaagagaacagtcaccaaatagagaaccctgagatgggaggaaccagtttgggaaagggataaaaatcatgccatgtacacagccaaaggcattgatgattctttaaagggaaagtaatacattttctttcaacttctacaaagtttctaggtagaagaagaaatagagaatcaatccaaattgccagagaagtctgaaagaggaccacaaggtaaatatttcagagaagcaaagtgttggttcacaataataaaaagaaagaaaggaaatgaaaaagcaaactattatagctggggttattcaacaatggaataagacagctggtaaaatgttagtcgttgctggaggaatttgaaatgcatttatatgttaaaagcactaaagctaaaactataaaaccaaaagatgggttagtacaagatgattgtcctaaaatacaaagaaacacacattgtcagtatgtgaaccttaaaaactaatgttggttattctgtttaaagagaagaatgtgatgttcacaaatcaacttatcacaaattacatgcttactctagtaatgtaatgaccttgggagctgactcatagtcttccttgacctaatgagcatgctgagtataatcaattaggtttgcaattaaaattgcaatttatctaacacccccctctacccccacctttttataaggctcaggagacagtggggtgataaatataagcccttctgctgtggctatcttttattttttaagcatttctattacgtataatttattaaaccttaaatttcttccctatttgtaagtttcagcaaaatttagtcaggtttcaacacagggtatcaagggataattaggacagttagcagtaatttatcatttctcagctgggttttcatgctttcgctgactgcccgtagaaatctgttagccacttctacacagatcactatgaaatctgctttatctttgtgcaaattgcttttctattttcctaaagtgagctgaaagatgagccaatcgactcctgaaaatctagccaccggtgtgcttgtcatcagagtgcagctgaggccagggccgcagatgaagggctacagtggctaatggatgatgcaatgccatgagaggcttttttccagcctgctgcgggttagaaatttaaaccaggcagcccgacttcaggttagatcttcacaaaatatgcccaggaatctatgaacatgccaatacacattttatggagcaaatattgcctagtaagccaccagagaggaaaagcctagaaaaggcagagacactagtactataccacttccactgaaaagagggattttatgaagcctgaaccaaaaagggaggacctcgtgttctttagagagattcatttactagatggtgaaaaatgaatgcttcgggtaatttcattttgaattgatttatttctaaatggggggaaactgacacttggtgaagaaagtaacaagtggttctctggaaagagccagccagtctcaggtataatccaattattccaacacaggaaataaggacacagagggaagggtggaaggtcacctgagaaagtcattccttgcaatgaataccttcctgtccccttccctacagactctcagagaagtataaactgacccatatttccagtttatttctgacacctaaacctaatcaaagtccactatttagaaatccaatagttattcgcaattagactgcacggcaaattaaatcataaatttctctatctcagccctggttgtcacattcctaaaacacaacttgcctccctccggcactttatttaaatctctgaggccgggctccaaagcaagttatggatttgataatttgctaatgtggccacagtaattgttttgagccatatttatgattttattggatcttacaacaatcaataataatccattgatgtccctgactcgggttttctcgcagtcgacaaatggggcagcagattcatttttaatgtactcacttagcactccctccctgggagagagagccctgcatattttaaaaaagggcaagaaatgaatggcactggtacacatactttactgtgaaaaactagctgcaggataagatttaatgctaaaaagaaaggagagaatagactaacagggcccattttgtgcagcaccaccatcgttaaagttaatggaattaccgtgtggtcacgcactagagggaacctattggaagttaagctcttctagggccattgattcacagactttcattcaaagattcccactagcatgtgatgagtattgcagatatgcagaggcactttagaaactgtttactcaaactgccagttaagcatattaagaaacaacaataactgaatattttagagtggatgatctagtggaacgtgtcttctgttagacatagtaaaaacttcaactccgactggcttaaacaatagaggactttattggtcacctaatttttttcaggctggagtgcagtggtgcaatttcagctcgctgcaccctctgccgcctcccaggttcaagtgattcttgtgcctcagcctcccaagtagctgggattacaggggtgtgccaccacacctggctaatttttgtagttttagtagagacagggtttcaccatgttggacaggctggtcttcaactcctgacctcaggtaatccgcccacctcagcttcccaaagtgctgggattacaggtgtgagccactgttcctggccagatcacctaatttaaatgtctggaagtaatgcaggcttcaagtctggttaattcaacaatccaataatgtcacctagtgtccagcttctttctgtctctgccatgtcagcctcagcatctgttttgctctgaggcatgttgccctagaaaatataagatggctgctagaagctgtcagttacctgctttcttgttcataagcagtagtggagaaaacagcccatccacaactaatgcatctaagtcctccatgatgatgggactccgatcctttagagtgtaggattcctaaagtcaagggaatcctacactctaaatagcttaggaaaggattaatgaaagtcattactgtggcagagacaactgacttagactgggatgggcaaattatggccctcaggccaaatttggcccaccatctgcttttacaaataaagttttattggaatacggccatgcttatttgtgacaattcattttcatatattctatggcttcttttgtgctgtaaagtcagatacataattatgacaaagaccatctggccctcacagcctaaaatgtttactatctggccttttacaaaagaagtctgccaacccctggtgtgtaccaaacaaggtctgcacctggagctaaagatgagttcaaacccatcctaattttgtggctactaaatcaagagggagggtaggaagaatgctagagggacaaccacagtgcctaagatagacatgagagaaaatccttcaagtctagaaaaatgggcttagaaactaaaaaaaaaaacaatttaggaaacctatcataagcacatgtgaaataccctctgccctgaaatacactctgagtatcatcaaaacatcaaatatatttaaaattgaattacaattccttaccacagcataagtcccagtgtaacggctccccgcccactcttcccacttctctcctgctgccactctccctacactaaatttctgccacctggtcttcaattatttcctagaatgtgccaagctcattcccactgccatttcctcttcccagaatggtctttcttctccagctcttcgctggctaggcgcctgtcgttccctgttctgggtttatgggttatctcttcagtgaccaccccatctaaagtagccataccaccccattccccttccaccatgtcattccatttcataacaccttgttttagtctttctagtattaacccaaatctgcaatattttatttgttccctttcacataaggggaagaagacaatacactgagagtttttcctaggctgtcttgccttccactttaacccagtgcctgggagcacatggcacatagtaggcactcaataaacacttattggagtaatatgttaatattaactatagaatttctacaactttttcagccttcctgcattatggtgttcatttcaaagtctgtacttgaaaacaaggactacgtctcattcttcttaggttctcagagcctgtgacgatatctggcacatagtaggtgatagaagaataaattaatgaatgaatgccagatagaaaaacatgagtaggcaggatactcatttcctggaagggaggaacagactactttggtagtgaggaaatcgagatcagagcgattcagaactggaagcagctacctcacagtgctttgagtttccaggtatagaggaagatgaaagacagacttaaatgctacaggggtgattaactgtcaagtagtggatgatgctaatgacttttaaggtcacttgctcctctgggattttcttgaattatcccgtgctctgagtttcttccttaaagagtgagattcatcgatggtcatctgatagtggagcagagcttggagtcacatttattccttccttggccaaacagtttcatcaaaattatactgctagaacctgattacgtctgggaatttataccatttacaaccaacagacgaatttaaacgcaaataaaagcccctggtgagctgtttgtcagggcaccaggatggaaagcatgataagaaaatattttgtgggggaacacgaactgatatatggaccccagagtgggagacttgaatgtgaacgttaggataaatgaattccaccacaaagtaaaagaatatttggtgtgttcactttgttaactcaatgttgtttattcttctcaaccaccctaggcagggtcaacatcttaaagaattccatcttcatttttcatgtaacgtcaggaaccaggaagacttgtttaaaagaataaactaccagggaaagaaatggaagttttcattactggaatccaataatattatctttatgttgaataagcctagaatttcaaaccactgtttgtgtgtgtttttttgtttgttgttgtttgtttgtttgtttgttgcccttccctcctgaggttttggattaatctgatggagaaggcttccgaagatatatgtctcaacttccctgattttggtgaacaagaggcttctttggagaacggatctattagacaataaggtaggatggatgcctcatgacatgggaagttaaaatttcaaaatgaccctttcccagcactaacataattgacttagaaggagggaaaggattcctcaccatgtttggcctgagggccattatagagtctcaccatcccaacatttttcactcaaatgtcctcaggaaggtcattattctaattcttccacatctgtggctctgcaggttgccttgtctattattcattaagctggtttccatctgaccctggctcagccatgaaatctttaccttttccagctgctttttgtgtcttgagacttactttattaatgactttggcataaagggtaaagagaagcgcctgaggggactgaataatttgagatgagtatcaagaaagaatcaagtccaggtcatctagaccaagaatcaaaatatatttataaaaataaacaaatgaaattgcagttgatattctgggtaaccatcagaatcaactgtggacctttcaagaagctacttcatgggccccaccctcagagattggaaaataggaggcatgagaactagctatatgctaaagataataaagcaaagagaatgaattataatagtcatttcttaatggaaagtgcttcaaatggggcccttggtttttcttttaaaatgcactttaaataatagaatcaacaaccatgtacacattacccaatttaaaaataaaacactgtaaagccgaaaccctcaggtacaattcacatcccacattgcactgcttcccctcactatctccacccagaggcagtaagaatgttatctgtgtccttccttctaagccatatatagatctacatgtttataaattatatggcagcctataagcaacctgttcttttattttattatttcctgctgttaataactactagtcaaaagtttgtagcatttggatctgtttcagctaaaaggcccaatttcaatcaaggcacacattattgtatggtctttcattccccattctgtatttaaggatgtggtgtagtctaaaacaaatggttccagagcactttaagaggccaaggcaggaggatcacttgatgtcaggagtttgagaccagcctggccaacatgatgaaacctcatctctattaaaaatacaaataatagctaggcatggtggctcgggcctgtagtcctagttactcaggagggtgaggtgggaggattatttgaacccgggaggcagaggttttaataagccgagatcacaccactgcacttcagcctgggcaacaaagcgagactctgtctcaaaaaaataaaaataaaacaaatggctcatctactgaggttgaattggccactaatatttaatcaaaagtactgaatctttctcacatgattaattgggctgcatttattttacttttttttttttttttaacagaattgacagtttggccagccaagtatttggatatcacaggtttaaaattttgaaattagaatgagctgattacatggagttagagatttttatatttgatttcctaggcttgaaacacccatagcaaaatggtgaggcagagtagtgctccttcaatgattagttattgagcactagtatcctatagcaaaatgacaacagtgagtaaccggccttactacatcaacaaaggtaagactctgactgaataataacgccttacatttaggtggtattttagggtctacaaaacacttgcctttcacaggaggtttgacttcacagtgattaagtagaaattacaggctctgagcctcaggtgtaaaagacagtttactgaatcctataaaacactgaatgtccctactatatgtgccacgtgtcggcattacaaatagcaaaataaattaaacagccaaatatccactttgctatatgtcagggcctctaattactgaggggatttgtttggtagtactaatgaaaaattaaacactaaaagcatataattctgccataaattgacatacagcaataaagcagcatttaggttaagcttcacctgtgtaataaacagggattgtcctctggatatttttagatggaaaccaacattattccaagcagagcaaaataatacagattaatatgtggtaagggtgacaaaatatttacaaaacctgtgcttgagtttcttctactgtgattacaggatacaacatatttctttaggaacagcctggtcatatgatataatgaagagttgaaattttggataggcttgggtttgaatcccaattccactatctgtcaactgtgcttttccagtatgtgattttttttctttaaacctcagtttccctaagtgtaaaatattaatgcctacttttgcaggttgttgtgaggactgaagtaagaattataaaactaatggtgaacatgtattgagactttactatgtgccaggcactattttacagggatttacatgcattaatccatttggtcctcacaacactcccaagagacaggatactcttaagacctccattttctaagtttatgaatgaatgtgggggagctcagaaaggttaactcgcccagggttcatgcacctggtaggcgacagctctgggtttgaaaccaagtagtctggccccagagtcctccctcttcatcagtatgctttaacttccctgcattttcttctcaccctcatccctgcttcaggatctctctcatctctttcaccttagctgcctttgagtttgaatgaacagggaaaaagtaaataagaacgtgaaaatactagggagcttggttaatttttctttcagtgctttgatccaaatggtatcatgcaaatcaaagttaacaaactagaaacggaaaaactcaatgatttgtatctacttaggaaagggcctgagggtttagtaggagagaggaagtttcccaaaggagacaggcaggcccccagccccttctgcctggagagctggggactgggggttttgcctcaaatcaccaggagcgggagagggaggggaagtcagagatatttacatgccagaggaaaagggcttggaacctcaacacttctctaaggcgtccactcccacatgtacacccaaacccatccccctgagcactgcagttgtctttggtttaccaacccagtcaaactggattcattctgagggcagagatgcaaattttaaggcaattatacaagataaaagctacagcatcctgaagataccaattcttcatgcaggaaatacatgcattaggtattaacatagtcagggcactgttcaccatggctgtaatgaaaggataaaagtcctatggcaaatcacatctctcttggagtgtctttccaaatgaaaataataagtaacggtaaaagaaaatcattttcatcctcaagataaggctttctctctttctgtacacatcaaatctttcctagaaattggtttgggttgagagcagcagccccctacaagtgcttcttatcactcctttaggaaagcagcttcagaaaagtgaagtgtgcatcagaatcacttgtggtgtctgttaggacagagtcctaggccccacatcagaactaccgagtcagcaaagcatggggcaggcaggcttctgtcctatggctaccttcttcaggtaactgtgaagtactctatcgatttgtaaccgcgacttactcgtgatcatctgtgcatacaccagaggctaaaaatgttcggacagagagggccagtattattttccccaattaagaaggcagatttctgaattttcaaagtgtcatttttataagttcagataagatatttaaatagcacaagtcatataatcagagtaaagttttctcaagaatttaaccaaaaggcagtcattcgtagcgagagaattcagtgtataataattaagggaatttggcagcaccacaaaccatctcaatgctagttacaaccccttaaagcctagccacaatctattttatagatgagaaactgagattgagattaacgttaagaaacatgtacgaggtccaagggccatgatgtggcagggccgggatttgaactggggtggactggtcagattctatatccatgtccaaatcctagccaatctctgctacatataccatgtactgaacatcaatacgtcagtttttctccactatcattcaatataatagatagggtttccgcattcaaaaaaaaaaaacaaggaaattgatgttcagagaggctaaaaggctgatccaaaggtgcacagttaggaagttaatatggctaatattcctaacggaacctctgatgccaaagtatgttaactactagacttaattaagagataaaatgtcctcattttcatgaatctgaaagattaccaaattttcaggtggaaaatttgttctagaaccacagaaacttctcagtgaacagaagagcttcctttttatctcatttaatttttgaattatacttctacaaataattatcttcttcttctagagcaatctaaaaagtaatttctaatatcttaaaagttattaacagctacttcccactgcgttaatactataaaattaaatttctaagtagaagattcaagtaccataaacatagaagagtgtaagcaagcataatctataaacagttcttacaagattccagattacctgcctggaataaatctgtccttaatatacctaaaaccgcctcccacccaaagatgaacataccaattgttctaaaagatagctcacatttaacttattaagcagcatcgcttctaaagaaatgaatattgccttaatggttagattagatggaattacattttggaacatgatttgagaacttgattcgtggaaattttagtcttcgttagtaacacctggaatatagaagacttttgatagagattccaggaatattgctgactgcatgctggaatacacatacatatcgtcttctacttcatgttaactaaagttagaaacttatgagattcgttccaacaagcaacaagcaaagttccattatcatcatcattctcttccccacacaaaagaggcatagaaaataaaccggagaaaaagctgtgtcatttccttacccattgcccggttcatggctcagacccctgtaacacaatacagattaacgagaggaaagcctaacgaatatatttaatataaattttatgtgccatgggagcctttagaaataaagacctaaagacaactgtgtatttttacggacagtcatgcagaagtatgattggatgataaaagagtatgacttgatggtaataaattggggaaaacttagcaaggcctgtgtgttcagattcttcttggcatgtgagtagagggcagaactcctctggaatgaaggtcttatgacctacttgcatgggtgttaggtcagagaattcttttatggcacacttgagggtagacaaatggaaaaaggtcagagagtgatgttcctgcttctgtagttttctcagtttccttcaccttaaaatactcagtatgcagagctagcatattttgggggtagcgtgtcctgagacctatcataaacaatgacaaaatccaggtcctcacaaagcttaccttctcaaagaactagagaaaagacagaggtacaggtgcatagccaaacaaacaaaagacaatgaagaatgcctcgagagaaatcaaatcatgcaccaggacagagagtaggggctttaggagagctacttcagatgaagggtcagggaggctgtttggatctgtatggttgaagatgaaagaaaaagattatttctcaagcctgcaggacatcaaactgctgcaataatcaccttgtggatggcagggttctactccttttaaacccaaaaaggagagttaataatcaattgtgaaataagaggtcacttttttactttgatatttccctttcctgactacaagtgccttactgagtaagcaaggccacgcttgttctttgcaaagcagaatttaaagcccctgaaacaaaaaaaccctacagtggtatcatgttcaagaggctaactcagtggtgcaccttcattaacgataacaacaggtgctccaggggaaaagaccattactgggcttattgctattaccactcagcatgagacaaaaatggtttagaacccagggatcaggcagaatctcaagaatgagacacagaggcaaagatgaagagaacagtcactgtgctttccatggcaggttgtcaaatgctgccttaaaatgtgcaactgtgtgaattccaaaatatgaaatgctcagaggcttgaattgtagtattcacaactggacagctgaatattaaagatgctgctttgtcccctagaggggctggctactgcaagactggcttccaggggtcataattatgtggccattgccactcaatattttatcatcatacaatactgaggctggcaaatatctatcacgggatgtgcttgttaataatgaagattcccaagccccagtcacagtattctaaataagtagatttggaataagaactgagaatcaactttttgttgttgttaactgataccaaagttaattttcatgcaggtgatacaaagatcgcattttgaaaagcagattcaacaactttagatatggatactttgtctaaaaggacagctttggaaccttcattgttctctgggattttatgtgtgtgtgtgtgtgtgtgtgtgtgtgtgtgtgtgtgtgtgtgtgtgtgtgtgtgtgtgtgtgtatggtggttttcttataaccaccatattctacaaacgagtcaagatatccccattatttcatatcaggaaacttctgtgatcaggttggaaacaactgaaagatgtgcaaaacagcataacctgctgatttaaaaaacagaatcgttttaaaaagttcaacttaagctaaataatcagggtgatgataacaataaccacattcaacaattcatatataagtactatatgttaagaattagtccatcatcatcaccatcaaaggtaacaaaaacattacacattttggccagataattgggacatcaaaaagtaattactattggagttacacaatctgtagccatagttatcagcccagctaggctcactgcttatttgttttgtgtgtgtgtgtttattatttttagtcaagagataattcaaatatgataaaattcaccattttaaaacgtacaattcagtggctttattatattcacaatgttgcacaaccatcaccactaagtccacaacgttttcattaccctaaaagaacctgtatccattaggaatcattccccattccttccttgtcccagtccctggcaaccactaatctactttctatctctattcagagcctgttgcatagcaaatattttctatcccgctttagaatggctaaatgaaattttgagatcatataacctatctattcatataagttttagctatgcttactatgcacctattatcattctgtgcatcccacttaatacagtttgtgcattcccccatgtcactagctatgcctctacagtatcgctttcaatggctgaaggaattccatcaaatagatattgcatagtgcatctaactaatccggtatagttggaatttacatttgaatactgagttttaaaaaatcttggaaccaagtttaaacatttgtgttttgcatttcaagaagtgatttcaaaaagaagccacaggtattaaatcctttctttgcatccgtatatttagagcctcacatggaggtgagacagtgggacagaggaaagctgaaagcctctgtgtctatcaccataccctgtgtgtagagcaattaggaggctagcccttttttatgataaggaatttggtagcccatatggtggcagtccctacataaactttcactgcttagaagtatttcccagagattgtattttaaaagtcccagaatagctgtgttaaagacaaaagtaaagtaagatcaaaagggaacttacgtttatttggcattgtttgtgtgggcagcaccttatccactcacagctagtcttcgaagcattaaactttatttcaacaaagtgtaacattaacatcccagcctgacttgcttctgacttctagcaccaaaaatagagccttttctatgacttaggtgcagaatctacccgtataggaattagcatttgtatgaaaagagctgaaacccagcttctgaatcagccaggattttattattttatttttactacagaagcagagactatcctaataaatcctcctttcttctcctagcacacttaaaaacccatctttgagctccactgactccattaggtttgaactttggtattaagtacacagggaggaaaagagtaggtgtgggggtgacgagaaggagaacagagagaagcacaggagaacagaaaggaagggaggcagcttgatgctactgctgcggttattgcttcactcaaaaacaatgaagcaaaagcagactatgtcaagaagcaaaggtgtgtcaaagacaccccaggcttaacatggggctgcacaaacccacaggaagctcacatgctatttcctagacactctctcacatgaaccactttgacttatgtttccggactccttgatttagtttctgttttagcgtttgcacaataataattttactactaaaagtaaatgtcttgtaaaccaatgggaaacatattgtttggcagagtttataatgtcaggatttacggctctaacactgagggtctctctgacctcgaagataacataatgaaacagcaatgtgctgcatatgactcgttgtgattttttattagttctcataatcgcctcttattaatttgtatgcacataataagcactcaccttcacagtctgtccggcttcggggccatcctagaagtaggaaaaaaccaacagaggtgagaatagatagatggtatctcctgcttattcagaaatatcacccattaataatttagatgcaatttcattgtgtgttaatttatagtattctcatggggaccattggcttcaaatgtgcgggattagacagttctccatttccgcctgagagtaagtgcgaagttatgtataaaaatgatataaattatccagcaagccaactccttgctacttttcatgctctttgctctaggctatggttttaattgcattaaaggaaggctgaaaatgtttggggaggtgaagtatcacaccttctggttatgtttagaggtggtttaattaatgtctgattactttaagcttctactcaggaaatctgctataaacataagccattaaggaagaatatggggtatttcatatgggaagagtcctctggctattctgaccttgtgggagacaaatggtagtgttcattgtagctggacccttttcccaaactggttccctttctctgtttctgaagcttagttggaaatgggcaaactcaccaagtcaccagccataatataaagcaaaagcagatactcagctggttgagatggccaaacaaagcaatggctccacaatcagaaattccaaaatagaatttcacctctgcaactttagccaggtttgtctacctctatgagcctgactaacggggtgagaactcccgccgtaaggattaagcataactgtgtatatcagggattttcaaacttagagtcacaatccattagtgggtcatgaagtcaacttaatgggttgcaatcagcattacaaacaatgtaaatcaggtgttttttttgttgttttttttttttttttttttgagaaagggtcttactcagttgtccaggccagagtatggtggcatgatggcggctcactgcacccttgacctcctggactcaagtgattctcctgcctcagcctcctgagtaactgggactacaggcatgcaccatcatgcctggctaatttttgtatttttcttagggacagggttttgccatgttgcccaagctgatctcaaactcctgagctcaagagagctgccggtcttagcctcccaaagtgctgggattacaggtgtgagccaccacacccagccagaaatcagatcttaatagaataaaaactattagactgcacagaatgagtaaacattgttttgtgaaactctggtttcctttatcaatataggcatatgcatatatttcatatatgtgtgtcaggggagacaggcatgattttgaaataaatatgtatcttactgtaggttacagtaaaaaatagtttgaccacattgcatatacgaaagtactctaggtgctaacacaagtcagctcttacatttatggaattaactttctagtgaaaaatgttccataaccagcaatggccatttcctataaatgtgatttttattcttgtatctcactaaacattaacagaggttttcattcactgccttcatttagtctctccagaaacacggtttgcaacataagcttgataaacccactctgaactgaactacctgcctgaaggggactcaaatggtttgacatacaacacatacacacaaagcatttgggggaagtttagctactcttaacacagacatggcagcaaaaaaagaaagaaaaaaatctgtttgagaagaagatgagcacttttagtcagagccttcataacctgaaaacactggctttctttatctggtctctttgaagctctatggtaaagagctaaggaggggaggaagaatggcaaacattcagtttaactaacaggctgagtacagagtcctcacattttgaaagtgtgtccttctaaagggcaattacagagtcatccaatttcagagccatgaaggactttatacattgataccccagccctttccatagagggcctgaaggagctcatggtatgttactacggatttactcaattccctactgatgactcaccatggacatccttctcccaacctgacaactgttggctcaacctctgcctaaaaatcttcagtgactggggatctgatttcttcactggtcagtgggccacacccaaccagtgaatctagcttctaactaatctgtgatcaatctctgcatcttgaattaaagacagacaaaaggtaaggcccaacctaagctgcatatcactgccaccctggaattagagcagggcttagtctatgcagtgctcaaaaattagttaccatggaatgaaaatgatttttccagtcccagttccagtaagcaatttggaatgtctgaatgtccattaaatcacttatccattactcccacctgcttggtaaacaagcctcagacatcaccttagacactatcccacggtccatcttggggccaatggacagtagggttgccctgcattagaaatctctttttttggctgctacctaaaatacaaacaatcacatctgccctcctggtaagatatcaggaggagcaagcccaatgccgggatatgaaagggaagaaaaatcatttctgagaaatctgtacactcacctgcatggaaaaggtgagagaggtcccatggaaatgtttttccaccactgtcccgactctctgggtcgtctgaaacaaatcggccacttcatcaggacgcaggtcatggaagcgctccactggccgcagcgggcacacaaggacatctgtagcaaggtctgttaaggcccatgctgctggctttgggtagtgttcttaccaagcagttcatacccacaggattgaatcctctcggaccagggcctgaactctcaaagactaaggaatgaagaaacagatatttaccatccactgaactccagagagttgaaagagagctcccatacatggataattacactttgaaggagaagctgtggtatgcagaagaatttcttgcaaaagaaagggacattcgtgtacagacagactcaagtgtatggtgagataattatgcgaggaggcaagatctattctagatcattctctcttgacccctattctaaagctgtgtccgcttcagcagccaaaggcactaggttgaaaaagcaactggaatatctacttggtttctctaggtagaacatggggataaatttttaatttaaattatctctttagagaaataagaaaattatgcaatgaacatacaaaagtagatgtttattttatttttaaaagagtatagacattctgaaaatgtacagtgaactttatccataactaagagaggtgccatgtggttaagcaatttatgacaagagttcctcagactaattttttttttagaatccaaaagaagacatttgaaggtaaatcatgaacgaaaggttgtctgtttattcaaataaagcattcttaatgcattctacaagttagacaaggcaacgtatttacactattggtctcagcaacatataagatctgagaaaaaaggatagaaatttgattacttcttgataggaaattaatattcactgttacaccatcaataacatttcagtcactatacacacatgtatgcacacatgtgtatatacacacactatatatataaatatttgtttagtttttagatactaacaagagaaacaaactcttgtacgtttttctgtttcttttttcttgttgttttaagacagcatgctcctgcctggagctaagcagctgaggggcataataaaaccataattctgcaattgctagtctcactagaatatcaaccccattccgctattggtagaactcagagcccaaggggaaacacaactgagctcagctggtcaggcctgatttccataagagagaggggaagagaaagaagaaactgattaattttgctcataatcaggaaattcatgtcaatggtaaactaggaaaagaagcatttttaaaatcagagttcatttttcaagagaggagaagggaggcgttcacccacagggcatctgatacttaaaaagataattatccatctttggcaggcccgctttattatcatgggtcaatgaaccatttagaaatgaagaatttcctttcatttcctttgagcagattgccagcctccactcccacgaagctgctttttctgtgttaaaagggacccttccccatattcctcctccctgatttgaattacaccctcacttaggcctgacttcaccaaaccacagcaagggtgacaaccatgcaagcttccaacgaagtccataagtgctatgttaggctatgttcacacacagcaactcggtgggggaggaagacatttcacttcaacaatggcttactgtgaaaactggtggaataaatcagacaacctatgtatctaatgtaaatttagtaatatcaatgacatccaaaaatgttttttttcaacaccataaaaaaacttattgtttgtcaattttgcttgtttgcatgttgctcctagaaaaacaactcagggaaagcaaattaattagaagaacagcagatagcttttgtaattctaatgccactttttatatgccaattgttttaaaataatatcacagatgcaatataatttaatttggagcctcttaggccttgttaatgggtaaattccatattatacataggctatgaagacacatttacttctggatcctgtttgcttgggattatctcctctgtcaagatttcttagccaacatgtaggataacctttaaagaattaaagttactatattgaattgaataaatgttttatccagtacatatcatgtgtgaaaacttgtggaactggttaccacttctccctataatctagagtatagagtttttttagcaataatattttttaaaggaagcgaaggtcaatagttataatttaggttgtatagctgacaaggagatttctcacagtagatgaaaaccaaaggcgacttcttagagcagatgagatttaaactggactttaaaaattggggagtgatttaaccagtggattgggctggcaacctactcactcatccatcccaacactgcagtctcctctcagtccagggtctatgctggaacttaggatgctaagatgaccaggacagagtagctgaccttgaagagttcacattctaatgtccgcaactgtcatgcagtgtaaacagatcattacaacacagagagatgaatgctattggtagaaatcagtatagaaagctgtgggagcacaggggaggtcagatctaattctgcctcagggtgttagataaacttttccatctcattttacatttcaccttttaaagtagaacaatttctccacacctagaccaaaatctgtccttaaaaatggtccagaaacttaaggttagcttcaaagaaagttgttaagcgttcctcctttggcccaaatcaccatttcacttttgtacgtactcttacttactcaatctttccaacaaacccataaactattaatactattataattcccatgttgaagatgaattataagcaataatttcttatagaaaattagaaacttgccacaccagcacactcaaaatgagattaaaactagaattcaacccgtctgtccgattctaaagttcatgttattaatgacagtgctgtgatgtcatgcttgttagagctttcatgactccatttttgcctagcctcttattaaaactgtgccctgcattccctagtcactctgttcatagaagggaaccactgttttcattaaatagaaggctatgatgcaaacatgctgaacgcttaagaaacacctaaccttggaaaaagaaagcagacgagacctacaatcccacaatgaaaggaggcctcagcactgggcagtgagtatgccttcatcctaacagagaatcgtaagatcaaaaaggggggagagtaccagcttgcctgaactggaggaagtaaagagggatacaaagctggcattttgccccttctcatcctgactttgggttgcttcaaggtgacttgggctccatcatgggccagactcctgagaaagtttagatactgcagcctctatcactgggtcaggttgtcagacacactgaatccattgcttgttggacagtctaattactgagaattatggaccttctcacaacacatgattcatatcacaagagactaccagaaacttggcaatcctttctttttgttttcccttttcgtctcctcctcttcatgctcaccaccagcccagaactgactatctctctttttgaacatgaacactttaggtgtttttgctgcattaaagtggtgtgaccacatgccaagccctatgctgaactcttgctgacacactgccaactcagaatacacacaatgaaagaaagacatattcgcattagtcaggtgcctagagctggtgtggtttgctatttgcaaatgtgaccacaagaatccctcccatcctacacatgctgttttgctctctggctttcccccactttccatcaagagttgcagtctatttcccctccccttgagtgtctatcttactttgtgtttgtgttgttataaaagaacacctgaagctgggtcgtttacaaagaaaagaggtttatctggctcacagttctgaaggctgtccaagaagcacgatgctggcttctgaatttggtggaggcctcaagatgcttccattcatggcagaagtggaagggaaaacagtttgcagagatcatatggtgagaaaggaggcaagagagacaggagggaggtgccagacccttttcaacaaccagctcttctgggaactaatagagcagtagagagctcactggttaccacaaagatgacatcaagtgattcatgaaggatctgcccccaaacacttcccattagaccctaccgccaacatcagggatcaaatttcaacatgaggtttggagggtcaaatatccaatctatagcagtgttgctgtgtgactttccaaggttaggccttaagtgaccttgaaacctctgattattgctctcttggaagcctgagaccaacatgctataaaaaatcccagctagcctgttaagtggcaacatgaagaaagaactaaggcacctcagctgatagtcagcaataactgtcagagatcatctcagaccttctagagtcaggagagccactgacttccagtttctatatcacttatctactgctgcataataaactaccccaaatcatagagccttaaaacaacattgatcggccgggcgcagtggctcacgcctgtaatcccagcactttgggaggccaaagcgcgcgaatcacctgaggtcagcagttcaagaccagcctggccaacgtggtgaaaccccatctctactaaaaatacaaaaaaaacagctgggcatggtggcgggcatctgtaatcccagctactcaggaggcagagacagaagaatcccttgaatccgggaggtggaggttgcagtgagccaaggtcacgccattgcactccagcctgggctacaagagcaaaactctgtctcaaaacaacaacaacaacaacaaaccaacattgataggttttactaccataagtctgtggatggtttttgctgagggtctcacctggactcactcatgcaactgctttcagatggaaggtaggctggagtctgggctcagctgcatccactaggcccttcactctacatgctcttccatcccaatagatgcagaatctctgaatttgcttaaggcttacattgtcccacattctatcggtcaaagaaaatcacaagccaacccagattcaaggtagagatattctgtcttctaaaaggaggagtggaaagatgacagtcaaaagggatatggacactaggaagttccagggatgtttaaaaattaacaggggcccaaggtatcttggctgtcctagtgagtaaatacaggatggcattttagagttgagatgctcctttttttttttttttttcctgagatggagtttcgctctcgttgcccaggctggagagcaatggcacaatctcagctcagtgcaacctctgcttcctgggttcaagtgattctcctgcctcagcctcccaagtagctgggaatacaggcatgcaccaccatgcccagctaattttgtatttttagtagagatggggtttctccacgttggtcaggctggtcgtaaactcccgaccttaggtgatccacctgccttcacctcccaaagtgctggggttacaggcatgagccgccgtgcccagccgagatggatcttaaacatcaactactccaataccttcactgtcagattttaaaaatagggagagaaaggttacttaacttgttcaaagtcacacagttaggagcacagttgggattggagctcaactggtgagcttccccaaccaaagctctttctgttacactgagatggcaaaacattgcacatctgccactattttccaatggtaaacttatggcagaataatcgaccacagaattctctcctttaaccaaagtgtccccaaatacttgccaatataacctctgagcagtcaacaccagtgagaatgggcacgcgacatgagatgcatgtgccatttctgtggcctcccacactgcctcatgaaacacagaaccaactgcaaaggactggtggagtcagaacaaagggggatgctgcaaaagggagaatcttcccaactacataaaatttccattatgttgccacatttttattcaaaataaatttgataagttcaaaatttgctcatcaaggataataattgattaaaaatatttttaggaggatttccatgacaaatacgaaatatttaaacatggagcactgacagataaatggaaatgtactgattcagatgattaattaaagatgacagcagaatattatgatcggagttgctcagactcgcccccatttagttttctatatctgatctattctagggattcagaatatagaagtcaccaaaataaagcaaatcatcaaaatatcactgattttgattaggctgattagcctgtgtatatattaatatgaagtaaggcagtatcagataatacaacacagaattaatcattcttctgaactaataaaaaagagtctgtattcatctcgactgcagatctgtgtgtagtttagtgataagcaaggaacattccagcttgcaatgcagacctcagcagaccctgtataattcattatttgctctaacaaacactcctaggccttgtaaatgtttaaaataattcttaatgtcacttcacaaaacaatagcaggatggactgtcagctacttttcaagaaaatattcaatttatttgatttaaatagcacaattacagagctttgagtcaaagtaggcggcatctcaaaaagtaatctattcacaacgtaagcactttgatggattttcatatcagaaaggcagaaatatcacccttaaatattaataaatacaattctgaagaagcatcttgctttgtttgggccacaccttttttcagtggggattaacatactcatttcagtaactcaataaagggttcatgggatattcatcaaccataaccataaatgacacagatgtaattttaagcaaatgtgatttccagaatatgataaattccagagcagtgtgattaagataatgataacactctgctcagagctggttctcaaggcaagcatctcacaaatatccactatctcatgttttgccctgggatatgctttgggtcagagatatgatgagaccttgttcatctggaggaagagaacccaggtatccttgtctaggcaacatgccctgagctgccctcaaaactccggtaccgatctggatgctcaaaagtaagaatcactttcatcgagagaagcaaacagttgcctttcaaagaaagtaaattgacaggggagtccgcagcccgatagcattctggtacagattctttggttgaatttcacatatttttctgtgaacttttcaatgcaaagtaatcttatactgattgagggaagagcatcatatctggaaaaaaatatgctcatataaactaagtatgtgggaaagaagtaaatgatatcattaaaggaaagaaacaatatataacatttgtttgctgcctagtatggtctagtgataatcaataaccctttgagttaggataatatcacctcccaatgtccagattcagaagttgaggccaaaaaagtttaactgcataaccaaggtcacgtagctattaagtgaaaatcccagccaggggcatgtgctacaacactgttacaatgtccatgctgtttcaatgcctctcaaggttataaaaacctccatgtataatacctactgcagtgtttactagagtgggatagcagagccctgcttccacgggatgctgttatacattatacagaaaaaaaactgtgcggtcaaagaagattgagaaacactgcatgaaatgaagtaaaatagctctctttaccgcagtattcatcagcatatttactgtactactatgcattctggcttctcaaaaataagaaatagtatgcagcactgctcaaatttgcttatctacaaaataataatgattattaattattagtaatattgtagaacactacacaggacacatgtttcagaggatgttctttggaaaccttgagcatcatttcccaaaacacagagaggcctgagtaatttttctgttttttcaaacaaaaagttgagtacatgtcctattaatcacatgggcaaagaaagagagcattctgtgaaatgaaatatgctgagaagttgagcattaaaatacatcaaatgggatatggcagtcattagtgctgtttgccaaacagttcaggttactgccatgtctgggcatatggtaggccttctggacccttgcagttgggtgaagctcaaggaatacaggtcaaagagttgtgagcgaaaatgatatacgtcacttctgggctaaagcccttaacttctagtatgtgaccgacagctttatttccttcaccaagacaggcagcaatgctttgcaatggtagctgctctggcagtgagaccccgaattataggtcagcaggggcctctgagcatcgtggtcacagtgactagggcaagtttgttcttaaataggttttacctcttttgctaaccccaaccaacttgtagtagctatttacagcagcatgttgaagaggattctgaagctctgataaggagcaggaggaaagaactgaggaatttattagttttggctgccaccagggaggaaaaaaatattagcgtgtataccaagtacctgccattcttcaattagacggcaataaaaatgttttttcaagaattctctctcccccattcttaatgatatagaagtcatttctgggacttgcaatgtctctcagtaaccgttatgaaaatctattattattgttattgtcctagagatatacagaagtgtctagaatttagataattctggttaggagagtactgaaaaggaaaattaactgtcactcgaaagagtctgtccacaatgtgtaaacatgagaatgggaacacaccaatatgaaaatgagcatgttgtaaaaatgctcttaggagttaagacttgaaggagtatggcaatagaagaaataaattgcactcagcagctgaagaaatatttaaagataactccaatgagagattattttaaacttcagatacactttgctatgagaatcatttcaaaaactctgtaaaaagctttttagtgaagtagagatgagaaagtaatactaaaaatctgcaattcattgcagatctagaaaaccacatgcaacataaataatttaatagcaccctcaccatatacacagtttcatttcaccagtatgtgaatgaggggagtgccctgagcacatacctccatagggtggctagagtgaaacctggggcccaaactcccacatagacaggattcttccagtgcaagctctatcaggttttgaaattatggattccaaatttaggtttgcttatgtcatttaagagactaaaaattccagtttccctcagatcttccatatagctggccaagccaatggagcaaccagacaacacagttcagatgccatctgaaggcaaaaagtagccaaactataaatatgaaaggaaagaaataggaaatgagagaaagggagagaggagattaaaggtaggggtggtatttagcagatgaagcctccttagaagagaggaaatactcctttatagataggctcaactaggattcctggtgctacacacagagcttaacatagcattggcctttaataaatacttggtgaaaaaataaatgtcatgtaggcttattcattgtttaatctgggaaacaattctttctaatgaataatttcttcaaaatgctccccaaactgtgggttcttaaaagaccagtgaaccagtccagactcaacttacttaaatgtaaaccattaagaaaaatatacttcatggtaaaaaaaaaaagaattatgaattcctaatacaaatgtaacatacccagctaaagggatagaaaaataaatacaaactggtctttccttcacacatcaaaagtagtgcatgtgttttaaatggaaaacttcagaactattaactcagtgaagcttggaaaagttcaaagataacagtgttctatgctttttaataacaatgaggaaccctcttctatgacagatactaatgttaatagaaacatcctttatttcaaataaatgaaagagagtcacacttaacactaatttggcattctcacagaatatgaatcaacgtctttctctcttaaaatcagtcctccatgagctagcaacctaaaataaatgtgaagatttcgtagtgagaggtattcatcatgtgttcagtgaatgaacttctgaatgaattagtgaaagatcacaaagttgaatattagagaaaaggataaagccaaaagactttcaagaactctgtatttttttgtatattcattcagtaaatatttgtgaattaagagccgactacctggcaagtactatataagacactgaggatacagcacaaccaggtacagtcatcctctcccttccaaagatgtgaaatctagagggtgagcagacaaaggcaactgacatagtaactactgtgaaaatataaggggtgagatgagaaagaaaaggtgcaagaatgcaagggcaagaccgtaacaagccaaaccagctaaggtggctgtgaactaggcccagttcacttggtctaactggatcttcaggaaagagtgcaggcccttgatagccttggtcagcagtctgtatttattcgccatgcatggagaagccactgaagcatttcggagagtggagatgtatgacagattctgggttctctttgcaaagctgaaggccactgggaatatctttattgcagactaggtaaaagattcaaagcaggcctggcctgtggtggtggcagtagagatgcagagaatttgagatgtatgtttgaggtaggagcaacaagacttaactaatgggggcaaaaaggaagagaaggatcaaagaggattccaaggttctggcttgggtagtaggtgaagagtgatgtaattttgagatacggtgggtgggacagtgtcatgtagctcaccatttggagacttttctttcttgaatttatagaattctccagaaataactagagcagagtttcctaacctgggtctacagataggctccagggcttctatgaatctcctgaaattgtttgcaaaatggtgcatatgtgcacgcacacacattgttttcctctggtataaaattcttaaatagtctcctgaccccaactaagataagaaatctagatttaaatcagaagaattctttgaagattagtccccaagagaatgattagaaacaggctcagacttttgctcactttggcttagaatctaatatacccagtactaaagagtaagaaaagaagttcactctgtctgagcaatgtgccataattcacaagcatgaagcctccataaaagacaaacaaaagattttttaatgccataacaccgaagtcattttaatctgattcagcagtgaacaatttaagacatgtctcctccaacaaaggcagctggacacataaagatgattgtgtgatccattcaaaattaaagaataagctaaatcatttacaacaataaaaatgcagaaaattctaccagaaaaaaaaaaaaaaagagagagtgaaaactttcagcagcaagtgatttccaaatgtttccaaaacaggaagcaaaagacattttaatgtcactgtggcagcttccagaatagagtaagttaatcaggcagcctctaaaaacaaagcagcaattcattaaaaacaacaactgctactcagcaatgaactgtactgccagagtgtcaagaaagcaaactttttcaagatagtgatttgtatgcaaatatagctcagcatttatcactaaacctccaaggcctgtaaagggggggaaagaaaagttctttccatctgcttacacctgtctcctaataaaatcaactgccaatcacaggggaggctggggcattttaaaaacagtcaaagaaatacattcacaaatccagggtttcaaacaaaaaactcctgtctactctttcttcttcaaatctcctagcctactgtcctcttcctaaattggagttaatatctgtacctacttcattgggatgttaaaagtgttttttcaaaataatagcatatttcacaccaacaaataaaagctgaacgaatggttggtttagaaaaaaaaaaaatagtcaatggaaatgaaatccttcaaagcttccctcaatccagcaatggtaatgcggttatgtgattgaaacagtgtctcactagcaccagtgttatcgtttggaacccagatcttcattcatctcatgtttaaaatgtctgtacttttctacattccactcacccacccatctccattttctcatttgatctctgttttttatttccccctcataatgtaagcatcactggtagcagagtctaggaattaatcatcttataatcatttagtcttcctctccagttctaacttacgactttttcaaaatatggttgctaacaataaaaaaaatctcaaaatgtgaaaacaaacaatggaaaaatattgtaaatatttaaacgcatttagaatttgcaagtttttttcactctaatgtcatttttcaagctatgtttagacagcacagaacactatatggtttacctaatgtttaaattagtagatctggccaggtgtggtggctcacgcctgtaatcccagcactttgggaggccaaggtgggtgggtcacttgagatcaggagtttgagagcagtctagccaacatggtgcaatcctgtctctactaaaaatacaaaaatcagctaggcatggtggcacacacctgtaatcccagctactcggaaagctgaggcaggagaatttcttgaacccaggaagcagagcttgcagtgagccaagataacgccactgcactctagcctgggtgacagagtgagtaagactgtttcacacacagacacacacacacacacacacacacacacacacacacacacaaaattagtaaacccaataatccacaaagatctataaaaatatgaacttacaagatttctatatatttgaatttcattttgtatataactgaaaaaaaatatttaagcatgcctaaggaaaaagaaaactgtggaaacaaaacaaatgttctggcaattctgcaacagtttcacatttgtatattgttattcctcctgaagaatcctaaaattcactctcattttctttatatgcttagatattaaaaacatgtctttgacaaccaacagtcttctgtcatggggaatcagacatcggccccataatctctcattaccaacatcaccattgtcactgtctttaccatcatcacttaaaagaaaatagaaactgcttaaataaccacagctaaaataagtgtcacaagtttcttactgattaaatgctcctccgcgagactgcaacctcgaatactacgccatagagttcagattccaacacctttaatgtttctataaggaaaaaaaaccacaagcgttctccctgaaaacgtactcttaactcagaatctcttctggttccatttagtttataaaaaaaaaaaaaagaataattcagattgaaggatagtattttggattttcagtgttattgatattcctcgatccatcataatttagctaacatagatcactgcctatagagcagtgctgtctagtggaactttctatatcctatactgttcaatatagtagccactagccatatgtggctactgagcacttgaaatatggctgatgtaatcaaccatatttaattgcattttgttttaattttaattttacatttaaaaattaaatttaaactttacattttaaataccaccctgtagctagtaatcacttgtagctagtagctattacattgtacagttcatcaggagaggccacaaatttatggtaacaaggagtggtggaactggcacaactggaaaacacatgccccaaggtgggtggccaccacctagagatttttttgttcctgaagaaactagaaatttgaattgctatgtgtaattctcttctatttaacttttggcaactataggcagtccttctcatggttccaatatgcacatatttcagttactccagtttaaacaacaccaattccccaacaacacggtttaaatttcagttaccatgtcacattaactctgggtcattgggtaaagtacaagctccactactagctcttcaattcacaaattaccatgtagatcatagatgtgcatgatgatcagagaccagtcacatcacttcttccaaagtctgtcagtgactgatcactgcacatctggtattcagtcagaggcagccagcaaagtatgtagttttgtatcccactgatcttccagtgatgaacccacatatttcaccaaaatggataatcgaaagagggaactggccaagaaatatgaaacacaagtgaccaaaaacaaaaacaaaaaaccaaatgtgacaaccccagaagtgcactttgaatcaaatgtaaataaaattatagaacaaataactgactttgggaatgccaattgcgctgatgttcaggagattctagatatgtaacccaaggaatttagtaaagacaaacttattaacataaattaccaaagaatttatgatgcagaagaaaaagatgtaccagaggaagtgacatcaaaaaagtcacattttaaaaaacgtcctatttcatgacattgaaaacacaaaggatgaaatattggaaggagatccacactttaggagggattatgacaatcagccaaagcacagaaaagatgccccatctgtactgttagttgcaggataagaaaaacaaggcaagaattgttcaagagactctcaataagtgattttcaaagaaataaagcacttcaattcttagtgtttctaatgttttaaattacagtgtactaaattagtattagttcgttttttacttctttcattatatttttctatttctttatactctgataacttatagagggtttttaatgattagagaaaaacgttaaaggtcatagaacagtcatacgttttcccattgattactaagtggacattgcatggtttccgcttgcgtggtcatttttatagtcccacactgctgtataagatgaggggtacttgtacttccaatgtgttaaaaaatattgggtggggcaaataaaacatataggtaacaggccacaaatttaaaacctgtgccaagaactagtgtcatatgtgatgtgcatcttaatattaggagagagcagatgaaggaaaatcaaggactgtgactttaaaaagacatatatatgcagtctctctccagaaagagcagacccgtcgtcatatgctcctgaattctcccaccacactgcctggcaaaattaaagtcaaagttctcttttgtttcccaagtagcctgagaactgcatgttactgtctacctaaataacagaggctctctaaaagaaaatgatatttattgagaaatgggccttgtcttgggaatacatgtgccacagtaaattatgagtattcagccaggtgaaggaagacaaaggtttttaaagggcaagtgaggagaattacctaattgttttgaggtaattatccttggttactaggatcaataacattgtagcaccagaaagaggttggacaggcagttgttgggcagatgtcctcatagaagcattgtgtgtgtgtgtgtgtctgtgtgtgtgtgtgtgtgtgtgtgtgtgtgtacaaatgtgatggccttggtgcagcgtggctttttgcagagtcttttatgatagtttttgttatcaggcatttgtacatgagaacgctcccgtcatggcctttcctagctctatttgtcagggttttgtttgtgactccatttgattctgacaacttttatattatcaaacctcctgaactctgaatgcatcattaaacctggctgttagcattaaggtttccccaccaaatgttctcttgtacatcacaatatgactgaagggagattacataatgagtaacatcaataccatgcatgttctatattccatatggataatgcgcaacaagcaaaattcctgccaaaatccttattttgacacaaaaaacagaatgcagctatagctgtatgttttccttcacaatgttccactataggccctttctgtagtgcattatctgccgctggtccagaagctctttaaaaacagaggccacttatttttcatccttggatccaaagaccagcatatggagcccaggttaggacagatgtcacctcttagtagacttatcaatcccatcccatgaaggtatccctccttccttttcttcccatttgtttgtatccctcatagcttatatcaatcttgaaattttagtactcatttatgattacttgttttctattgagaatgcaaactgaaatgagggcagaaatcaggaatgtctgcttctcagctgtattctacctggatacagtatactgcccatagagcacttgctaaacactgaattggtgggtcaatggatggatggatggctgggatgcatggacggatggtagatgactgggtgggtggtttgaaaaaatgtctaagggaatgactattagaacgaatgactgttgaatgaattactgtttcattaataaataaaaataaataaataaaagctaaaactattattttagtaagtagagagtagaaaaaataactgttattttcttaatgttttataaccataaacataacattctctgggttgtcttccttttcccaagttatgtcctcagataaatctaaaaatgagaattcttccaatgggtgatctcccctggtccagtccactatttgctgaactacaagatggagaagtttcactttgcagcagcatgtgtgaaaacagcttggaaatttttgtagagaataagctcaagaagagtcaacagagaaatgttgtttctacaaaacacgttttatctcagattgtgaatgcaagtctggtgttgagttgagggaggtgatttctcactctgatcttattgacagggatagtcatggagttttctgtcaacctgggagccaccaggaacagcctatagcacattcacaaaagagatcagtatggctgaagaaaatcaaagaaaagagaaatgaggaaacaagggtcaacctttgactatagcattgcaaaggcagtcattctaggaaggaggaaagatgcaggtgaaccaactagtaaatggtagaacagaatctgaatccagcatatgacctgtggagtgactcagatctggattccaattccatttttgccactttttagccatttgactctgggcaaataaactcttatcagtaacctcacctgcaaaatggggcttatttattctcatggaactgcatttcagagtaaccaaacagcaccaatgatggacaattcttcaaagaattctagcattaaaagcaaaaggacccccaccattttaaatccctaaaaatataactgactcatgcaaaattatcaacaggtaatttggggcttaggtcaggagttcttaacctgggggtcccacagaggcttagcagagggtgcatggataaaaggaaggaaacacatgaacatgaatgaaaaaaatgacacacagttatttttactaatttttaactaaaattttgtatcttattaaatcacagatgtaggcaatgaaccactgtagtaacagcagtacctatgagttgtgtcacagtataaatcacaggtatttaaaaaatatgtaaagtaataacttgatagttattgcagttaccttgaaatatcatttattctagaagtacttatcattacaattactatcacacaattatgatggtcattatagctgctaccacttctcattatttaatatgtaataaagaaatgcataattcactgtatcacaaatttgctgttaatactgtgttaactggtattaaataacatgaatttccttggtacttctctatacttaactgtccttaattaaaatcattattgggtgggagggttgctcgaggctaggagtttcaatccagcctgggcaaagtagtgagaccccatatctaaaaaaaattagctgggcatagtggcgtgcacgtgtggtctcagctactcaggagactgagatgggaggactgcttgagcctaggagttcaaagttgcagtaagctatgatcatactactgcactccagcctaggtgaaggagcaagaccgtaccttgaaaaaaataataaaaataaaaaataaaaacattattgggggaaaaggtatacaagcgtcaccaacagccaaaaaggtgactgaaccaaaaaggttaagaactcctgctttggatgaaagtgtgacgggaaactttataatggagaaccaggctgtcactacctaaatctgctgatcaatttcaggattctaagagcaggacatccagacattatgcctccctatacactgtgatttgaagcacataatactactactacaaatgcttatatctgaaaataatccatagacccgcagctgtctaatagaactttttgcgattgtttacactatgcaacacagcagacactagctgcatttgaaatgtggctagagcaaagaagcaacctgaatttctaattttacttaagtgtataatcagccacctatagctagcatctaccctggagcccaccttagagctaacttactttacaccaaacacaagatagagaaacaagttaagtaacactaaagggaagcaaacagacaaatccgtactatagaacagtctacaggacaactgactcagttaaaaaaaaattcaatggcataacaatattggattaaaacagcactaaaacaaataataacctaatataaggtgtggatcttttttggatcctgatccaaccaagcaatgataaaaagacattttaaaacagtcaaagaacttgactactgcattaagaaattcctattaattttgtgaaatatgataatggggccaggtgcagtggctcatgcctgtaatgagcactttgagaggctgaggcggggggatcacctgaggccaggagttcaagacaagcctgaccaacatggagaaaccccgtctctactaaaaatacaaatcagccgggcgtggtggcgcatgcctgtaatctcagctactcaggaggttgaggcaggagaatcgcttgaacctgggaggcagaggctgcggtgagccaagatcgcgccattgcactccagcctaggcaacaagaacgaaactccatcccaaaaaaaaaagagagaaagaaagaaaagaaagaaagaaaaagaaatatgataataatattgccaattagggaattttcgtagtctttaaagatacatgctgatgtgtgtagagctaagaaaatacttctagcaattgccttaaaatatttcagcaaaaactcaagtggataaatgaagcaagtgtggcaaaatccgaatgacatttgaatctggttgaaggtaaacaggccatcctttgtattgtttttggtgctttttctgagtatgtctgaaacatttcaaaattaattttaaatgggataatgcattgggtacagtgaccaacacatagtaaacattcagtaaatgttaattagcaagtattagcatcatcaacattatcatttatgttctcaaaagtcaaaactaagatcaatcagtaaaaaatacaaagaggtagctttcagcttcatctaagaacaggctctgggaagatgaaaatacaccgtctcgtgagggagtagccaacagcatattcaagataacaataacagcagtgacttacatgattgagtacttataatggggcagatgtggttctaagcactttccatataacccctcactcaatcttcacaacaatttcataaggtaggtactctaactgtccctgctggagcagagattgatcacttggtgaggatgctgcagaagagggtcaaggtgaatggctttgctagttgccctttaacatccctgataaccctgaactcctctgattcaatgaacatgtcattcagatgaattgtgcaggttggccagctggctggctcacacacacatacagggcaattcttgcttttacttactgaaaggtctttaaacaccacctttccctttcaagtaggagactaaaacgtcacaggaatttaattatctgtaggcaagaagatgatatgatcaagaaaatgctacatttaaactactccatttacccactttcaaatttcccatcaattagaggggaacatcttccctaggcagccatttgaccaagaaatgtccgtggtatatcttcgtcaacatgtttcagaatataaatccagattacacaaactaaagttggtataaaggctgtcatcatatattatatcatttggaaagaaatattggtgaccttatccagtatgactgttataatggtaataaaattgaatctttgaagattacacttctggtcaaagtagtaaaatgtgaccttattctattcaacattgacatttattatattaatttacatgtaaaaaactgcattagaatgatattaaagccctggttagaaatgttagaaatgggaatgttcaagaacttcagaaataagatttcactttaccagccattcacagcattgagtttgtttgatgcaaattaaactaaatttccttcaccaatctctgattcggttctaattttattattatcactatctcattcatacaggagatatttttcccaatgcctctttaaacattttataaaccttaactcattttcatcatgctctggataaaaagataacacagagcactgaatatataaacctgagtcagaggatcaagccatctgcttatgacggggagagtctcctcagcccagtaaaaatgagcttagcgatgagtatacatcagatagtgcactaggtcctagaaggataccaaggtccagaggtgagaaaagagagtcagaccgccacgtgggtttcacagaatggccaccatgcagcaaaaagatcgctcttgttgcccaggctggagtgcaatggcacagtctctgctcactgcaacccctgcctcctgggttcaagcaattttcctgcctcagcctcccgagtagctgggattacaggtgcctgccaccatgcccagctaattttttgtatttttagtagagaagaggtttcaccttgttggccaggctagtctcgaactccttgccttggcctcccaaagtgttgggattacaggcgtgagccaccacacccagccaaaaacatttttttatactggtcaaaattttatagggaggtccctcccttaaatataagttttgcaaactttcagtttgggggtagaacatggaatcatgcaatgaattaaggacaagattcagccacacctcaacagattattctattttcaccattagcccaaagtccaggcttgctaggatgggtcccaactgtccttccaattttgtttctcactattctcgccagcacttcaaggttccaaccaaaattaactttttgctatgtatttcctcatatgccttagttaatattgtcttctactctgaatatcttttgactttctatcaataggttaagctaggtgttgctatgataacaagcagtcccagcatttcagaagcttgtaacaaaaaaggtttacttcttgcctgctatttgtccatggtgggccagcagatcagctctgcccatctctggcactctgatatccaggctaagagagcaaaaaccagctcaaatactgttaggaaccatcccaaggggaagagaaaactgcagggtcttacaccagaagttaggtgcttagtccaaagtgacacaattcactgccataactagtcatgtggttccaccaaaccacaagaagcataatgctaccatacacctggaagaaagaagaactaaaaatatttggtcaataccatcaatgactccctatctccatgtgtcccaaatctgataatttttccagatctaagttagattccacctcctcctaaaagaaaaccacagtccttcctgctaaaaggaaaccgttcatatggttaatatacagagcatgttattttacctcataagactctcatgactctctgagaaccgtgtctctattggaattccgtgtttcccataatgccttgctagataaatactgcttgaatgattgaacaaggctgtctgtataatgagagtttcatctccaaagacttcgaataccctggaggctagtaatacgtggtaagcaataaaactttattttttcttatttatatcataaagatacttaaaacaatattaaaatgatcataaagatgaaataaaaatgagcccatagtcccgccaccctaaaccaacaaatgttttcatttcttttcctcctggtcctattcaaagggcatccatttcctttacatagctgtattcagggtgcatacaaagagagaattctaaatagaacagaagtaactgcccagtcaacaggttttgtttgtttgtttgtttgtttttgctcttccccaagatagagacacattgggccatatcctaatactgagacttattttctgcaataaaatttccgttaatttaaagcttctaagctgtttaatacagtcaccatcattaggaaatatcagtgtagtcttcaccactacttcctctccttggctcaacactggaagaaattgcctctagtgaaaggagattgacttccaacatgagaagaaggaagaaaaggagaagtgtgtgctaaatcttggacagttctggggaacatcgtagaccaacgtcaccttgtcacggtccgacgttaagacatcattaacaagagctaacaaccaacattgaagttttaacctcattcgtgaatttatctgattattattttgctccatttagctcatccaattcttttcattttatcatgcactctttttatttgtgtagtctgagttgaaccttttctaaaacaaggtagaaaatacatacataatgcttcaaaaaaatgttttccatactgccaaataggcactaggaagtctcaccagagttgataaacaatctagatggccatttaacccactcagcttacttaaaaccaagtctttcttttttttttttttttgagacggagtcttgctctgtcgcccgagtgcagtggcgaaatcttggctcactgcaacctccgcctcccaggttcaagcaattctcatgcttcagcctcctgagtagctgggactacaggcacgcaccaccgcactggctaatttttgtatttttagtagagacagggtttcaccatgatggccagcctggtctcgaactcctaacctcaggtgatccgcccgacttggcctctcaaagtgctgggattacaggcatgagccactgcacccggcctaaaaccaagtaagtcttaaaatttgtactcagaactactttttttttttgagatggagtcttgctctgtcacccaggctggagtgcagtgacatgatctcggctcactgcaacctctgcctcccgggttcaagcaattctcccgcctcagcctcccaagtagctgggactacaggtgcatactgccatgcccggctaattttttgtattttagtagagacagggtttcattgtattgcccaggctggtcttgaactcctgagctcaggcaatctgcccgcctcggcctcccaaagtgttgggattacaggtgtgaggcactgtaccttgcctcagagctacttctatactgagaataaataaacacccaaacacctttcaatgttattaaatttcagagtaatgactttttgtctattttctattttaatagctgatagattagtaggttttcaagctatattttaaaattttatgttcagtttcctaaccactgccacatgtacacataatttatactcttacatttttgaaagggtttattattttatgtgctatagttattgatctgaatcaaatctttcttacttgattcaacagactatagtgggaataaaatgtgactatttacgaatgttaaccactgctgtaattcatatgaaatctgccaagcctattatattaggaataatgttatatattttatctaagagtctgataacacctacctcaagtctaaatattctctgaaaaatttgtcagaataaaacaagtgcccttaaataatattttcaggtataactgcagacagttgcttgtacgtttgtctttaactttaatactgtctcaatatgcatgaaacgcttgatagttcaatagttgttttcatgagttgtgccttcattaaggtacaaaacattaaacacctggaatgctgctcgaactattcctaagggagaaattttggtgacaaatgaaagggatacatttttaagctgaaaaagttgctcgctactgataaaagaatttatatcagaatattccaatagagcagaagaaagcaacatgaaaagaaaattaacattcattaagaaacagctaccatggtgcgaaacaaagatcacaaagccaaaactgaacaacaatcaaatttctacacaaaaaataagacacatacaatgcctacagttccgattgtctaatgctgtgtaacaaactaccctaaaactaagtgacttaaataacggtcattatgtactgcctcttatggtttctggagggggtggtcaggaattttggatcatctcagtcagaaggtctggctctgaactttcatgacactccagtcataccgtggctgagactagggccatctcagtggcttctatatgtatgcctgaaacctaagctaggatttgaatagttaggggcatccctctctggctccttaaggtgtttccatgtgctctctcccatacggtggcttcaaggtagccagacttatcatatattgccttgaggttcccaagacatatatctcaagctagaaagaaaaccaagaaaagccaaagttcctttaaggacctagtcttaaaactcatttggccttacttctcccatcatctgagcagctccacttttatctgtttcatacatggggctttggcataagagcatgttgaccaaaggctgtcaaagtaaccaaacataaaaagtttaaaagctagtggctgggatgaagtctaatgccccaaacttcaacaaagctaggtgatggaaaaatactgctgaggggaaggctgcttaggtgatgggcaagagagtccttggagaatgcagataatcaaaacagcacctaattaaggtacagataattgagagctggattatcactaagattgtatgtataaagatgcactaaatatcttattttcaatttctcttatttttctatactgttataatagaaataatgtaataacagcaaaagcaaaaaatagtcctataaagtgttcacatggtgaattcaatactttcacactgggaagatgatggtggaagatagtatctcaggcagtgcagtccaatggaagatcttagaaccaaatgtattgagttgaaaacattaatgctgtcatttctgagccatcttaactttggcaaagtaattaacctgtcagagtctaaatgtcctcatctgtgaaatggaagaaattatgagttcacaaatttacactgaagagtcactgatccaccattctttaattcagtcataaaatatttatggagagccaaatatatgccaggtatgatatggtatggaaatacaataatgagccaaatgcctacaataatcaatcaccaaacaaatgtttatcttaagatgacacccataaacatgtccaacaaagatagtgtcaaaaaattgatgtcacctaatgaataatttccttctttctttttatttatttatttatttttttgagacagagtcttgctctgtctccaggctggagtacaatgatgtgatctcggctcactgcaacctccgcctcccaggctcaagcaattctcctgcttcagcctcccgagtagctgggattacaggcatgtaccaccatgcccagctaatttttctatttttagtagagacggggtttcaccatgttggtcaggatggtctcgatctcttgacctggtgatccacccacctcggcctcccaaagtgctgggattacaggcatgagccaccgcgcctggcctttccttctttcttgaccttcctttcttcataccataactcagtgataattagtagggggtgaaacagagccataatacattcatttgtgaatctcccctgtcctcctcacacttaccttttctctattcccttctcccaagcctggttctggctctctcatgcttcagaatctgtgaaattggttcggagggcttcaagagaactgcggaggctaagcctgtatcataaagatttaggactaggggagaggaagcgaacacaaagaaaagttggaccatgtaagaactagaaggagagactggggagctggtcctggagtgactccagggcaccaacatgtaggggagaaatactgctgaggggaatgacatgatttctgtttctttgagagattcaagactggatttccttttaattaacatggggtggctgatctatacttcttgaaggcaactctaggtgggggtaaaccacctggggcctcaagatttattaggacctcacaatagcaaacctgttgctcccctaaaagctagaaaggggggtttacaaaggagataaaccacaggtgtcagatatgtatccaaaacatctctctgaaggacttttctcaataaaaaaaagctactgatgcatttaaaattaagtaataaaacaagaagtacctgtgcatgaaatatttttacatctcccacctccaaccctgaagccatcctattagcaacctaccctatgatcctgacatgacccgacagaaggagacttgcagatccaactgctcctcagactctcacttgcacagggggcattttcaacatgtccagggagcatttgctgccttgataatgacctttgaggagaggaaaccaactcagaagtaccttcatcctccttttagtttgtcttttatgtttttttcttgagccaatgacttctttcagacagcaataatttacacttcaggaaaatgtcaaagtatagcaatgccctgaataataattaccgccaaggttggaatgaagcctttcgaagaaatgctaagttaattagccacacacttgtttaccattaggccagtggagaaaacaaggagcacaggatcagaacatgcctgcaacatatggtctttattaatggcggcatctcaattagtctatgggaccccacttctgtcaacccagagatgatctgaataaagaaggagaagaaatgttcacaaagctgtcatggggagaagatgctacctgagaccactcaggacacccacaaaagaaacttggatttctgttgttttctgtcataccttcatacatgaaattgcctcttttaatctttccacaatgcatttgttttgggacaaaggtcaagagaagggcagattaggaaataaggaggtttacccattattaccaaaaatctatttaaaaaatcatgtttccatgaatatctcaatttatcccttctaattcttattctcatttctgaaatatatactttgtttagctttttggaaaaatccacattttaaagaagtatacaataaaaaaataatactccttatttacatgcttctgcaatcatggccgcctttccacagaacactctcagacgaaggcccttttgtgccggcctacttagatgttaccaaaggtgtacaaaaacgcatctcttgcagatggctggaagatagctctgagctctttgtgttcaatcaatcccccaggaaaaggcattagaaatttattagaagcagctccctgttctcctcagtttctgagcttggaaaaagcacactacactgaaaaagcattttgaatggaaaatgtaacctgaagtatcttacttttttctttcctccatagtcctaccatcgatatatcctttgtaggactctattagtttgctaggacgagcataacaaaataccaagtaccacaaactggctggcttagaaaagagacatgtacgatcccacagttctgaggacaggggcctaaaccaatgggtcaccagggttggttccttctgaggactgtgaaggaggatgtgttccaggactctctccttggcttgtggatggctgtcttcttgatggatttcctcacactgtcttccctctttgcttgtctgttgctatgtctaaatttccctttctttaagaatacaagtcatattgcactagggcccaccccagtgacctcatcttaacctgattacctctgtaaaggccgtctccagatacactcacattcagaggcactagggattaggacttcaacttatctttctttgcaagggatacaattcaacccataacagagatgagtaaaaaaaaaagatattaatgttcaaaaaattaagtaaccaaacataaaaactttaaaagctagtggctgggataatgtctaatgccccaaagtggaaaggtaccattgtcacatatttcaaagaggaaaggtaccattgccacctatttccctggctgtttgttaccttgatgaagtgtctactgtggcaaggcattatgcatggcactgggcaacagagggaaaaaaacatggagcctctatgctcatgaatttaccctctccttttatgccagccttttcaacctgggggaaagtggactggctagagtactaatcaagctgtgaaggactttgggcttctacttcattctcccttgcattgacagctggacagttaaaagcagcaacaccaacagctgcacagcacccaactcatcaacccacaacaacggtgacatcacctaagttagcatggaagtggccagtctgcttttgccaattctttgggacattaaacccatgataatacttttaatataattctgtgtgaaccaataatgatgacaaactattcttcttgcctggttggagataataagtaacaatacctcctattttctacgaactgtactttttttctagcaccgtgccaggcacttaccatgataattttatgccattttcacaaggtgagactgatattactagctccattttacagatggagagattacatgtcttgctaaagctaccagctaatacagagtaaaggttaaatctgaaatcaaggtgtctagaaaatcaaccccatgctcttgagccttacacaatagtgtctctttcaaccttttgaacctgagcacttatgacaactgcccagtatatgtgtacacatattctgtgcatgttatagatagacagatagatagatagataaaatatctattttctccccccaaaatctatgactaatgcaataaacctcccactgattagacagttatggctttttctcacatctccatcagtgacataacatattaagcaaaaaagtccgacccagctgattagtatttgatgtgctgaagagcctaatgtttctttatatgaaacatcagacagtggcagcctacttaattactaggttgactttatgtcttcaaaataataaaacagaataatccaaacgacaggccaacgtggtgagtgatatttgaacatctactcgaccctaaaactgttaaagcaaaagtacttatccaaaatccaatactttccatttttcttttaaatgttgtaagtcaaaaccagctaaattgattttttgcctttgacttctgctgaaaagttcattcctaagcagattacatgtgtggctttgcagctcagaggaaattttacagccaagtaaaaccctaaaatcaggaaaacatgggtttgctgaatacagtagaaagacgtgacagatcttaattataaaagaacaaatatatcttgatagatgaactgtcttttgtgaattaagactcaaaagttttaactccttgattaaccgttacccattagtaatatagaaagttgtgaggcaacgtcttcaaacttctaagtagaacagagcactcccaaagcatgcagaaccccctgtaacatcactcaacgcattttcagcatgagtgcccagggtaagccttcctcacaatgttgcaaagcaaatcgtgtccctcattcccttttctactcccagcactccttggttaagtgttttaacagggtaagtgatgacggtacaggaagagaagaaggaagaggaggagaaagaacaacaatgatatcatggtaaaggcctgtagaaattgatctaccagacaaaactcaagagctcatatgatacaggattttgcttgcacatggtcacaattaaataaatgatgaaaatgagactcaaatatagattgtatacctcattccactgttacaagctttcttctaaatgaggaatcatcaaaaccaaacagaagtgtctatcttaggtcaccttaccctcttttctgattgttgaaattaaggcagtgcaagaaacctggggagacactggaaagtgtccccatgccaagccctgtgagcacaatgagctcatgaaagaaaagcccagagccaacaactaataatcgtgcttaaaactcatcatttaagaatttcaaaataaacactgatcaattgaagttattttgacccaaagtcttacgtaccttcttttgcttgtccatattggccatcataaaaaacagcaaaaaaaagaaagaaagaaacaaagatggggagttgttgcttaatgggtatacagtttcagtttcgtaagatgagtgagttctgaagatctgttgcacagtaatgtgagtatgtttaacactacagaactgtacacttaaaatggttaaaatgatgtattattccattaacttaaaatggttaaaatgatgtattattctcaggtatgataaagacatacctgagactgggcaatttacaaaagaaagaggtttaatggacttacagttccacatggctggggaggcctcacaatcatggcagaagacaaggaggagcaagtcacttcttacatggatggcagcaggcaaagagagagtttgtgcagggaaactcccccttacaaaaccatcagatcttatgagactcacccaccatcatgagaacagcttgggaaagacctgcccccatgattcaattacctcccactgtatccctcccacaacacgtgagatttgggtggggacacagccaaacaatatcaaatgataaattttatgtttttttaatggaaaataaaatttaaaagaaggaaaaagaattctctccccttccctctctccctacctccctaccttgctttctcccctccagggaagacatgtgcctccaggatggaaacaaatggattgatctggaaaatacttaggaggcagaactgaaaaaatttgaatgtgaggatgagaaacagggagatcatgggtgatttccaagtctctggatcaactgaaatggagaatggataaggaggaacacctggaggagagcacgcttggaaaggcatggtgagtttcatctaactagagatcaccagcaggagtctgccctgtccatctggagcccaggaaggagggttagggtggagattctgtacatttctacagccaactctaatttttggttacaatcaaagcctatgcccttctaaaacctttttcttccatcactaatgatcagctgtgtttccagaagtatgaatggatttatcctatatttctgcctaatatttcatatatgaatacttctaggcaggcattgggtcatatgtgtaaaacgaaagcaagtacttaacacaatagaccattcaataaagctgcttttcacatgcttcatttactactttccattgcctttttcgcaagcaattaccatctcacacatgcccagtttcaccattctgcagaaccaaatgttgaatttaggcaaacatagggtgttcaataaacaggtggattttgaacagaacaccaatgaattcaggaagcacggtcaaccagctgcgtctgtcaatggaataatcagtagctggctgcatctgtgctggctgggctgccatcggtgtttacaagctggaattgaagagggctcggccagctgacagcagaagtttgcgcagcacctgtctaaagtatatatgactgcctccaggcaatcccattagttctccactttcatggacactaggacttgttcacaaatttagggggaaaaataaaaaagacaaacagagctagcctctgactgagaaaggacacctgaaagagaaacaatcccatatggagaaacagaacaagggggtgagaatgagaaagacaagaaatcactcaagaaagccagtaatgtttacagatagtagaaaaattttgtctgtaaacagtgggcttggtagcatttttttaaatcagagatgttctggagaaatatgtaaagaactcagcccaagctttctgatgccaggcagggcataagtagtttacatggaaccttctgacttgtttatctgacatagtaaacagctttctctgatcccactgtcccttttacgcattacaagataacaaaaagttatgcgattttaggaaatcaagtatataaacagggctattctcagcacatccactgaatattaagtgcccacttttatctgctagaacttgatgtgtgaaggtaaccaacttaaatgcactgaagagattgcattcacacagtgaatagtgacattttgctaggaatttgttaaattttataatgcaagcatactgccgtaatgttccacaaaacgtaacagtcggtgcacagcaatactgccctctggtttgtgagggctatttccatcctcaattcattctagcaggaaaaagaaattaaagatatgatagaatgctatccacattgttataatgctggttctttctgaggttagtggtcacacacagtgctatagaggcggttgttctttcttgtgcctgtaactgctgaggttaatctctcagtgcttccaaatgcatatggacatttacacatatggacactgaccaatcctaaaagaaaactcaggataaatcatgttcaacttcaaaagtccagcagctaattcaaagccatgctcttgtagaaggagccattgaaaacaacagagaaaccagacaacagtctttaacgtcttatctttgtttatgattcttaagaccacacctggcgtgaaccgatatgctaggtcaccctggttcctcaggtgcattaggcatatgtgagcagtgaaactatgacaaccagaatgcaacatccaattataatgattagaataacaacaaacacttaggcaataattatttccattcattcacttcatctccccaataactctacgaggtaagtacaattattattccccacttcatggaccactcagtgccatactaagagtcccagagccagtaacgagcagactagatttaagatcaaccccatctgacttaggggttctgctcttactgttgttctgtacctaaagctatctgatgtattttaaaatgtaggtgtatcagtttggtggggttgccataaccgtgagttgggtggcttaaacagcagaaatttttcttacagttctagaaactgaaagtccaagatcaaggcatgggcaggtttggtttctcctgaggcctctctctccccttggcttgcagatggtcttcaccgtgtgtgcaccttcctggtatgcctttgtgtgtcctaatctcctccacgtataagaacatcagccagaccagattgggacccaccgtaatggtttcattttaagttctctctttctttgttttcttcttttgagacagagtctcactctgctgtccaggctggagtgcagtggcgtgatctcagatcactgcaccttctgcctcctgggttcaagctattctcctgcctcagcctcccgagtagctgggactacggacatgtgccaccacgcttccctaattttttgtatttttagtagagatggggtttcactatgttagccaggatgggctcgatctcctgacctcgtgatccacctgcctcggcctcccagagtgctgggattacaggcgtgagtctctacgaccggccttaagttctcttttcaaaggccttagctacaaatgcggtcacattctgaggtactgtgggttagggcttcggtgtgaatttttggggaaaccacaacgcaccccataacagcaggtgtgttaacgttctacaaaacgcaacggtgggtgaattgtaggacttccctctgctttatgagggcttaattgtatagggccttattttggatctttccacattcaacaagttctgagaatgtgatacttggaaaccatgttcatcagaagagtgaaaggctttcaggtaaacgtcctttgatctttttcaccgtgatgccctccgatgacattaactgtggtagtaaccagcatcattcagttgctgttttagaaggaacttaaaaatggaagatttgaaaacatgattgtgaaaccataattttgcactgagtccagtattaacagtttttcaacagagttaactcttgctgctttttgttttaaccctgagtgtctagaactgagttgggcaagctccttaacccacagcacaccagcagcctagaactctccaagatgtcacttggattttccttctgacctgcctttcctgatcccttgctacctcaccctatagacataggcttacttttccctaatattttcctgtactttaacgcatagctgtgtttttatgaaaaataaaatactggggttttatgctcaacttatttaaatgatatttcactacaaattatgttcttcttctatttgtttacatcattatgcttttgaaaaccaccagaatatgtatgtgtacctctggatctaagctgttaaacatagtagccactagccacatgcagctaccgggcatttgaaatacggctcatgcaagtggaaaactaaatttgtaattttaatttatctttaatttaaatttgaaaacctgtatcttaattatgagaatacttttaaatatttttggaatatcttgatgaatcttcttttttcagttgtacattttataaaacttaaatatgaatcaatcagttccaatgaaaatttagcctctgatttaagatgtactataaaatacacatcagatactgaaaatagtacaaaataggaatgtaaaacatatcagtaagttttatgttgatgatatactgaaatactactttacatatattaaataaaatacagcattaacatgatcacctaattctttaaatttaaaaaagtaaaaataaattttcttggtacttttttgtgtggctactaaaaatctttaaattacacatgtggttcacattatacttctaccagacaggggtgatctaggttttaattcctctaactactacaagtattctataataagcataaataataattttacttcattctcttatcagcaggcaaatagattgtttctaattctttaccatatcaaacaaccctccaaattcctgtttttatgcatcctcactaatacttattatgatctttcttgttgcttttggtcaacttggtggttatagagcagtgtttcttatttaaatattcatgtctcagaatactgaaagtgtacatattagccattcaaagttcccctttcgtaaactgcccatttatatctttgcttattaaaaattttgaattcacatcttttatttaccaattagtagaagtaaaaagatatattcccagtataaatctcttgtccactgttagacgtaatttttcagctattatacgtatctccaatattttcttagcttgtactttgttcatttttcccatagtttatttcattgaacacaaatctttaattataattaaattccttaaattttacctttattatttcaagaaattctaccctagtaagaaattgtgaagaaatttcatcttttctactcttggtttatagtttcgccttccatatttggatcttcagtccatcatgaagccctatagcacttagagcagcagatggttgccaacatcctaggcttaggtacttgccatttgagaatctgaacaaaactgaagactttcttactgaaagaatgtatgtgcataaaatactatatatataatttcaggctgttcccagacctctactgcaagccctttcatgtatccttatgcagtccacagaatccaggcgcaggatccccgagtctcacagattctactctctattcaaaaacttcattgtatttttcatggctttgctcaccatctttttctgggttatctcatattctcaactagtttatgagctccttacggacagagacctagatccaggcatctccaagatttttcatggcacctgagagctgggagtgctcaataaatacgccccttagcaagtgatattccagaaatcagactcagagaagagaatgtggtgtaaggcccaggggattactctaaagaggcctccattaattcatgcattcaatcaacagtcattgagcttgtccactgtttcaggtcctgggctacatggaagataatcaagggaaaggccacagtttgtgtcctcagagggttcctattctagaggggacagcaaaggagaagtaattataacacggggcatcaatgctctgctaaagtaaggaagtagggagcttctggtctgcataacaggagggtacctaatggggcctttgaggtaggggaaggttgggcctctcagcaggagtcatgtttaggcggagactcacaaaaatgcatagtgttaaaaaaattaaatttagcctgaggctgtctccgtaatttgagtccctacctaaggaactgcagcctaacctaacttagtctattaaacacaccgaaagcctaatttaggatgctttttttttttttttttgtaacagcagctgagcttcagccaatcacaggctgccaactgatcagaccatgaccaaataaggtgaacacctagacataacttaaggaggaggcaggatttgactgaggaggcagggctcggacaccagatcaaatcaaagactacctagaacagggacagagtggaagtacatttccgtaagatatgcccaccactggtgccatgccactttatctctccagcacttaatagattctacctgaacccctcaccctcaactgctattaactgaacctggaaatctgagtatctatatctgtagtgcattaatgattctatattttgcacccactgtgtattaatgacacaaaagtggaggtttcccttcaatgctttgatccaactctaagctgccaagtccccaaggctgtaacagtgtatacaggattctacttgtgagcaaggaaacaaaccatatatggtgacttctctcagataacaacatacaggaaaaaaataaaacaaacaaacaaaacaactgcctaatctgggaaggtaggagtactgacccactctgtgaaacaaagattggttgggtatctccattggaacagggcaagaatatctctacagacccaatttggcagcaatggatagatatcagatgttgtggagcctctatttgcaccccaactggactaatttttgtttgtggccattaatggggaaaagtcataccccatattcactcttgactaccccatgagccacttgtttttaggagtggctttcccttgtatataaaaaacttggaacagaggtgaatgtaggatggccactcttgcttctctaggggtcacagtctataatcccataagaaccaagaacaccagaaataaacaagcaacagcattaattctagcaggaatcagagcagcaatagaacgagtggcatcctggggcagctttgcctatcacgagtacaccctgaaaaactagactcaaactctagaatccctagccaccaacacaggtcatgtactaaagggaatcctagagtccttagaatctttggcaaatgtacttcttggtaactcattctgagggctgcccgattagttgactgctctttggtcaaactctgttaaattaaacttgtctacagtttttcttttaccagtaggcagctcatctgaaaacagtaggagggaaaagagggaatcctagaaatcgatctgtcataaacattgtgaactggctagagtgctcctgccttttcctgggaatcagaaagtagcagccagacaggaaaccaaaccacctgatcttttacaaacaggaatcagatcactgtactgccacatttaaagccaccaggggcatcccatctaggatgggatgggaaaaagtatgtctaaaatatatatacatagtgtatataaatatatattatatataatataaatagtatataaaatatataagtatatattacacatataattttttcttagtataagtatgtcccgcgtaatatttgcaatgtaacttacactaacaaagtatgtgttatttatcagaaagtcaaatttatggcagttaaacctgccagcccaaagcacttaaaatataaaattacacttaaaatagagtcttcagtattatattttctctggctttcatcttagtgtgagctctgcattgttccccatgcttcaggcatgctgaccagtgagaatgagaataagaatgccaagctccatcccatcttagcaccttggcttctgtatcttctttccatttagaatgtgttttccctctttcttagcgtggttggtttcttctcttctttcaaataccagtttagatgtcacctccatagagaggccttccctaaccacaccacctaaagtaggctatcccaattattttctctctagatacatatatatatgtcagtccataaacattttattctttcacttctaaactgttgccctcaccattatgtcagagacttctgccttttgcatctttgtgtccctagcccttagcaaaatgtctgtcacatacgagatactcaacaaatttttatcatataatggaaatcttaagttagtattttctctggtgcttccaagacatgcattttgcctagacatgttattgttcgtcatgtgaactggctatggcaaaacacattgccttcagagagaaagagccacacaagttggaaaggaaaggtcacaaggatgaaagaactctatcaacattaatgccttataaaaaaatctcttaagagataccaaaagatggaaagaaattgagtctatcatttgaagacatcccccacccccgcttttttgctttcctgcaagtcatatctgagtcatacctaaggcactttggctgtgcctccttgtggtcctctccatttcttactacttcatctcatcactttaccaccttcaaagagtcctttcctcatataacctcacatgatgttcacaggattaaaaaactccaaacgttcaatagagaaacaacattttcttaaaaatatacagacagacatatgcgaattctttcaacatgcttataaatctatccacaaccctactcagagtatgcttcaaatgtaaatcagaagccatatatattgtattcttccaagtgattactctggaaaagaaaaatcacacatatttattgagaggagaacaaatttaataattttgctcaatcatcaaaaacatttctaaatatgagctatgataggaaaaaaatcagtttaactttacatatgaattattttcctgttttaatcatagaattttttaaagttttggattagattcaaatttcttcagagaactaaatgataagtttgcaaacaattactggaaagaaataaggacaggtgagagcaaaagaaagaaaaacggttacagagtgtaaaactattttcaagcacaaagttaaaaacttctaatacagaacctggaaaacactttatgtgtgtgagataaatgaaagcgttgaggtcagattagaaaaacaaaacaaaacaaaacatagcttctactgacaaatgtaaatgcaccctgtgatcctgttgccaatgaagtggcattgctctgatgtaccactcccatcccaacccaagcacacacttgtcaatgagcaccagggttttcaaattatccagaactctatcataatgatggagctaggaagttctttcagcctcttaacagcagcgcattattttccctatagataatactgagaacatggcaacacttctgcctgatctgcttattaataatacccaacacagcatttattagatagagaactactagatgttaggtgctgggttaagcacaggaaaagaatcaacaaattctacatcattttctttgttgtgttggtggtggtggttactgttgtttataccttcagatctctttctacactaaatttttgggtagaaatgtttaaatatcatccttagcctccgcaataataatagcatttcatcactatcactggtgagaaatttgtgttttatttttgtttacattttacattaagaaattaatgaagtgggaatggctacctttgctgtatactccaaactcccactgatctgtgtgtgggttgcgtgtttgtctagagaggacagttgcccaacacaggaaaaaaaataccctgtcattatatgatttttcacagaactaaaaagaaataaactacccccattccaaagcgtggcctcctatctttttgctacacctcatatacttttctcacatggcaagaagggtacccttgactgctcagtgcctctccctcctcttgatgctgagatgctccaaaacaccactggggttcttcaggagggatttcattgtcaactccagcttgcagtacagggaagtgacatctagagtgggcctctttttgtcactttccccatactaccacacacataaaaatgcctgtcaaacactgtcctacatacatggatgagaaaaagaaataagcactctactatgaaagactctaactagaaaaagcaaggagatgccaactgacaaatgtatggtgatggactttctttttttttttttttccaattctcagatttatttctgaggctctcagccaatttctgtgtcataaagatggtgcagttcagagcttaattgctttagcacttgcaccaagaaaaactgtattgcaaacaatgaagaaagaagagaggaaaccaacattttctaggcactggccacgtggcaaccagtgtacaaggcatttagagaaagctttttgattccattcaatcctggaaaccaacatgttgaagggccagatttttcaccattttatagggatgcaaactttagctcagagaggttaaatgacttgccaacagtcacacaactagcacttagaggaacgggaaggctaactcggagctgatgctgcagcttacactcactccccactcccacgcaacacaaactctttctaggcagcttcgaaggtaccaaacaagtggctcctaaggactcagtaaacattcctgtcagctggccaagatgaatattttggataatgtccagacacgtgaaataccagctttaagttgtggaagtgcttcaggcacaaccaagtctcatttacgtcctttaaaaaatagtcatgacctgcccccttcacacactgtcattcttctggaaggtatctgagagcacagctctgcaaatgccaagagcattatgcagtttccatacatagggcttcctgagtcaggtttggcagggcaggggttcagtgtacaatatttctgccttatttctttaagtttctcttggctacagctcttaagagacacacagagggaatggattctgtagaagatttctcccagaaattttggtgtagattagaaagcttggtttgcttctggttctattacttgagatttatttggaactaaaaggttttctgcctgagagtaaccatttaatatattggggaggggggaagaataaaatgctccttttgttttgctatttgcaccaccctgtcccgattctattgtttgcagtaagttttgtaagagaaactcttctgcactccttattgtgttacaagtttagatgtacccaaaccatcagcagttagattccaagtatacgcttttgattgattcaagtgcattacccgggagggtgtgtgctttgctctgttgttcttccagccaactcccttgccagctgctgaaatgatgccaccaccggtctccatgtcatgcagattttacaccctgataccaggaaagcagaagcatttctcaaaagactttttgctggcttggcaggaaaacagaaattgctttttatcaaaatgaaaaaggttttcttcatgggaaacagcaaaagcagtttgaaagaggggccaatacttttatcctagataaggtgttttcagcagagcagacagaaaaacatgttttccttcctttcatgacatcaatcagatccccaaagccagctacctttattcacagaacagatggagcggtaatggtcccagaggccactcttcctggtctggggatcttgccatccctgcctgaaagttctcaaatccaagctctgggaacttgggatgcttttttctgcctctcccacactccaagaggaacacatccactattatgcatgtcttcattctttgtcctgggtggaacttctgggggtgggagaatgggtgataaagggggaagtgggattcactttgtgaacacctactagaagccaagccaggtacatcctatgcattatttcatataaaccttaccacaaaactttgagtggtattattatgtccatatgacagacgccaaagaagtagactaggggagttaaatgaaatcccaaaagtcatatactaatatgtggaatactagtaaaatctggaatgtgaaccctgcctggtctgttgcttcagagctttgatgtgccaccaacaaacacttccatgcctctctgcttagaggcccagtttaaaatgctatcctctggataaatatgtggtaggtccatacaatggaatattactcagccatgaaaatgaaattctgacacgttacaacatgaatgaaccttgaaaacataagctaagtgaaataagccagtcacaaaggatgatattgtgattctgaaaccaacccaataatcccatagatagttttttggatagacgtagaaattgacctttgtggtcttaatgcttgaagtttatatttgttttaactgagttccttcctcaggaaatgaccttcaggcctctcgaaaaaaaaaaaaaagtattggcaaactgaaactcaccagatcaccacattttgacaatgagatgctggacccctcattctcaggattgcttccttgcctctccctagttcctgttttcttatacattattacatttcttcctggctatataaacccctggttttacatagtctggttttggtcagggaaatggatttgagactgaactcccttcttcttggcaatactcatcatctcagtgactggttttctgcacggcaaacagcaggacctagaccgaacccctagtgttttggtaacaattccacttctgtgaggtacctagaataggcaagcttacagagacagaaaagtagaacacagattaccaggggctgggggagggagaaagtagtccggggaatagggagttattgtataatgagtacagagttgtgttttttttttttttttttttttttttttgagacagagtctcgctctgtcaccaggctggagtgcagtggctcgactcgatctcggctcactgcaatctccgcctcctgggttcaagcaattctcctgcctcagcctcctgagtagctgggattacatgcccagctaatttttgtatttttagtagagatggggtttcaccatgttgggcaggatggtctggatctcttgacctcatgatctgcccgcctcagcctcccacactgttgggattacaggcgtgagccaccgtgctgaccgtgtacagagtttctatttgagatgacagaaacttctggagttggatagtgtgatgactgcacaacattgtgaatgtactcagtaccactgaatgacacagttagaaatggttaacatgctaaattttatgttatgtgtagtttgccatcacacaaaaatgttccctgcttttccctttgaaagatgccacatctgccctgattccaaagctctttcttagaattgactcccactagctgtaaagtgacacaaaagatgatctactccaggcatgccaactcaaatccactgatagtgacagctagcaacactgtgttaagaaagattatgaggatgttttcagggccaaaaaagataaataacatgatcgatttgtaaaaatcccctcacaatgagacatcgaaatgttggataaaatacaacaaaatattaattgttctgggaaatgtgaattgggaaacacagaccaagtggcaaaagcttgggcagagagtcatggtattcagaggccatgatggtcaaatacaggttgatcttctaaaaacataggaaccgagtgagtaagaaaatcaaggcaactaaaacgaagaaaatgttacagtaggtaggtagtcaggcgtgatggggcaggagagggccctcccaacacccccaccaggaaagccacgctaccatcaggtgatggtcaggtggttgttaactctctttaaaataataatttgtcacagccagcaccagggaaagaccgtcttcctatattgataggaaacacctgtaactggtaatcagcagttttcaggagttgggcgagtgagcacaagcatgcgcattaagagacaaaatggcagaatatggttttctggggcattccactggaaaagggaagaaagcctcaggtgggcatacatacaacttcttaaacacactcacatgctcacctcccacatgttagcaggccacacacatgtgggtggcccaccttaagagaagaaccatgggaaaagggacacaaggcccagaagtacaacaacatataaaacccacgtcaaaaggtcaaacgttacatgtgaccttcacagtgcctgcttgggtctcttccagatatactttcctttctttcctgtgctaaagctttttaataaacttccactcctgctctaaaacttgtctcagtctcttttcctgccttatgcccctcagctgaattctttctcaggaggcaagaactgaggttgctgcaggcccatatcgattagccgccagtaacccaaatattcattgcccccaacaaaaagagcagaggttttctgtgcctacgaggttcatgaatgagggctgcctagagctccccccattcttgttgggtctccccttctagtacaagactccttgtagctttgcaataagtttaccttttccttataaaactttactagctattcttcaaatcgacaatggtttgacttcaacaggtcttcatggggtgatcacatcatgtgtcatccatagagggtaatttgaacttataagcattaaccgtgctccatgagttgttgttttttgttttgttttgttttccttttgctttgataaacaacatacccagatacatgggggaaaaatggtagtcatccaatttcttcatattgccagactcacagcaacaggaaagtgacgttattaaccctggggagcctctataacttcttaaaccataaacaaaaataaagaacataatggaaggtataattggtgttaaaaaaaaaaacccaaatgttttctgaattccatcctcatgttacacactcaaaaagtttctctgtaaagaaagaaaatctttgactcaagaatcaactttctagctatctcaaaaccaaattataatgaatttagaccgtagaatcaatactgggggactaactaaggatcactaaatcctgtgttattgattgcttggagaaaactatctttttaaatatgcatcacataacaaagttctttatttctaagaactttctccaaatcctcccatcacatggtttatgtaatgattaatcctttgtattaactactttatgtgtcagaaatattaaaatgcatattaactgttcctgggaaatggttctgcagtttctcctaaaagtatactacctactttgaataagttacatgaaaactgtggcacatttgggaagaaagcagcttagtaggagaaaaatgagatttgcaattataagaactcaatacatgggtgtcttaggcatttccagattttaaaaaagtataatgacttttctcccccagtgtgataccaaaatcaatggaatggttttggtttgttttctactggagtgtaccagttagatttaatcacagagggaaaaatcttgttttgatttctcttattaattacttcttggaaaaatgcactgtagcattcttattcagaatttcaggaacaaaaacttttcacttttcaaactgcaaatgaaggtggggtaaatgtgtgaaggagctaagatctagatatattagagtttctatctctgaatccaggaaggactttgtttatagtggtggaaatcaagcaaggagctattggttggtccacacaatgcctaggtgttggctgtcatgctccattcagacccacaatcccaatgaaacctgtcactttcaagagtgcaaataataggatggggaaagagtgttagagtaggacgttttctaacaagagcccagtggattcctacctttcatctaataaatttcaatggtttaagagagcagatccataggtgccacacagcgaaaggacctgtgtaaaaatcacagtgagactctggagtaagagatggaatgtgatggcccgaggccctgccctccaaccttgagtccacaacatacgacctctttaaaaaactccctccagaagccctacagtttcctctctggtttgcgtcttactgctgaagagtctgtttgtagagatggatatctgactaagctagctttccttttttatgctctttccctcaagaaccaagggtttttcacattccaaaataaaatgcaaactgagagcattttgtatttttgcatttcgattccctgttttgtcagtgagtaattatagcaaataaaatattgcagctgaatgtaaattgttaggcaaccagatcacagcaggatatttttcttccacaagttttacatcatagagtgttaaatattaaaatattgcaagtcaagtaaacagagagggttctttgctcaaaacattaattttaaacaaacatttcactgttattcagatcggatgctaggaaacaaatgacattttctttcaaataaggtgaatagatcatatgaaaggaaagcagacaagggaatcatacagaaggaagggcatttatgacacgagagatgaatttcagccagaagaacaggagagaattcacatgtaggagagaaagcaaaagaaagagaaattggcaaaacaacatggaaaagagcaagaaatgagaaagactgacttactgctagaaggggaaaaaatgaagatacgtctcatgtcagagtacagagacctgactcaaaataaggcagctggggaagaaatgaaattctttctaacatcatgaatttctgtttccttaggttattaccagaaaggtagaaaggagatgaattttcagacctccaaaagatcaccaatcaataaaataccaatcaataagcattgattgagtacctaatgtgtgctcaacaaccaagtacaaaattagacatggccttcttctgaggtaccttactatggagttgagatgaggagatgctgaaacaatgaatgagagtggaaatgtattctatgctgtggagtgaagaaaacacacagctcaggattcaatgataatgacaatgagggtggttgagagtaactgtcgtaacactcttattttctaagcacctcctacattccaagtactgtgctggatgcttaatattttcatttccaacatttaaaacaatccattaagaattatctcctctagtgaagaaaataaagcttcaaaacttaagttgcttgtattacacaatgagtaaatggtagggcctgaatttaaccccaggtctcccaacccaaagatcacgatctttcttctactgaagtgctggatttatcctaagaaggcattcttctgttaatccttacaccagaatgccagctaattaaaacagaaacaaaaacaaacagaaacgctgtttgagaaatgttctttgtaagggagatgacctaacatgaatttttggatgaaattataatggatatggaggagttttgtttttttggtttgagaaagaatcttcaggaaaacatatagaatttgcaggagagtcatgttcattaaaccatctcagagttaaagactggagggaatagatgttaatagccataaaggccttgcagaaaaaggcaaaccttcttttccagtaggagagaagaagtgaaaagggatggaggaggagaagagtcaactgaggagcaagaaatgttccacaatgagaccgcttcacaatatctcccagttcacaactaaattaaaataatgcctggggagaagactgttacagatacatgcaaacaaattgcacatcctgttaagtagggcaaaacagacacttggacagagaaaccagaggaagacaaaattcacagagaaggtggagagaactttaacttctcatgaactgtggaattggtagtttgagtacattatagttagatctccattgagcaacaaggtcccgactgacatctggtctacaagatcaactttctggcaatacggtaaattttttgacagttactaaatgagactgaatataagcaaaataaaaatcatcttgtgtttcaagaaactgatatactccagatacatcaccatagcatatggagatttctttaactagaaaaaatagtccatccaaattcacattggttgaggaagccagaacactgacttatccatgtttaccacagctcatctgccttccctcccttaataaaagcagaggcccagagtgactgccaaacaaaatctacctaaaaaacatgccattcaatttttttagaaggccattgaaagataagcaaattaaattaaaagaaaggaatgaagagattttccttctgtctggttgttgagagagaacatttcttgcatatccagcatttggcaatctcttagcaaaatggcaaattcacaaaccctttaacccagcaaatgcattgctaagaatttgccctacagatatacttccaaatagtatgccagaatttgtgcaagaatgtcctttgtagtattgcccataaaaacaaacaaaaaaatggagaagaaaacccatataccatccattgggttaaacgcgttttgatttatcaatacaaaacaatatgtacagctattaagaataatgaggtaggtctgctcttcaagatatactatgctttgaaacaagctaagtgtgaagaatgtatataatatgccatttaagtaaagattttaaaggctccgtgtcgttttgtttagatgtcaacatgtgcataatttctttttctgaaaagctacagaagaaacttcacaatggtaatatttggaggacaagaggccagcatgtcagagaagagaaggaaaggaaagttttcattttcctcttatacctttccttcctgcctgaagttataggtatggctaatttgatttaaatcaataatattaatgaaacataaaagtaaaataattacctagtaataataaaactatgttgtttataactcttatttgatgtttggattctcagaatttacttcactgaactccgaaatgggtggtatttttgaaatttttagctgcaatgaaagaacacagtataactgatgcaccccacccccaaccaaaccaccctcataccttgtccaccactgccatctctatcttgcatttgaaaatatgcagagaagactctgtttccatgctacagacagtacttctagaattttgaccgcatagtaaacagtcattgtatcatccacaccctgaatgatgagggacagggacagacagaacctacctaccatgtgagcagctctagagctgtcatagctatagctgactctagctcacaaagcagacatgaggaaaagcaaagtttgcatgtgcacatacacacaacacaagcacactgagaatgaaggagaacaatgtgagactatactggtcaaagagtatttaggatctgccaaataatccagttttgtttgtattttcatttacatccctttcaccttaaccattttcacagttatcaactctctaatacactgacacatgctgtgttaggcacttcgcaagtattatctcatttacttctcatttaaaatgccattggttaatatcataatcttcccattgcatatgaagaaattgacacttaaagatataacacttaccctactcaaagtcacacatctacatctagcaagtgggaggtggcattcaaacataaacacagctggcctcaaaggcactatgactcactgtattcattcctgattcaagtctcatgccttgccctgagactgttctttaggacataaattgggcaaagagcaatcaactcacaaaaagagaagaccttccagaccaaaactaggaagtttggaaaaatgagaatcatgaaaatatgcgtattacacatacagccaggttgaagaagacagaaagcattagaatgtggaggaaccttatgagctagaatgcttagtacttaaagaaatgtctttgggatcagccatgctcctgggatgaatcctgacctggccatgatctaactgtcaccttaaccatgtcaccgagaggcttaacctgcacttacttctttcatctgtaaaatggatggcataatagtgcctgcttcacagaggcatggtgagggttgaataagatcatgcacattaagtacctaggacccagtaactctctgtaattatgctgtgtttgagatcataaagctcttaatcattataaaagtacctgagaaattctggaatgctataacaggaaaacttctgaaaatatagactacccctaggcaagccctttgttttacacagcaagaaagtgagacctaatcagttagaggcaagatgcttctcaagtcagtctattgagtttttattttgcactgaattacacatctacagagcttcctgtagcaggaaactctgctcagtttgcccattgctcattcctaacacctttttctcctgcctgttcccatcccatggccaactactcattctctcagaccatcttgaagccagtgaaaatctgctggggaatactcgggggaagcatatgattttccagtagcaacactgctgctgccacctctctccctttcttcctaccgtgaatttgatcatggttccaggaaatagggtggccatcttgcaaataggcagattaaaacaatcactaagacactgcctacctccaggaggtcttcttgttaccaaagaaaatacacccctatttttttaagcaactgttaaaggcagggtttctgttacatgcagctgaactcattcccagaaaatgatagaagtcctttttccatggacattgacacagtctaggatgggatggtggggatagtacagggtactcaccagctgttggagggaaatccccaggttgtgagagctcttttatttaaaaaaaaattaaaatgtaagtcaaactcaggcttagttttgaagttcatttctcaccttgttctcatttttatcttgatactccgaatgaatttcccaacgatatctaagagcttcccattcccaggctggtccagtgatttttagtgaaattaggttttattgaaagtgagttgatttttacttattaatgttctgctaattagagcactttgtcaatatctccatgcatgcattatattctcatgtccacagcatgtgtttagaaatatgtggataacaagatggagagttagactgttctggccctaatgacctcccgccctctcaaaacgccaacataacttctggtcacgtaatcatgggccaccttgtactgttcactgactatttgttataggttgattttaatccctgacaaattttttttttttttttttttttttttttttttttttttttttttgagatggagtcttgctctgtcacccaggctggagtgcagaggcacgatctcggctcactgcaagctccgcctcgcgggttcacgccattctcctgcctcagcctcccgagtagctggaacaacaggcacccaccaccatgcccggctaattttttatatttttagtagagacggggtttcaccgtggtctcgatctcctgaccttgtgatccgcccacctcggcctcccaaagtgctgggattacaggcgtgagccactgcgcctgacagacaaaatttttaaacctgtgaatactgacacagcgcttcatgttttgctagtcactctcagtgcctatcacagaggtaggcaaatcaaaaattctcatgaagtactagaaaatagatgcacctgtcccccaaatgcacagcataagaagatacccagggactaaaagctcccaactccaaaataaacctattcatgaacatgagtctctattcctttgctcagggaattcagtgctaaagtagatagcaaatatatttatattaggggaaatatctaaaaaatggcacttatagatacatttgctaaatagatatggaagtctatctgaagacctagcactatgccagccatacaacaatctcttcacaaatatgtattgaatgaatgaatgaatgaatgaatgaatgaataagcacacatacacagcagaaaaacagactatgaatgaatatatatcctttcccctaaagaaagatactctaaaacaaatgggcagtcaaaactacaatctctcatttaactgggaaaagtaaagaaccctctatttcatctttgatttcctccttacatgatgtacaatgcaaagggcttgctagtcatatttgtcaagagagcccacaggtactatctggctcatcacagcttaacttatcaattgccattgttgtttggtggatattgatctgggaagaccttgtatcttgcgaaagtcacttctacagcaactcatcactttttctttttagtcgacatgaaggctcaagtgttgtggtatactgggaatttccacgcgacagccccattccatcattaaatacccagtgagagcttgttaactagatgaatgtcccaattaaaccagcacgttcttgtcgctgcctaacagtgatggtgggttcagactaacagtttgaagggcaataactaaaatggtttgaggagcctcaagtgtagtttcaatggtttcacacttatccattcatttgttcattcaacaaatcactcaggggcccagcatggtggctcacacctgtaatcccagcactttgggaggccaaggtgggtggatcatatgaggccaggagtttgagaccagcctggtcaacgtggtgaaaccccgtctctactaaaaaaacaaaaattagccaagtgtgatggcacacacctgtaaccccagctactctggaggctgaggcaggagaattctttgaaccaggaggcagaggttgcagtgagctgagatcgcaccactgcactccagcctgggcaacagagcgagactctgcctcaaaaaaaacaaaacaaaacaaaacaaaaagcatttttttggcaggtcccaatgtctatttccaagctgaaaatgtttgctttcccaaaggggcataaaactgtgatttttcttaacagcacagtttaagtggtcttgactctgcatcttaagttcccagggttaagctggagatcttgagaacaagaaaagagtaaaaatagcaacagtgcaaaactccagacatcatgttggctccatacggctgtgtgggttgtgcactgtgcaagttcagtgtgttccattactaggaccatgatacaaatggcagggaagtggtagaaaccccacccaaggggtatcctaggcccatagtgctccctagtacaagggccacaaactactaaatgtccaaaatcacaagtaaaaactgttcattttggtagaggaaatacttgatttcatacacatctaaatttcacaattaaagtctcaaataaaaagctgccaagtaaaaatgctcaatgaaacataattttttcctctacctgatttttaagtaaaacaggcaaagaagaaacaaggcaatgattgaatagaaatgctattcttgttttaaaaaaaattagacggtcctaagaatctatgctaaatgattacattaatatgcataaaatacataaaacatatgtacaaggatgtttattgtaagactgtttctctattactaaaatacagaagtggttatataaattatggtacttccatacatgaaatgctattaagtcaataaaaagaatgagtaaacttgtaattgctatcctaaggacaaagctccaaaacatactctgaaagacaaaaaggtaatcatagaaaaatataatatgatcctgtttataatcaaatctagataatgtacataaagggatattaagtcatgaaacagtgcttggaaagatacacaccagtcatctgacagtaataacctatgaagatgaacgaggaagtagagaaatttcatattttatatattgtaatttgaactacttttttttaaataatgaaaagtgtttgtgtattaagtgtattataaaaaatatccaaatagttcaaaatgacagtaaattacaggttatgtatagtttaatcccaacctgttacaattcatgacaaaacaaatggtttaaagttaaaatttctaatgtaacctatgtcaattacacattctgacaacatatattcattgagcacatacattacataaaacactgctccaggggctgcaggtccagcaaagagacaggtaaggcccctgcttgtatagcgcttttgtccaagacagtaaaagagactcatatattttaaagagattttcagttaaccatcattttcatagtaaataattcaactaactatgacattttgggcactgtggctgagaggtttgctgtgactctagtaaagtttcttcttggaaagacattctgtgccataaagagcattccctgcctatcaaatattcatccttctcagccatcaatcaactgaagttccctcaaacagaatccataaaacagtcatactttccatccttagaggggtttacacctttccaagcactttcacacatctacggtgtcctaagagatgggtgactaagatgcaggagcaaaataatataaatttaccatataaaaactttcttctgtctagcacacttttctcctcgctctttactcgctcaagttttgctggtccttcagtttgcaacttagaagtcacctcttccaggtggcattccaggctggtatagggatcccccctacatgcttttattgctccctattgcctccattccctcacaaggtgtggaccatgctgctttgcaatgaccaacttggtggccacatccaagtcacagggctcaggatcacctggagtgccctgggtccaaactcaccctcaagaactgactcaccaggtaggtgagtatctgacagtcatatttacagaagctctccaggtgttctgaagcagttaatcccaagatatgatgatggaggtgtggaccatgtctgtctctacatcaccatcattgaagccacggcttctgacagtgcctgatatattgctggtgcccaataaggagctgctcctttatctactggttctttcaaaaaatatttactgagcacctcagcatgccagacttctggtgaatgacaaaatgaaccaatcatgcatcatgacgatgatacagctttcattaataagactttttgagttatctgatacctgaagcaactacaggaacccaatccacacctgtccctctgtcccctgctgggtagattagggaagacaaacaaagatttgggagcttttgtcacattctttaggtgcttccgggatgccaccagtgggttccaactgctcagctatgtttagaggtcacaggcaaacagagtgggcccattgcagactgcgaggcagggtgcctctgttcaatataaggatatagtccatgagacagaaggttattacaatgaggttgcctgggttttcctccccagttttattctgtacgccttttaggtaaattccttaatatctttcttcaaaatagttggatggcatttgtcttacctttaagggattcggctaaaatccacttgagtgctggcgcctaggcagggaacaggcagcaattcctacaggtccatctacctgatgacatgaagactagtttatggttaacaaactgtttttcactctctttagaagagaaatctctgtcaaaggtcacataaactttaccgtagtcagcaaagccccttcttataggatcctccctctatatttccaccctcatctagcactgtcttccttgcttgccatgccctagtcctgctgtatcaatagagtagagccaccagccacatgcggctcctgagcacctgaattgtggctagcccaaactgagatgtaccagaagtgtaaaatacaacccagatttcaaacacttagtacaagggaaacagaaggtgaaagaatcctattcataattttctacacagcttatatgttgaaatcatactattttagatatatcgagttttaacaacatattattaatttcttttactttttatggtgactaccggaaaaactaaaattacacaagtggcttgcatcatatttctaccgggcactgcaaccgtgtctgtattggcctcttgatttctgtactataacaagcatttcccccacttctgaggctgtgtgtttttttgtcttcacatgaatgactctctttccatgtctggcatgcctgactgctgttcacccttctaaatgcagcttgtatagcatctctggaataagacttgttgaatgtctatctgtttatgacctgcagcaaagttagccaaaatgctcaaaagggggacagaattgtctgcccagacttaaggctggggctccccgaagctgactttccagtgataataaaatgtccccacccaaatctcatcttgaattgtagctcccataattcccgtatgttatgagatggacccggtgagaggtaattgacccatgggggcagttctttcccatgctgttctcatgatagtgaataagtctaatgagatctgatggttttataaagcggagttcccctctacacaagccctcttgcctgccaccatgtaagacgttcctttgcttctcttttgccttccaccatgattatgaggcttcctcagccacgtggaactgtgagtccgttaaacctcttccctttatgatttaccaagtctcaggtttgtctttactaacagagtgagaacagactaatacaggtaataaagacttgaaggacatgaggtaggaaggaaagacaaaggtagaggaggagaaaccaagagtgttaccaagccttagcctgatgacaacaggcagttgcttgaagagagacaaacactcttgctttaagaggaataaatcaaagtggcttcggatacattaaccctagcttgtcatttgagaagacagccctttatatttagaatggctaggaaagactccttctagatgatttggtgctaatgttaagaacatcacgcaaggtgtccagttcgatggctgtcaacaccttctctaaaccttgtggcccataccatatcaacaacaaaataaagaaaccaaccaagtcaacaacaacaaaacatcgtcaacaacaacaaaacatcaccaacaacaataaaaattagaatatttaagagcctgtgcatgcttacttatgtgctgggcactgttttacacattccatatattaacttagtctttccaattaagtcttcaaggtagccaccgttattgttcccattctatagatggagactgaaacctaaaaaagtcaaggacttgcccagcatcactgagctggtaagtggacgatcaaagatttaaacataggcagtgtggatcccaagcctgtgctcttaacccttgcagcatataccactctacatcttctgtactattctctattgacagtatctatgaagctagcgcttcatggtatcaggatatgatactttcttaattattcattattttgtctatgtatgccttcttttcccagctacagcattcactgtttgaagggagagattcaaccatctccttctctggaccccacacccaacttatcctgttataggctcatggtcaacagatgactgcactgtgttactaaatgccagggaatacacagaagttgtgactgcttacatattcatggaagaaaaccccaactcctatcatccaagtttgaaactaggtcttctttcctattgggggaaatttctgcaggtgtgagtaattagaaaattaaacattaattaacaattcaagtgactgattgtgttagcaagttgcttgctaaccatacaggtaaatattgtgcccccatatgatgtttaaaaataaggtcccttgagcatattaagtagtagagatggttgactcaagattcaagagtttcctgacccctttaatatgtcacattttaagtctgtatataacaaaactattgggaaaggggattgccttactcactcaccttgccttatcatcttacaaaatatcttatattaaaagagagaaaaggatgacagctctgtatctatcacctattactcattatcctgggacaacaaacagccccagaatctttctttaatgaatataggctctcatagtacatgcttatgttcgtctcacgtttgctctctctcatttcaaaaccctatttctcttctgccctttatgtcttcaaaagagacgctgatattaattaccttgcttctctaacccctcatcgttttcagccccaaacaatcagcttcctgcttttaatcttctaccaaatctattttctcatgatctaccgaagtcaccctactaagtaagtgtttctggaaaggtattttcagtgcccatttcccttgaccaacctgtggcccttgactcactggaaaaaatcactccactcctgccctttgtaatattattctcagctggaattctagcctctgtcctgcaacctccagcttgattttacaatataaacactgctacttcctaacaagttcaccagatatacgaaataaccctgtatttcccactgaagtaaattagattgttgttcagtaaatattcactctctctttacttcttattcctgagaggagtatactgtcacattcctttgatatcagacttgatttggcttaagacatgtgaatggagcaggggcttaaaatgtcatgtgcattcctgtctttcactatgagaagcagatgtcttagttttttgctgggtcttggagggtgacagacacatggacttaactcacaccctatagtcaaaacaagccaagctggcccacagacacaagaatcagagtaaatgactcttatttcaatccaccaagtactggggacagtttggtacacatgagttttatgaaacagttaactgatgcacccatacaaatgttaaacctttgttcactggaacaaaggttggaagttttctccaacctttgttggatggaaattttctcttgttcctctacttctatggtattacctctcccatgccacttctctaacttcatgtcctgtattctctcccttattatgttttaaactcctttgaagagcaaagcatcaaaagttcttatccctagacagacacaaattaaaatttgcttattcattcattcattcattcattcagcaaatgtgtggattttagaaatgagtttctgtctcaaaggtatttaatacaacacctggctcagcttcatggactagagacacattatcactgaggtcacgttgttactgtttttgctactcctgctaactgttccaaaggggaaaaaaaaacaacatgcactttaaaagcatgatgttcttgttggcagaaattacaatagtttcttctcttggtgtttactcccccaacactttcctcagctctttatttctgatattcaattaccctttttctgcctggcttttctcactttcccagaagacttaccctgggaaactttactgttttcactggtgtacatttgcactagttggtttaattaccaagtgaatctacagcctctcagaacatttgacacgtctccctttcactggatccaagacatgaagcaatgaaaacgaatgggtgaatgttacagcaaactcaaccaaaatttattttgcctggattcaaggattaggctaacatgctagccagtttctgcccccctaaaatgtcaccctctggaatgacaaaaaccttaataagatttggaaccaaagttcctatgaccagaaactgctcaacatatatgcgtcacacacaggaaataaaggcacattttaaactagagctgctgggtcatctttaaaatagcagactgcctgtcaggagaaccaatggaataatcaatcactcaatttaaagtggggagctcctttaaaatgctagggtgatggggtatgggcacaaagtgaatagctgtgacagtacagttcctcagccaagatccacgaatgtaagcaccagtgggaagagcactagaccaagaggctcaaaaatatactgtgaccttcaactagtcacttaacaagtgctcattgtatcatttaaaaaataatacaatagaactccatgaatccaattaaatttaattccatattattcgagtgtttgtttaaaatgatatttctcaaagcaatggtcaaatgagtttggaaatcagtagattaaagaaggttaagcaggtttctgttccatgcaacttctcagtaactttaatagtctactgtgcaccgtgaagctctcagacctggtggatgtggtatggaacattccccagactaataggaatcaaagatcctgtttgtttaccatggacagccttgtagaactcctattctctataatacatggccatcaattatagaagacacagagatactaaagagaatagttttcttgggtcctggtcctgaggcctggcattctcatgaagctgagtttatgccctcccctgtgatttatgccatacctctgaatccttataatgatgtccctttttgatcttaagatggctttaactggtaactatcatttgtaagcaaaagtaccttattaaacaagaaaaacagctacgtgtgagttctgagtaaatattgctaatttatgtctatctgcaattgttacttgggctgaaacaaaagttccaggtaagtatgatagtcattttgccagaggagcctcaataatccctgagctgaaatactttcatacatcaagacgtaatcatctaatattaggaaagccattaagaaatacaattactactggaaatgaagaccttttacaggagaacagacatgatggttttccttaaaagctcttcccttttccacatccactttcttctactttaaaatgaaagtgacttcattttcaagtgaccttttataaagtccaaacatcaagtgtcgtaaatattctaagtattcagaatgaggtccagtactgtaatattaagttggatatgccagaaactcagaaaagcctatttctctttaaatagccaacttataaaattattcatattgtcttcctggattcccattatgttcctcgtgcaagaaagtgaaagtgttttatacaagccacactgtggggtaatatggccaaactaagagctttcagaaggattcttctcttattctctacttctgcttctgctgctgctgctttttttaaacaaatgagatcagaggcatactgtgattagcaatgcatgtttatgtagtgagacaccagattagaaatgattattatcatgtcacctaacagagtgataataatggtactctgagatggtacagctcagctgttgaggattcctactacaataattattttaaaattaattttgaagagaaaaaggaaagaaagaaagatgattgaaaccattaaagcaatcctgataaataagaaaaaaaaacccaaacactatgttttattcctaaggcaagcacaaaaaataaaataatcaccaaagtgagacacgactgactgaaaggtaaaaggaacattcattttccccatccaaggaaaacaataactgaaaacaatttaaggcaaaaagttaagcttctattctgagcaaaggagagttggactgtatttatgtgctaataatctatttataagaaataactgattaaataagatagataaaacttagtagacagaaatatatttttttcatagcaaacaaagcaatcaaaagagaagtgttgctgaaaatattgacaattaaaaatcattcaaggactctgaagtatatttcaggcagaaagagagcagcctaaggaggacttattacaggattgaaagcatcaccgtgaattcataatttttaatatataaactgagagatatggaaatatatatatagtatgtgtataagtacacatgcatataaatacacacgcatgtattgcctacctctactcacagagaggctgaagcaatgataccccactataaattagcatacctgatgtccagatcttggtttctaaataccattctccaaaaaataaaaataaaaaaggaaccagacctccttggagaagtggttggctccattaatgggacaggacaggaacaagatgagattagaatatcctgtggtgccacaaagttacaaatggctaaaaaaaaacaaagaaaaaccaaaattgtggggacaggtcaaaagaacacatgaaccagaatgaagggattcccctggctaaatagggacataaaataaaataaaaactgataatatcccagagactacagaattaaaaaaaatctacgattttacttcacacacacacacacacacacacacacacacacacacacacacatatatagaggggggggggaggatacaaagtaacatgtaggatgaacaagtctagagatctaatatacaatatgatgactacagtcaataaaattgaattagagttttttgttaaataagtagattttagctgctctcttcacaaaaaaagtaactctgagataacagacgttgatttgctttatgtagtaaccatcttattgtatatatgtatcccatatcatactttaaacctcaaatacacaaaataaaatttatttttaaaaaaatgggaggtgggggagaaaagcccttccttacagaatttcaagtcataaataaggagtaattaaattagaaagttaccatttaacaatcatcacaaaagtaactgtttcaggtaagaatcagtagtagtgaatgcaaaaaaagaatgggtaaaagtataagaaaaaacatactacattttctacaagtatattcctataagatacttattgattacaaaaggaaaaatagcaattttccaatggagaaacctggtagacaccacaccaaccaagtgatcaaagttaataccaagaatgggagaaaggagcatcagtgtctcctgatataatgcactaagaaggatataatactacctctgtaggattctggccaatatgcaaaatctgattctaaccatgaagaaatgccacatcagacaaactcaaattaagaaacattctgaaaagcaataggctgtgcttttcaaaaatgtcaaggtcatgaaagacaaagtctggggaattgtttgagattaaagaacactaaaagacaggacaactaaacacaatgtgtgatcctggaatggatcctggacccaaataaaagacaatggcagcatttccataaggtctgcagaccagaaatagctttatatcaaggttaatttcctggttcagtaattacactatgtttttctaagaaaatgtcttgtttaaatacactaaaggagcaaagaggcatcatgtaacttgctttcaaatatttcactaaaaattatatatacatttatacacatataacatatatggtacacacactcatatataggtgagagagagaaaatataatggaagtaagtaaagtattaatatctggggatctgagggaggagggtagagggattctttacattatgcttgcaactttttttttttgcaactctaaaattatttcagaattaaaagttaaaaaagaaaagagagggagcttgacttaatattgcagctgtaccataaagtgttcttgaacaagtgacttgtcttcattgaggctcggctccccctttgcaaaatagagacaacatgacttcacagggtgatcggggtggacaaacaagatggtgctgcaaagctccaacccaagagctggcccctgaagcacacagtaagtatagcttgtttttggtaaatccaaaatacaacaacccattagagggcgttactgtctgaaagcagtttgggggcacccgaggtgatgtgcaggccgcagagacaatgctgttctaggtcaggagcagaaacacaggctcctcacacatgcttttaaatggggctttttactttctaaaatgtgtttctacacaattgaaaacaacattactttttccagagtgggaggatgaaagcaatcgtgggtgggggcttcttgagaagaggggttattttttttacttttaaaaaggtctcagaacagttaaaaatagtttttccttaagcagcctccctctgctccctgctcccaccagctgctccttctctcagcctgcccttctctttgtcccttcaccattttcccctctctcctttttgcttccagtcactcatatgccacccactcctgagaaccctaccttctcttatttttttgtttggctttgttttgaaaaaaatattaatcccaaatgaacaaagaagatacgtgggaaggaaataaatggtgagctcttccttacttcaccacctgtcaagttttaagtttttcctccaactcacactaacctcctgcgcaaccataaacttcagtgcttgccaaagcccagaaaattctaagtaaaaagcagaaaatgaatgcagggaagggggtgcattcttattgttcatcagatctgaaaaaaataatgcccagaatgtcaaatgatattacactattaaaaaggtacagtaaagatgtgctaatgatagattttttttctactccaatatgttgtaaatattataaactatcatttactgtcattactttaatgatgtagaatgttgaaaactcaatctgggttaatttacaaataagtaattttgaaaggagaaaaaaatatcttttctatttccgtgtaatgtcccattacttgacagtcaaaatgtggatacagccaaaagaaaaataatgaaggtcaaggaggatcaaaatttacctgatagagtacctatctgttagaaatcactttcctgaaataccttctctgattttagaaaactgaaaaaacagaaaatacactacctttgacaatgcttgcgattcagggttgtgcttgtgtatgggggtgggagaacctctgctaggataggagaaagctgccagacacaagttcagatttaatagaaatagctttcaaatcaggagtctagccatcaaccagttttagatggacagtcccagtttcaagtaaataaaatatttgcatattagagcctcgtagccctacttagctgcaagtaaattttctgagatttactctgccttgcttcatttcatccaggcactgattattttttcattctttattcaccaaacatttactaagcacttctttatacaataaattctgagcaaggtactaagacatgaagaataaaacaggtctggctggagactgcacgaaattgccagtctgtctgagcctgtttgaattcataaagtccccgagaaagaagaaataggtgaggattagcaaccctgtaagagcatttacaaagaagggagtgcaaaagaagaaaatagcaccacagctcaggagggcaatggtattacttaccaagggtgcagtttgtttgatgacaaatctcaaaactgaatgcagtgattgtgttagatgcaaacacttggatgaaatagatgactgttcttgtgaccttgccaggaaagaggaggagtgaaagagagggctagagttctagtctcctttctgagttttgcattcattggcaaccatgtacctctagacatgggagtgcaggcatctatctctatcaaggtacatgacatgtaatgaaaggaagggatagagaccaggcaagagaaagcaaagagagagaaatagacagggagatggaatgaggtagacaaatcttagaggaatgcagtgcttctccaagtttggtgcaggaatgttcccattagaatcacctgagggggttatttaaaatgcagattcctgggctctgacccaggtctggtgagcctgaatgtctgtggctgggactctaagatttgcattttatatacgttttggggggtggttctgcatattaaaatttaagatcagaccactccctaaatccaagggtgctattttactgtttacttgaccaacagtataaatgggtgtcttcaaagccttgtcaccacaaccccatgcagcctgatccacttacttctctgtatcacactccctcctctcccaccaaggaaaacagagtgatcctgaagttccttaaaactcaactcaatctactgctcctcattagtaataaggttctgttcaaggaactattggctaatcattcatatcctgattgagataccagcatatcctacccaattattaactatggatggactccaaccaggaaatccaaaactatatgctgcttactgaatgacaataataaatgtaggctcttatttaattatgctgcggtttattaactatccgataataaggaaaacccctagtttattatagatctgtggggtgtgtgaatatgtgtgtgtgttttgagagatatatacaggaccctaatcagagagagtgccaggaataacagccatgcatgccaggcatcttttcctgtttctttttcagttacttgaatccacctgtgataaacttgccaaaagaaagaggaagtacaataaccacaaacgttaagtgatttttttttttgttctacaaactcgatgagttcactgcattgtctacttatctgtttttgtaatttcaacttttatttttgatttcggggtgcacatgtgggtttgttccataggtatattgcatgatgctcatgtttggggtatgattaataccatcacccaggtagtgagcatagtacccaatagctctttttcaatccttgaccccctccttccctcccactagtccccagtgtttatggctgccattttcatgtccatgtgtaccatgtttgtctgtttaactctcacttataagagagaacatgtagtatttggttttctgttcctgtgttaatttgcttaggataatgacctgcagctgcattcatggtgctgcaacagacatgatttcattctttttttatggccatgtagtattccactgtgtatgtgtaccgtatttcctttatctaatccaccattgatgggcacctaagttgatttcatgtctttgctattgtaaatagtgctacaataaacatacaggtagatgtatcagtttggtggaacagtttcttttcttttgaatatatatccagtaatggaattactgggttgaacagtagctctgttttaagttcactgaaaaacctcccaactgctttccacagaggctaaactaatttacattcccaccaacagtgtataagcatccccctttctccacggtttcaccagcatctgtgtctttttggctttttattaataactattctgaatggtgtgaaatggtctctcaccgtggtttggatttgtatttctctgatgattagtgaggttgagcattttttcatgtttgtttgctgcttgtatgtgttgttttgagaagtgtctgttcatgtattttgtccactttgtaatagggctgttttttgcttgttgaattgttgaagttccatatagattctgggtattagacctttgtcagatgcatagtttgcaaatattttctcccatcctgtaggttgtctgtttctctgttggtagtttcttttgctgtgctcaagctcttcgattaggccctacttgttaaattgtgtttatgttacattgcttttgaagactttgtcataaattatttcccaaggctgatgtccagaaagacatttcctaacttttcttctaggatttttatagtttaaggtcttacatttaaatatttagtcaattttgaggtaatttttgtatatggtgaaaggtaggggtccagtttctttcttgtgcatatagttagccagctatcccagcaataacaatagggtgtcctttttccattgcttaatttgttgactttgtcaagatcaggcagttggaggtgtgaggttttatttctgggttttttattctgttccattggtctttgtctgttttcacgccagtaccatgctgttttggttaatgtagccttatagtacagtttgaagtcagataacatgatacctctggctgtcttctttttgcttaggattgctttggctactcgggctcctttttggttccatgtgaatagtcttttctaattccgtgaaaaatgacattggtagtttgataggaataccactgaaaacctgtatattgctttgggcaacattgccatattaatgatactgattcttccaatccatgagcatactgtgcggtctttgatattgggtcctgactaggccaagaagacagagatagactggtccctcaaaccttttctctaatgtctggagagtacatattttatgcttttcagtatgtatggcctctattgcaacaactcaactctgccattacagcattaaagcagtcatatataatatataaacaaatgggtgtggctgtgttccagtgaaactttatttacaaaaacaaatagtgggccaaatttagcctgcaggctcttgtttgccaaccccagctcaaatcatcctcagacaaaatttagggagctgctaataataacaaggccatgctctgctatagtgctattaagctattgcctcagcatcaaattcaccctttggtattctcttctgtgataactggcacgtttatgtattgacaagaaagatgaccaccacatattaagtggggaaaaaatcacactttttatagcaatatcactttttttaacaaaatatgatcctctatacgtacatacataatgttgtataaggattcataagtctcagaaaggataatactgaaaggttcagaggggtaacctctggaaaatggaatcaggagtaggaagaaaagattactctgattttttgctttacattcttttgtagtctttgaatttatttagagtaagcaaatattaccattgtaagttacaacaataaaaaggaataaatcaaggtggagtcttaacagtgctgaaacacttttgttaatccatttccccagttccaacctaagctttacagaggtgctattgtcaagcaatcactcattcgttcactctacacatataataggcatccactttgggccagaccctacgctatgtgtgaggaattcatgaagtttaggatctaggtggaaaaacataattatataagctaaaattgtaattaaaacaaataatgtacatgaaggagagatggcatcacatttctttattaatatatttattgggtattatatcccattattgctggaggataaaatctatgccagggaatataaaaagatgagacagagaaaatgatacgagtaaacacgctgaggactttagactcagcatataggtgtttggttcctaccatatcatctacataatttccttaaaactgctgtgaatataaaatcacaacagctgttttaaagagactgaaattgaaattcaatgaaacaaggcatttgtaagtcttccttggctttctacattgatagtgacttttttttttctttttcacactcttagaatcagggatgggttagatgttatgatcttgctgttacttcaggcatcttctgttatcattctccctagaggccaaaggcagagaccatgtcttcttttctatatgttggaggcactgtcttttgagttatatgccaaacaccttctctggaattggtttgccacttctagggactggctccctgtcgccatgtttgtgtaatatgacaacagacttaggcaagtgatcctagctgggccagaattccttcctcacacactcaaaacaggaacaaaagagagtggtctagattttacaatgtattaactcaagggatgaagaattccttataaactagacagagacaaagatcttcagagataaaagacgggtacagacaagcagagagaagattaccaagagcagatcattctgtccaggtgcctctgattttttgaggtctaggttcttccaaaggccctactacatcctttgcttgggtttttttccatatgacatcattctacacttacattatatcttcccttttcactgaagcatctatatataaattaaagcatcactaactgatgcatgtgtatatattccaagatgtttaatattgctttcctgacagtagggatttttatctgcagtgcttcagagccaaagcaaattctaatgttatttttttcctccggaatgttctcccagaaagtttctaccagtttgctacaagttgaatgccacttgttgtcatttcagaacctcatatacagtattctttaatagccagaaacacaattataggggaggtcagaagatacatctccaaagtcttctaagtgttctctcctgtgccctacaggccaaaatggtttatatatcaaatgaccttggacaagttgtttatcttttgagtttcagttgtctcatttgtatacaggcaattctgttggctctacagtgctgctggcaggataagtgacaaactctttggaaagtccctcacacacagtcagtgtcatttaaggtggctcctcctgtgagattttgcaattagggatatgatcagtcttagtccattttttgtttttgtgaagaaatacctgaggtggtataatttataaagaaaagaggtttatttggctcatgattctgatggctggaaagttcaagattgggtatctgcatctggtgagggcctcaggcttcttcatcatctcatggcagaaggcaaatggaagccattgtatgcacaaatcacatggtgagagaggaagcaagagagagagtaaaagggtggggggatgccaggctctttttaacaaccatctcttctggaaactaatagagtgagaacttgcttaacccaaaggacaggcatcgatctattcatgaaggatctgccctcctgacccaaacacctcccccaggccccacctcccatcattggggatcaagtttcaacatgtggttttgagaagacaaacatccaaaccatagcattccactcctggattcccaaaacccatgtacttctcacatgtgaaatacaattgtttcatctcaatagtcccaaaagtcttaactcatttcaaaatcaactcaaaagtttaaagtccgaagtctcatctgtgacccaaggtaatttctttccagctatgagcctataggatcaaaaataagatgtttgttttcaacatacaatggtttcatgggcactgggtaaacagtcccattccaaaagggagaaattggccaaaagaaagagaaaacaggccctgtgcaagtctgaaacttagccgggcagacatgatatcttaaagctacaaaataatcttctttgcctccatgccctacatcctaggtactgcaaggggtgggctcctaatgcctcaggcagctctgcccctataacttcagtgggtgcagctcaagtagctgctttccttggttggagttgaatgcctgtggcttttccaggttgaggttacacactgctgctgctgctggtggctgtataatttgggagtccctttggtagctccacttccatagctccactaggaaccctgatagagattctgtggtggctgcacctctgtggaaggtctctgtctatgctttcagagatctatgagtcatctctaaaatcctctgaaatctatgagtcatcaagcctccaccacccttgcattctgggtgcctgcagacgtaacgtcatgcaaaaactgacaaggctcatggcttgcaccctccagagaaggagcctgagctatatctggggccatttgagccatggctggagccagagcagctgggatgcagggagcaacatccagaggcagcccagggcagcaatactttaggcctgtcacctgaaccattctgtccatctacacctctgggcctatgataggaggggtggttgtgaagatctttgaaatgccttaagggcctttttcccattggcttgactactagcacctggctccattttaatcatgctaatctctttagcaatttcactggactgggcaatagcattggattcctcttctgaaaatgtttcctttcccaccaaatggccaggctgcaaattttccaaacttttacactctgcttcgcttttaattataaattacacctttagatctttcctttgctgctttaattcagcataacctgttaaaagtagccatgccactaactgaggtctttgcagcctagcattttcatccaccagataccccaccctcatcacttttaagttcgaccttccacaaagccctaggacatggacacgatgcagccaagttatttgctactatgtaacaagggtgacagttcccagtaagtttttcattttcatctgagaccttgtcagcatggattttacagtctatatttctatcagcattttggtcacaaccacttagccattctctaagaagttcaacactttcccttgtctttttttcttcttctgagacctccaaactcttccgactgctgcccattacccccaaccactgggtactaattttctgtcttagttcattttgtatcgctacaaaggtgtcactgaggctgtgtaatttataaataaaaggatttatgtggatcacaattctaatggctaaaaaattcaagattgaatatctgcatctgctgagggcccctggctgcttacactcatggtggaagatgaaagggagcttatgagcttatgtatggagagatcacatgacagagaggaagcaagatgtcaacaaggtgctagtctcttttcaacaattagttcccttgggaattaacagatggagaactcatcccccaaaggcaggcattaatctattcatgacggatctgccttcatgatccgaacacctcccaccaggccccacctccaatactggggatcaaatttcaacatgtgccttgacagggacaaacaaatcaagcatgatccttagaaacaccacatggtagagtggaaagagtatttaaatgttagtcaggagacctctattctagttccctgttctcactaactagttgcacggccatgctgcttacttctttccaagaaacctgtaccttcatgcataaagtgctattccctatgcccgagtatcatcctacatcatcatgtcatggaaaccccaactctaattcatgattcatcttgagtcctgacttcttcagcaaggtctcctcagtttccacaatcagaggagaacattcctttttttgcataaataaacactgtacttggatctctcttatgggagttattaggctcaaccctactttatagatctagcactactcaattccttcttatttactttctaaagacaattcatcttccaaagttatagaaaaacaaagtttagcatttgctgcatatgtccaacaaacataattaattggataagaaacttggcaggtaattagtactaggcataccatttgcttttttatgcccagaacctagaaaagtgcctgacacatggtaggtactcaataaatatttattaaatgaaaaaatacccagacttggttaggaaagactatgtaaggcaacaatttcaagggtatatgcttttaggccaattcagtttgccaaaatctagcccttgatgttaaaaggaagctggggcttacagaaatggaggaccccaacgctaatggcaagggcagaaatcatcatttatgagacatagtctcttgtttggtggggaatgtttgacagctagctgcataattccacacggttccacaggagatgattttggatgtggagggaacactccaagcacacttcttatgaagacctataatcagaggtcttaacaaacacaagtgattaatatttgttgacttcatgacacatttattttctttagagcacttaccacagcttactctaactttattaaactttttagtatatttttgggttttttttgttgttggtggtatcctcaataaactatgagttctgtgggggaaggaaccatgattccctgtccattgttgtacatccactacacagcacagagtagatgaagctcaacaaatgttggatgaataaatatgcatatagtatgatggatggatggttgagtggataaatggacggaaagaggccagctagtcacccatacaagcttctgggttatgaacctaaataataacacaagttcaacagcaacaaaaataatcccattccattataggctggatgaaaggcttacccactgtcttacaccattagcgctgctctaacaaaatacctgacaatgggtgatttataaagaacagaaaattatttctcacagatctgggaaatccaagatcaaggtcctagcatcttgtttctgatgagggtagtcttctgcttccaaaatggtaacttgttggcagctccttcggaggaaacaagtgatcacctcccaatggcaacatctcgtaatattgttgaattggggattaagttttaacatgcaatttggaggagacacaaatattcaaaccatagaacccacttagagatgacagaataacgaatatatatgaattaaaatgaatggaacaacaacaataacaacagccatcacttatgtagtgcttactgtgttccaggcattgatctaaatgctttacatatatgaattcttaattcctaatacaaaaaagtgagtgttccttcttgatctggagccaagactgcatctatcaaaatgggaatctgatcatctctcccatctgccccccaccccacgtacatcaatggtctacatgacaatgctacaattaattccagaagtaaacttaacctctcactaagtgcccaaccaaagagactgcatggtttcccagtatgaaaatgtgaaggatcaattcacaatttgtttcctgcaaaactgtcattcctctcttcatacccatcactggagaaattacttttcagaccattctacagcttgggaatactaaataagccctaatgagttcaaaagtcggtaatgacagtactaattcagtggcctgtttggtagaaagtcagtctcccttcttcaaaagcaaaataggattatcaagtgagctgggagcattttctttacgtgattgatgggtagaaaaagtaatcacctttgaagtgccacaacatataatatatctcctgtgttctctttcttcttctgacacccacaagtaattgaagggaagggagcctcttagaatgaccaacgaagtgaaggtgacaaccctttctctgctatctaccactagagtgacatgctggggtcttgaatagttgagaactgacatgagtgtctttgatgggctgctttgatgcttggttcagagtgtacctgccaccagtcaggccacacagactttgggtgaaacatacatctaaggagacaagtgttactacttcttagaagcaaagggcctgtgcacctgtgaaagaagatctgttgtctgagctctggggtcggggtaaggtccgcaaggtggaagtgaaggaagtcaaggagcaaagcaagttgaagcaggtaagaaacactgaatatgatttcaaaacagtttctcatcatactcatccataatgaccgattaaccacaatgttcagactgacaactaggagatcattagcctcttgacctcagctcactgatgcagaagcagacagtcgtctccttggaaaaggcactgctctacagtagcttactttgtaaggggatttttgcaactacaagtaattcaactgaaacagagttgacactcaaaaaccttaagaagcagggattatcaggcaggtgaacagttttattcttaagagctcactctttctgaactctcctaaagcccatccaggcaaggacatatgagtttgttatctgaaggaagaaaaatgctttgaagaagatttataaagaggaagggtctttggtttattgacaagaaagtaaaagactttctagagttgtaagcgaaatgtcgctgttcaggttctagaacttgctggctagagaacagatggctgccacttgttggcacctggagtgacaaggagttgaggaaggaagagagtgtcatccatgtgatctggcacagaacattcttctctggagccactcttataaagaagagactggcatgtttggtgggtttactgtatgatatggtttgaatctgtgtccctgcccaaatttcacgtgggattgtaatccttaatgttggaagtggggcacggtgagaggtgatttgatcatgggggcggtttctcacgaatggtttcgcaccatccccttggtgctgttctcatgatagtaagttaccatgagatctggctgtttaaaagtgtgcggcacctcccaccttgcctttcttctcctgctcccaccacatgagatgcctcactccccctttccctttgccatgactggaagcttgctgagacctccctagaagccgaagctgctatgcttcctgtatggcatacagaactgtgagccaattaaacctcttttctttataaattacccagtctcagatatttctttacagcaatgtgagaacagacaaatacaccatagtacctccaacctgctaattaagtcaggagtctccccctggttggctgctacccacaggctccactactggtgagtcgtagaagacaaataaaggcattttaaggaatagtacgacaataatctctagatacatctgcaatcaagtaacagtaacccctctcagaagctatgccagtatgttgcagatactgaacacacatctgttaaatgaatgaaaatgaatgaaagaataaatgattatacagtgtacttgtttcataattgtaactggtttatattgatttggttatatctgcttggtaccatgtgagttttgattacataaagatctacagtctttgtatgacatggcctcagaacacaagtcaacttcttcatctggttctcaacctaagaaataatgatctgttgcaaggacaggctggccatggtagaagtacgaagcaacattttatctacatagtactttagaggtaatgtaagagattttcaaaatcatgcttttacaatgtctacattaaggtctggcttttaactaaaaagtatgtgaaacatgatagcatttctagattgattccattcagaggtgcttttatttcacacatatatctcagaccaagggtaagtatggtaagaacaagtcactaggaggccagcaagagaggattaatgaatggaagaaatggaaaggagagtgaaacactggtaaactcatcccagctccagcaagaggggccaagatatctgagctagctggaacagcacaataataaaaataataacaataatgacattcactgtgagcaaaagaactctgtaagcaaatcaaaaatatcagtgctaagggtcttaatagctgattataatgaacttcctcatgtaatctcagggagcagaaaagagaaaatagattgtgcatctgttcaaactaaacatatttcaagctggaaccagcttggtgccaaagacatctctgtcacagagaagaaaaaattccaaatggaagaaaaattccacttcatgctcaaacaccatgaacttcgacaggaaaattaggtaaccactgcctcacttacaaggcaacgcatcagtttcctatggctgcagtaacagattaacacaaacttagtggcttcaaaccacaccactttcttatcttgctcttctggaagttgggggtctgacacaggtctccaggtgtgggcagagctgacaccttgagcctgacgcaggtctaaaatcaagttgtgcgcagaggtgacttcctttccagaggcttcttttccagtttctagagtccaactacattccttggctcgtggcctcttccttcatctttaaagtcagcaataatgggacgaaaccatctcacatcacatcactctgacctgcttttctgcctcccacctccacttctaagaatccttgagattacactgagcccacctggacagtctaggataatcttcctattttaacatcagctattgagcaacctcaattccatctgcaaccttaattccccactgcatataaggtaacacagccacagtttctggggattacgacatggaggtctttggtaggaggggggtattctatccagggatccccaaccgccgtgccacacagcaggaggtgagtggcgggtgagcaagcattactgcctgaggttagcttcctatcagatcagcagcagcattcatttctcacaggagcaagaaccctactatgaactgcacatgcgaaggatttagaatgcgggctccttatgagaatttaatgcctaatgatatagggtggaacagtttcatcccgaaaccactccctccaccaccgggtctgtgggaaaattgtcttccatgaaacaaggtccctggtgtcctaaaggttggggactgctgttctatattgcctactacaggcatcaatgtttcaaatttacttaaaaatctgttcaggtccagctaccacaaatacaagtgagtgcctctcatttgtgaaaaactgtgtatgtgtaaggtgtgagaatcctatcttattttgctaggcagagctgactatatgtgctctcagagcccccagaattccagaaaaccaaaatttaaaaaaaaatattgaagattaaaaaacagagagacagtgttacccagtgaagtttctaagagaatctacccactaacagacttttccccatctcaagttctcaatcattcattttgttacatttttttatatttgacaaatgatatctaatgcatttcattgctgttagcagtttagacacttatgagaaattaaaaccccattaagtgtgaaggcatctaaacaataccagatctgccttccactgaatatattttgggatgacaggtctgcttcatctgactcctcaacaagaacagcttatgaaactcacagttttagtgacagggcccaaccggcacctatttttgtatcacctggaaaaaaaaaatgcccacataggcaatacatctgatacagaaatgaaattaaatagaacaatactgaggcatcaaccactcagatccatttcactgtttcctattctgagacaacctaattgaaggtggcattccaaggttaaatcctagctctgacagcatctcctgtcagacacctgtcaaaatgtaataagacacctgtgaaagggaagtgatgccaaagccacatcattttcccctacaccttgattcctaacttgcaggattcatgtcacccagcaaacagagtggtagctgggtgctgctggcactgtgccaccatttgcaggtgagggagggaagggaagggaacacaaggggtgggggagagagagagagagaagaagagagagagagaaggagagagggagagaaaaaaaaagacaacactgcaaaaggaagcacccaagcgttttaagtttagcaaatgattatgagcataaaaggacaactctgaacggacttgaattttaggattcatccctagagtcttgatcatgatcagaagcagggaattattttttaatatctgttttacataattaaggggtggtagctttcatgcaaatgaacgctttgaatgctcacaacaccaaatgggcttcattagcttagctgggcaattatgaagcaggaagtaaaaagctgagataaagacttatctcaaaaaggtctgaagcagggcgtgttgatagccaagaggcacaacgatgcattttgtacatttattacctcggaggcaaaacttctaggattctagatagctttgaaagcagtgcatacattccatttaacacccaaatgaaacaggtggaatgtttaaagatctgtagaaagtcttgaaatcgttcccacacattggaaggttttaccaaaccttctctatttattctaagtgctttttctattgtttttcaattgcttctctcatttccctcccgtgtacatttcagagaaaattggagagcttaaaatgcgactaaatataacccctgcactaagcaaacagtgaataaatccttaagaaattatttttgaagcatattctttctgatttgatttaaaaactgcaatatcacatgtgagtcttgctcaggagaaaggctatttgttcacaagacgaccaagcatgtagagggaaagctgagggtgaagggactgaatccggttctcagctatttcaatacagatgtttttctagataatcggcctcattgtaagttaaagaatcaaacataaatcagatctctcacaggctgagaaaaggcaaaacaacagcctgttcgttctgtaaaaggaccattctagttggcctatctggtacaaccaccttgtttaaaagacagtaaactgaatccagcaaaagtttattgacttggtccagaatattactgagccaccaccacagccaggcttacatcccagagctcctgtttcccatcctgggctgtgtatattcttccacgtcacctccccaggtggctggctttgagaagaagggaatcataaaaagaccagaaataacatatacaccttgaaggagttgacacaggattttttcttgatcactttgcaagccagggacctctggccagtgacaccctgcccaggcctcactcggccatgctacttgctataggagatggcccgcccacttagcccgctcaggccgagtctgacttgcacactagttcccaagttcttgtcctgcgccccagcagaatgaggatacactgacaatcaaagaaaaagtcagggagttttattgagtgatgaaaacagctttcagcagagtggggatgcaggggtggtccccctatctgaaggcaggaaagtccacccaatttgtctgagtctggggcttttataggctcagaataggggaggggcaggcagtaggtagtactcgaaaaagcaacattagattggttcaacggcattattcagaaagaatcaaccaagaaaggtcaggcaaacagaaacgcaagttctcactctgggtcgcaggtttcatccaggaccagcagtctggtctttcagccttcaggctgtttctgttggttcggaggtgggatttcactggggactcacctctatctgactaggtatttggctgcctcctactgtcctcagagtcatctgttcatcagtttgttttccctgtaccttcctttctcacaaacattccattggcagatttctgttttgttctgtgtgtttcctttccttctccccagttcaagctgaggcagacgcatggacaaagaaaaacaaactgctggctaaatacagagcagagagtgtcatggaatgtttacagaggaaatggttttaggaaccagagagtaggaaaagctcaggctggggaaggggcaggaggatgcaagagggaatgactttagggtataaaaggaatggaaacggccaggcacagtggcttgtgcctataatcctagcaccttgggagactggggcaggaggattccttcaggctaggagttcaaggccaacctggccaacacagtgagaccctatctctgttattattaaaaaaaaaaaaaaaaaggaatagaagaactcgagtccttaaagaattagggtctccatgtagagtaccaggtggccaggtgaaaacatacccaaatatcaagtaaggacacccattggccagcacccccaaattttagtccagttattacacccaacttggactggcaatttatcccctacaggtaactgaacatcttatggtctgggaaatctaccagcccctccaaacagaagatgaggagcttaaatggaatagtaggaagggggagctttaccccttgaccatgatgggtctaaataaaatgagctgggaatttccctaggagcccagggtagtgctacaaagaggacacactgcccctgaggtatactgtgttcatttgggagctatctagtcccagttttccaagacagactccagggaaaacaggtctaccttgaacaacatgagtttgaactgtgtgagcccacttacacatggattttctttcaccttcacaacctctgagacagcaacaccaacccctcctcttcctcctcctttacagcctacttaatgtgaagacgataaggatgaaaagtctttacaatgatccatttccacttaatagtaattataattcctctttctgattttctttttttaatcttttcttaattctaccaattaattttttcttttttttaaaattttattattattatactttaagttttagggtacatgtgcacaatgtgcaggtttgttacatatgtatacatgtgccatgttggtgtgctgcacccattaactcatcatttagcattaggtatatctcctaatgctatccctccccccgccccccaccccacaacaggccccggtgtgtgatgttccccttcctgtgtccatgtgttctcattgttcaattcccacctatgagtgagaacatgcagtgtttggtttttttgtccttgccatagtttgctgagaatgatggtttccagtttcatccatgtccctgcaaaggacatgaactgattattttttatggctgcatagtattccatggtgtatatgtgccacgttttcttaatccagtctatccttgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgacatggtatctcattgtggttttgatttgcatttctctgatggccagtgatgatgagcattttttcatgtgttttttggctgcataaatgtcttcttttgagaaatgtctgttcatatcctttgcccactttttgatggggttgtttgtttttttcttgtaaatttgtttgagttcattgcagattctggatattagccctttgtcagatgaatagattgcaaaaattttctcccattttgtaggttgcctgttcactctgatggtagtttcttttgctgtgcagaagctctttagttcttactaatattttcttttctctagcaaactttattgtaagaaaacagtatataatacatacaacatacaaaatgtgttaactgattgtgttatcagtaaggcttctggtaaacagtagtcaaattttgggagagtcaaaagttatatgtagacttttgactgcctgggagtcagcacccctaacccctgtgatgttcaagggtcagttgtattctgttagctcaccaatgtttacctgatcttacacttgtcctaacttctaatatggaaaggataggccaatgatatagtagagtgcttagatttgactgttgaccactggctctcaaagcctctccagtataactgcctctgcctcttcaccccatctcccactgtgcctaaaacccaacactccagccaaagagtaatcatgcgctgttgcctgaacataccccatacttgtctcctactagtctttgctcatgccagtcttcctacctcaaaggctctccctttgctctgtttacctcttgataacttatccatctaccaaccaagaatttttaacatctgaaatgattcacaaatggaatgggatgggctcaaacgataaaaataataatggctaatttggtgtcaggaactgtgctaagcatgtggaatacattattctcataattacctaagagggagctataataatcctcatttcatagatgaggcccaggagggtcaaagaacatttccaaggtcactcagctgggattctgacccaatcagtaggactttagagctgggctgttaacctgtaccctctatgcctctaatggtccttctaacactgtgaccctggcattttataatgtaactgtttctccccagatccctttctgaatgcccccaatgaggtgtaagccctccttactctggaagttatctcactggcctcacccgacatatttacatacttttttcatctcaccaaatacagatggtccctaacttcaatggttcatctcaaatttttttgactttttaatggtttactgggagtattaaatgcattttaactcatgataagtttattgggacacagctccatcatatgtcatagagcatgtatactgggtaagcttcatgaaagcggaaactctggctgatttacccacaatcagactgtctgagctgcagcagatattaaagtatttttcgtgaatgaacatctttcatgcttcacacagtagaagtgctccgtaaatggttgtggtgtgtgttgaattctgttcaaacaattatcaggaacaacagtcacagtttttcacagtagcacactggaaccccctttcttcactgtgagtgctgccctgaccctgacaatcaggtcaactggacagtctgttctcaccagtctcaatataggactgaaaagctatcttctccaaccaagttgtttggatcacctgaggtcaggagttcgagaccagcctgacccccgtcaatatggtaaaaccccgtctctactaaaaataaaaaattagccaggcatggtggtggacgcctgtagtcccagctactcgggaggctgagacaagagaatcgcttgaacccgggaggtggaggttgcactgagctgagattgtgccactgtactccatcctgggcaacagagcaagactctgcctcaaaaaaaaaaattgtgattttttgaaaccattaaattcttcactggtgtcatggtacaaacaaaatcacttgctttgactcttggccaagtccagaattgtgtcattttaaaaaactggtttttaaaaatcctaagttgtttccacctgcaggcataggcagaggagccttcgtccctcactacgctgaccccgagtggttccagtcccatcattccagaaacccctctctggtcttgtatcaaaaacaccacaaatcactgggattgctctgtcatggggtagaaggggctcgaggacaaagtttagcttaaaaccagagtgaatttatttctattacatatggttaaatcatgacttcttttctaatccctaaagctaaacagtagagtcatgctggagacacaccatcatctatgtcaatcagacaaaattaaaacagagaccaacatctccttgtttcatttaattttgttctcttgttactgcatgtgtgacaccaagaaccacttgacctttggacaaaaaagtagttatatataagccatgtatggctaaggtcctgttttcacaggccaggaacatgtaacagctctaattcttgttgactctatttctgaaatagagtctgaatatgtacacttctttctgtctcaaagtctaccccctaggccagaccaccattgcttcttacctggggaacagggcagtatctgctcttaactgacctgccggcccccgctccctattctaatcctttctgtatacagccgccagaagggcttgacacaaatgtaaagcagggaaccctgaccctgtgcttcaatgacttttcaatgcatggagaataaccaagcacattacctggcctgcaaggccctgcataatgtgatgtggcactgtacagatggccatgtccacctcgggccactctccctcacacctcctgcaccctgggctcactggcttcctctcacacctgagcacttgctgctcctttgacctggagctctcttctttcagctccccaggactggctcttgctcatccgttaagtttcagctaagtgtcaccttcagaaagtcctctctacctatgctttctacaaaggtctctgccttccctcacccaccccatgctattttctattacattacgtatttttttcttcctgctcctttttacacaaactgcaatgattgtctttacgtattgacttacttatcttcaattttccctattggaatgtaattccatgagggcacagcccttgtttatcttctttggcattgtaccccctattaacctgcaacacatcacatggatgtaaacagtatctgtgcaatgaataaattaacgaatgccaagttccatcacattccaaggtctgtcattacctgggcccctgccatcctttccagccttatcaaccagcgctctcccacatggacaattacgcaaggcacactgagccacttccttcaggaataggtcactttttcttgcctctgaaattttataccagctgttgcctctcgctaggatgtctttcttcccttcctcactcaagtctaattctgctcaaggatcagtttaattgttacttcctctaggatttcaaaagaatttttgaatgcaccaaggcaaagttaaatgtggcaacaatctgtcagaaaagctgccttttggtgggtgagtcccagaagtacagaaatcatggctaaatcgtacctttatcttcaatacaatacctggcacacaataggtgttcaataagtgttaggcaaatgagtgagtttaactaaattataacttcctgagaactaacaacatctcaatcactacgctcagtatagattgaggctgagggccgccaatgttggcagcagcaaagcctgcttaaatataataactacagctgcattgcacagaagtccagttagtgcagaagcataaagttttgagggtgtgtgaaaggaacaaagacaaagttcaggtgagacatggaagcaacgagaaatgcaacatggggcgagtaagccagcactttctgctttcacttctatcactttggaaacatttagtccagaatgatctgggggttcttacttatggttctaagacagcctccacattcctcagcatgtccagtcacaatcaccatctccccaagaaggcacaaagtaagcatctgtaaatccatagttggctattttggaaaattagtgttaaataagaataaaaaaaaaaaacccttcacctttatgtgtaataaagcactgcttaacaatcaaggtcacccatgtcaataacactccccaagcaaagcttcatatctttttaattcctaggctcataaagaccattgtcacttacatcattacaggattcaagggagaataacataaagagaatgtgcaggataattttcaaaataaaagagaaaaaaatgacacatctacatatcaaaccacacaagtcccgtgtctgataaaatcacaattatagatttggtgcatttaaccagtcatacatgccatgcatttgcgaaggtgccatatgggggagttgtggaaagtcaaataattcctagactttttctttctgagcacatgtgacaatgaatattatttacccctgtagtatagaaattatgaagcttaagaccccattgcttctttttaataaaagctaacacatcacagcttactgcttgacccagctccttggtctttgcacgttctcctctctgggcagctctctctcagttttaccccctaccacaggaaaggagacagctgtgtttctagacttgacagacttgtttttacttgataaacacattgtatattgtaggggagaaaacgatcacccctattcccctccttagttcttatgtgggctctttggcccgatctaggaaccaaattgacacaacacagattaacaaagaaaggcgtacacattttattaattttacacatacatgggaatcttcacaagacagtgaagttcaaagaagtgaccaaagcaacatgcttttacacgttttagacaaaaacaaacaaacaccacgataaatttgtgaagaaatgacaggataaaaagggatctggctagggaaaataatttctatgggagtgaccaggagctatatgaatgtaaaacaagtagaaggtaaggattatttcaggaagtttatttgctcagacacattgcagcacctaatcacagtctccactgataaggaatattctcttacccttgtacggagaaggcagccctcccaaaagaatctttatggcttgctacgtgtagaaaaagactggtcagttagccctctgcaattatactttttccaacgttttcagctcgaaataatcaacataccaattcgcatattctgggatggcatgtccttcactgcttcaggaatatgttttcctttgtgctttacttggatattaagttccaaccaattttaattacatgtcgcttgtgcataatattgccacttctaaaaagcagatcactttctgagttagaaagcttatctgctttccctccttatagacacttctgaagcagaaaggaagtaattcctatgctcctatcagatatgggctcatatttctgtttcaaatttaagtctgtgacccctacatgaggccaggattttgagaagagtgaggaaggtagactctttttaaaccatgccacaggcaaaaactcagaactcattttggggaggaaaaaaagtcctatcaaaccagtatactataaattaaacaatgtagcatcaaagataacttttcctttagttgttacccctgagtggtcacgtagccataagaaaatcacctccttgtcaacacatcatcaatcaaccagtgttcattaaataccaactctgtgctagaacctgcttggtataaagaattctattttgtgttcaatgtgtgcattcagtgctttgattgtaattatctttgaaatgacccaaatcattccaaacaactataagtgactttatattcagaatagcaaaaagctgacttgaacacacaatgtaaaagtcttgaagagagagtgaattaaacttttttttttttttacaacaatcagtgggcttatagaatagaaagagaaagagggggagaggtttttatcttttagaattgcaatgcagtgaatagtgatactagaagaacaatcaccaaaagattacagatgagaacttcagatgaaaataacaatgaaacaaagcaaaattcaattaatggccttagagaaggtgagatcagaaagagaaactgaaagttttttagacttctctttaagacagataaaatttagaatttttaaaaatccataataaaaaccagaacaatgctacctcgccaaagttgagttcaaatttagtcacttcagtcaccaagaatccaggaaacttagttactatgggaacagaggtcctcctcttcagaaaggagggcagtgtttctttcaaattccaccagctaaattcaagatcaatgatggttgtttaatatcctctcttgaagctcttactgtctttagtatactttaaaataaaataaaaactcaacaataatggagctcaattaagcataatttgtgtgcttcaacctttggctgggtgactgctctgtaccgttcacacttgtactgtagagcattgcaatttttaattaagatcactcattctatttcccctgaaccaaccaatgttgaggttattgtttggatacaaaactctccaggatacggcttcacttaacaaggactttgtttctttcaagtaccaggcactcactggttctgagtataggctgcctgccctactttaaaatgcatctcaactttatttcagagacagtaagatttcattgttactctacaggacttagaaataaatgcatgcatgtactcacacacaaaatctctcgataattttgcatataatacagtttttgtgctctatgccaacaaagaacagaatgtttagtaaatcacagagaaacacttttatttcttgagactgagatatgtgtggcttctctacttttctaggaattacatttaaaatgtaagaggacaagacctcattcaaccttttatgcctactttagtgatcagggtgaaacatataagaatattgcaacaccaaagctgtgtgtcactactcagctaatggtacctataaagaaacttctcttaattagctttaccctgaactaacttcctttgctctgccatgtataattaaatatgttagcaagacagaaatgtgagatgtagcagctttcacacccaaatttccgactccaaatttataaaaagtgtggatttttttttagttgaaagcccatcatgaagtattttacttttactctaaaaactttcaaaattacattaaaagaagaaaaagaaaatgggcaggaaaattagtaatgagagatgaattttcagagaaaagaattctacagtagtccctcctgatctgcagtttcccattcagtgctttcagttacccttggttaaccatggtccaaaaatattaaatggaaaatcccagaaataaacaattcataagttttcaactgcaagcagttctgagtagtgtgatgaaatctcattgtctctcactctgtctcttctggagcgggaatctttcctttgtccagcatattctggctgtatatgccactcacctgttagatacttagtagctatctctgttaccagatcaactgttgtggtatggcagtgcttatgtttaagtaactcttctcttacttaacgatagccccacagaagagtagtgatgctgtaaatttggatatgccaaggaaaagtcccaaagtatctcttttaagtgaaaagtcaaaagttcctgatttagtaaagagaagtcatatgctaagggtggcaacacctataggaagaataaatcttctatccatgaaactgggaaaaaaagaaaaattcatgctagttttgctctcacacctcaaaccgcaaaagtttcaaccacagttcatgataagtgcttaattaagatggaaaaggcattaaatctgtgaaaggaagacatgaacagaaatgtgttcgttcctactgatggcaattaggttcggtaccatctgtgatttcaggcacccactgggggtctttgattgtatcccctgtggataagggggtactgttgtatatcaaacaaaatctgaggtgcccagccaaggacagtgctgcttcccagaagagatgagactcccctatcctttctatcttcccaaagggtgcatgtagtgtacgcccattggtctctccctttcaggagtgaatccaaaagccacaatattgatggacggcaggaaacgtccagtatctgggctctgaagaaccttgaggatagaatccagctccaatcatacagttcctctgtatggataccttaaacaaaagtgtattttatcctttttaatttggcatcccttagaaatgtgaaacttccttgtgaaaactgctctttaaggaaacgaaacttttttattgtaagccttcccattgtctgtatataattaagaaaagatcagtgatagttcacggtggttttataataggtgaattaatcagttttaaaaagctgaattttacatgcatttgacaaccaatctgggcactattttcctaggaaaaggctcatttgattaaataaattttaacctttaaaagctttaattcttttttttttttttttttttttgtacacaaaggactcttttgtgatggttggatcaacttacacatccagagcacatgtgcatagataaaactttgcagtaaactatcctgttacagatagcttttcttacacataaaaatacattctgatgagcaatctaggggaaacaaaactaaaaaaaattaaaatacagatatacaattcatattctaatcttatcagaataacctactgttaaaacacaaactgaggcaggataaaattttaaagagtttatttgatcgaacaacaattcatgcattgggcagcttctaactggaagtcattcacgagctccacagagggaacatgatgggtggacttttataggaaggtcacaaaagtaaagcaagtcagtatgtgactggttatagctctataattgccttatttgctctatcccattagaaagtcactaaatatatatacataagtttgttggctacttccaactggacaggcttaagttctgttttcctttaatataggcatttgcaaggaatagcttaagtttcacttaagctttgcaagccaagcaaggtttaggtcacttatgaggtctgatatcatctgtttctttcaggcctagtctccattttaatttactttaacactatccataagaatattaaaaacaggcagcagatatgcagatattttatcaatacaaccttttataaatacaggaaagaatagtgttgacagtctaaatttgcttccttgaggcattatctgtttgaccagatttaatcatttaatttgaaacaaagaaacaaatactactctggggttgctgtgaaaggacattcagagtggacaaaacctctttaaacttttcttcaaggtttcatcttcacatatatgttagtttggttactttgacagattggtcaacttaatccaatacagttttatgggtccggaaagtgctttgcttgactttgaccgtatgtgtcatgtcagttaagttaaaagctaattcaatgtgtccacttcggggttatttccatcataaggcattatgtttttacttgggttgtatgggggagttcctctgaattgactagacagatgggaggtttagacacagtttaatattctgtacttgcagaagcaactattgagagctttgattacaactaaattcaagctagctcaaaagttggttctcagccatttaagtcaaaaggttaggtaatgtcactccctccaggggttcattgtccagtttttctgtgtattcattttgtttttatttcatgcctatctagtacccacccctgtgtcccacctatgcctgaattcttactgtgtaaactcttttggatgggaaatgaccagctcctgctactgaccacagccctccctcttgccagagcctgaaggacaggggactcctagctcgacagatcatgctaaaattataccttgtgcttagcatttcttggcctttaatcctgtcccagttacttctctttttttttttttttgagacagagtctcgcttttgtcgtccaggcaggagtccaatggcttgacctcagctcaccacaacctccacctcctgggttcaagtgattctcctacctcagcctccccagtagctgggatcacaggtgtgcgccaccaagcccagctaattttacatttgtagtagagacggggtttctccatgttggtcaggctggtctcgtactcccgacctcaagtgatctgcccacttcaacctcccaaagtgccaggattacaggcgtgagccaccatgcccagccattccttctcttttctaagatttgagttctcattgttaatctggtaattttctttttcacaccagataagcagagctggtttctgcattgctaactgggagcttcctaactaaaagagcctcacaaacagttaattctgctctagatgctgtaaaagagggggacgggggtaggggcagggagagagagagattacagtgataaaatgaaaatgctgtttcagccaggaagttttttctcccccatctcatatattaaaatgggcctgattttctaacttcagcataaaagcccagtaagaaatattagctcttcagttaatgtcattcacacaaggaatttatcagcagagtttgtgtttgaacttttcatgtcatctcacgcatctcagagggtattaaactccataaaacacaatcccaaaagtgaaatatttcccacttttactctataagtgagtcttagggaacggaaaaaaaaattccatgtctggcttattcctaaagagagagtaaatagagatatttcttgggccaaataatgagaagaatcacaacccttagggtttatgttccaaaggcctccaaatcccaacaggtccagcaaagcagaacagagaaaggggctgaatatacatgaagagaataacagaagcaagtggttaatggtttccttaaatgcggcagaaaatggcttatgtgtacctaagtatcctatagtactgagacttaccaagaagaaaaggtgaaaatggaacttgaggcccctggaagacatgttcttagctttgcctgctggctttctgcataaatctgacctttctgcaggtgaagttcttctttacagcccagtttctcctcttagttggctactgacccacagtagcagccaaaattaaaccaatgatgtatttctcgtacttccccaaatcacttttctttaaataagttaataataatccaaacttgcatttttcagctgagtgctttgatacttgcttctcaaaaaactacttggaaggtaaaggagttttcttttcgagacctcgatcagaaatactccatgattcacgcactcagttaggcctaaattagcccaatgttatggctataaaggaaacaggaaacctgtgttccagggacaatcttcttcatcactctattcccagcgtcctctcatatgaggacacggggggttgggctacctccatagaatgataataaaagtttgcctccaaaataatttggaatttttgggttaagcatcaggacatttcatatcatgtaatatactaacattcagtataaatctctaagcagggtaagtgggctcagaataagtcacaatctctcaactcatttcaccatcttgaaaatttcttccatggagcacaaagatgaactaagtaatcaccacattcctcgcaacatttatactttctgatcaggacaaaatgattctaaggagtgattaaagcagggtaagagagtcttctcaccctaatgaatccaaagatcaccaaatagacacccagtttatggcttagtgatgtaaaacaggtgtgattcagagccaagtttacgtaagttcaaattctgtttccatctttggtagctgtgcattcttggataagttacatcacctccgagcctcagtttcttaatctgtaaaacagacatactaacatgacttcatagaggtgtttgaaatagattatctaaaataagcaccaagtgttacatataatggttatttcagttattcattgatttaattcaattaccattaaggttgagacctggtcatcattacccagttaaggaaggggtttgacataaaaaccactcaagatttcttcccactttaggactttatgattgcctttaatttttcatgtttcaattatgtaactaaaatcttctattccatatatatcagaacacaccccatctaatctctgctaagtgtttctctactctgcctgtcccatgaaacaattcccaaagcctaggagagtctcctgtgatacagataccaaaatgacgtgggtcagaagtaactcatacatccatattgtcagaggtgaactatacaaaatactgagtacactacagagtgatctgataggccaagaagaaaaaaaagtaatctgatagaccgagaagaaaaaaaaagtatatgttgtttctctactaaagaatgtcaccgcatattgatttttctagtcttttacaaagactgtgttcagaatttagatcagtgttagagaaattcacttataaattcacatatacccgtatataaggatacagtcctgtatctaaggataaagtcctagcttaaatctggaatgagtaaaaacaaagtgtaaagttaaaaatgcccctctggtaagacaaacatatgcttttcacccaaaggtgcagttaaagaataacaacaaaagttggtagtgagatccctctaaaaccactgatatataatagactcctactgacaccctagaaaaatgatgccaacccatgcagattagtttcttccagcaatgtaattacccatttctttggggctatctttccttcaatggtgatttgagaaatacctttcatttatactccattttgcacaaataaactacatttaaagctctataattagctgtcctttgctactgtaaaattcagtgtttttgtccaaaaggaacagactattgatttacaaagaagctgaaatgctgtcaaactacccactgaagaagtaagaaaaaagtggtccctatcttggctctgcctctagactagctcttgtcctacctcagctttgtatccacataccgagccttctgttaaggtttagacttgcacagccaaggcctcccaggcatctccccattgacatctaagagacacctcaaattaaacatccaactctttgcctgaaacaccgttccttaagggctttccagattagcccttttttgcctctattatttgtatctcttaaatgcttactattgcaagatgtagaaaatcccaactaaaacgggcataaaccataagagaaattattgtctcacacactaagataagtggctcagtgaagctaagtatgggattatttctctttgctcatgaaagcatcaatgtgtcagttgggttcaagtacaagaatcagaacccattctagatattttaagcaggggagatttaatacagcaaagttggtgctggagaaataacttggagggctgaaagtacaactctaggtagagccttcagtaaggactcccagaacaatatcccattgacctcatggaacttgtaaggagccactcctcctgaagctgtcttggagccatagtaaaatcaagaacttgtcaccattacaactgactctactaatgcaagaaaccatagaatgcttatctgtagctgtggtcccgagtttcagaagcctgatcatagcgctgccactgctgcttctgccatcccaaccatttcgtaaaactcagaaagctggagagtgggcagaaaaacacgactgcagggaacctggacattgccacagctacgtttaccagcagaaacagccaaaggagggctgaaatatggcctccacatggctttcaccttccacacatcacatatacacatctaattggagaagactttttttgaagctggctaaaagagaatctgagaaatgatgcttttagttttgcaacaactttaacttgaatgaggatagaatggaaactacataaattcatctagagcatacgaaaataccagcttcctgggtgagtctttacataggagcatgatggaagcaagcagcaatcaaggctgccacagcctttgatatgttctaacagtagagaagaaaaaaatctctttcctggctatggcatagaaggccttcctttactccttatggaaccactttaagccatttgctgactcacagtcgaataccactgaccatggaatgctatgggctgattggctcagatggacaatctgttgagtgtcaaccacagtgtagtctatagtgtgcctgcttacataacatctaatcattgagggctttcctgaccatccaatctcaagtagcctcttctcctgacccatgaattctgtgtctgcttaccaataggtaagtcttcatggcacttaatgcactctgaaattatcttgccaatttacttatttgcctgctccttatctcctttccctactaagacgcaagctctgtgaaggtaaggatcctgtctttttcacgtctgtatccccaacacttacagcagcatgaaacacataccaagcattcaataaattgtttaatgcataaatgaataggctataatccatgtactacagaaaccttaccaataaaatgcttatgttcttcccagttaggccagcttagcagtttatttaaaaggggatgagaaagagagagctgttcaacgtgtgtgtggccatacacagtgaatctactaactggttagtcttttgggattcagtgttacatctactatgcgccagtcactgtaccctactattagcgatgcataaatcagaaatcttggcccaaaggaggactactggtacatgaagattaagattctacgatgacagctgcattggaaaacagtatcatgaaaagtgttttggagac

SEQ ID NO: 2492 - DNA, 12960 bp, Homo sapiens
cctgagaaaaagcaattcaaagatcaatatttccttttaaattttacacaacttggacaaaattttctaaagaaatcacaattttaaaaatgttggaaagccagttccattgctgaattcataaggtaacttaccgtaaatcatatatgattatcatatttataactaacatcacatagccccttccagactgtcaactccatgagggtaaaacctagttatgttgacatctgttttctcaagcagttagaatttcctgattcattctcttgtctatctggctggaacagctaaaattaaggcagtggagatcattagtttgataaaacaatagaagacaattggtattggtgtaggagccactcaccagaaatgctgtaagtaatgactaggttctgcagaaataaaattaacagattattacagtacacactcccatacctacatcaggagtgaaaggatcaagcaccacagttaaaataataatgtcagttgcaactggggaactgagggtcctggagactcccaactcagatgcctgaagaagccagggcaggtatagtaagcaagcagggaaaacttggtaatagtgtacatgtgtacttggcttctgagtagtgggagatggcactgaactggcaagcccatatcccaactaaaagtgggtttcagctactaatctctaaccaatatttgccatgtagaagggtagagctccaaactcccatgattttatatatacatattaaatggaaccacaaatagcaatttctacatattatctccaaaattgtacgtaacgtcacaatttttaaaaccattatgtagaacaaataagacacatgtttaagcatttgtgctttcccaaagatgatgtcacctttgttcctggtccaggaagctaaaaacaagtaagaggtgacttcctcccatttcttctccctccttcctccctgtattccaccaacagtgctacttaaagtatggctatggaatattgccactccaaaacctatttttttcttttttggtctaagataagcgtgatgaacaggtaaactccatgatccagccccctgtattcatgctcttgtgtgtaatctcctctcttgagtgtgaacagtgtcagtgatttgcttccaaccaaaagaaatgcaaagatgatagaatgttactgctatgattatgttatgtaaaactccatcttgctagcaaactcactcgagagtctctctcccttgttggctttgaagaagcaaactgtcatgaatcctacagccacaaagaaacgaagtctgtcaacaacctgagggagcttggaagtagatcccttcccagtcaagcagctgatgagaccacagccccagccaaaagctatattgcagcctggtaggacactgaagcaaaaaaaagccattaacccatgtctgaacttctgactcacatgaactatgagataataaaggtgtgttatcttagcaccactaaatttggagtaatttgttatatagcgacagcaaactaatacaaggggcctaccccttaatgttaattaactgtatcactaggcacattgtttagtttgactgatatttattttttgtaatagtactttctcaatgaaggaagcaatacattgaattacactcagacgcaagccacctcatctcacagcagcccaataccttgagttctacagttgatgggcatagtggaaagagaggtctggtgtaactttatatgcagaaaatgagaaaggcacattttcttcctttgacttataattttgtctaatgatatatgcaacagaggtagtcaagagcagggtcagggaaatggagactatggtgaaggagttattacctgtaatacttctaagttgcatcataaaaatttgctatcactacagataaaagcaaaggatgagctaactgataatacctgtaaaatgctgcaaacaccaccatgatgtggtgaggaaagcaagataaacattcctatagaatcctcctattactacttgccctggggccttgtgaaaatctagagaatctaatagtctagtactcagctcgcaaggaaaccagtcagtcatctttgtcattctctgctcatatcttatttcctaacacaacaaaatcacttatagacccatgcagaaaccatgcccttccttctcagtcctagacctggctaacccctgtgccctctaaagatttaattagctagctcttaccctgaagaagccttctttgataagtttgttcctccttatagcttgctaacatcctgtgcaatctccatcatttcacttcttgccctgtatcgtaattagctcttccggtgactgtcttatccactggagtaattaattgctacttaagataagaaaccatggctctcatttttgtatttccagcactgaggagcatgccttgctcatagaaggccctcaataaatactaagtgcagagaaaataagtgagttattttactagaggctgcataagagccaagagaagcaacttaattatgaggcaacaataagcttggatgatgcagacaaaaatatgctaggagattttaagcactcagtctgtcagtggtgagcctaaaacaggttcctttaaaggtaaaagattcatacaaaacaatacgaaactaagaattgtacaactcaacacatgttaaaattgaaagaaatatcacaggtactcactatacccagatgtcaaattctttcatatcttgcttcaagcagcatgtgtatattaactcatatttaatacaaaaagctatgctttttctaaaagcatttcttttttaaaatttttttttaagagatggagtcttactctgtcattcaggctaaagtacagtggtgcaatgacagcttaccgcagccttcaactcctaggttcatgtgatcctccggcctcaggctactgagtagctgagattgcagttgtccaccaccacagtcaggtaattttttaaaatttttattcatacttttagaggaagggtcttgctatgttgcctaggctgatctcaaactcctagcttcaagtgatcctcccaacctcagcctcacaggtcactgggtttacaggctcaatgcaccatacctgacctaaaagcatttcttatcagagtcctacttacccagttttgtcaggtgccaggaaataggggagctcttacctaggagctccctctggtcagagtggcctcgcattctcagtgtgggggattcagtcctacatttatacctcccttggagatcaattccttaaagcaaaacaggtggctcactggatggcattcactttcagttgatcaattgatttgtttggagatcagttcttaacatttatttcaacagtttaacaagataaatttgaaatcatttttcctaaaaaaatttcaaggtgatcttaatattattttaccaacttcaactatgaccccttcttcagacttaacctaattccttctgaaagccaaaaattcagacccatttaccatgaagctgaatcctccactgcttctctaactacctcttccatcggccctaaaacattaaaaaaagtggggtgctgcttctctttttctgtaagatgcccaggcctggttggtaaaagtttaactgcttaggtgattattatgcactatacaaagtatactacatatcaagtgctctgcccagtagagggtctactaaaaaggcttaagagtgaaaactgccaaagggaatttcttaccttccctcagggcacacagaacctgaacctcagtaccaggtgttccctacatctccttctgctggtgagtctaaacctgaattactcttctttgtctaatcaatttagacaacaaattaagcatgaatactgcttggcatagtagccttaatcaaacaaaaaagtgagattttttatttttttaaacatctatgcaaacatagagcttttgttagaaaaagttacaaattaataacattaaataaagccaactctttagaaatgatacagaatagccaattcccagaagtatttgagtggctgaaaaacaaatctgtaaaaaagtcaatctcaagcaaaaatcaagttaaaatgagacagacacactttcaaaattgcagtaatttttaaaaatttataagaagtgtgtaaagaagttgacattcatacagtcctgttcagctgatagcttttttagagagaaatttggtaatatgaccccaaaaccttaacaaattttatatatttatcctatctattctacttcttagaactctaaggaaacaagaagagatggccagagacttatgtagtaggatttttctatcacgatgatgggctggagaatccaaatgtctcacgataaaaaagtggcaatataaaaaatggtatgtgatacaatagactcctatgctataattaatttttatgacatatgacatgcttgtaacatattaaatgaaaaatggcaccaaaattgtttaaaatacaattattttatttttaaagcatacataaactcatagtaaaaaagtatgcacattaatagtattagtcattacctgtgaaaggcagactgattagtgacttactttattattcctatccttattttaaacttttccaacccatatatgtggcccatcagatttgtaaaaatgaaaatccaaggcataggatttgaaggcatacattcctataccctgctaaaaacagactcagtttagtatctccttaggttctgatataagatgattctcgaaaaagccccaagccaacccagtctgaagaaacagatacagagtagttatcagaacaagaattcaatgccagttaagtcacctttcccaaatttaattctaataataagtccgtgttaaaaagcaaaggttcaaatattttagtgttattgagaggattagctcactgctgagagtgaatataaaaaacaattctatatcaaagccaactaattcaatcttatttttaaatgtcaccaaatatggcttctctcaaagtacgccggtccaattggtaatatctgatggctgattctgcttaactctactaaatataaaccattatcttagggaatcagtagtatactttattcttgttattctttagtattttgttagggatcataaaattggacttgactttgaggacaggactggctaagccagggcagttagtcctatggaccttttcactccgggagtctgtgactacttatccttaaacatttccagtaaatttatgttttagttatcaatcagttatctgtaaactagaactttaaagaatcctaaaacataaatctttttaatcctcaatgatttagactctctacatttttaaataattcagtcaaacaaaagaagggtaaattagtcattttgtgtgtcagataaaacacacatgcatacacagaataaatgttttttgttctcaaaggattttgttgtaacctccactcgtcatgtaacactggaacaaaatagttaggctaattacccaaaattaagttccacttctcgatttacaagctttccattttattctagcaattcttagctgtcatggactcagaaaattattactgccatcaattggaagattgttttagtggtacagatggctgtccttttataggccaacttaatgacttcttcttatctaatctgtcatctgttatttagttgtcattatgaactttttgggttgcatatcaatccattttccatgtttactaaacagatggctttatttgagaaaaaaaaaagcaaagcaagaaaatgacattgcatgattaaaaaatttcaaaaggctgcatacaatttttaatgttcctaaatgaaatgaaaaattgctattaaaaaaactaaatttgaagtcaaagtgaaatagattttaaaactcaatggacatgcaaagaaacaatcagcagcagctatctacaaatagaacaaattacttccaaaacagcaataggttattcttccagtttttgtcacaaatttttttttaaatttatcttgacaaatagatgacaaatgtcaacgaagtaactcttcaattcagaagctctttatgttgtaattcacaggtgtacctcctttgtctagtatttgtaaccttatttagagagtaggtaatgacataaatacttccatttagtgaaaattgttccttatctttgtctccttatgatgattttgtttaatcactgggtcattatcaaatcaacacccaaactcaagaagcgtaagggaaattgtaaagggcttgtatcaatgagttcagagatccaaaaataataactggcactgtgccatgaaagaacactgtagttcacactgtaccagagaaagaacttgacaattattagaaactaaaatacataatcatgaaataattttatgttacatttatgagtggtatttaaaattgtgtttgttcaggaaggatatttaccaagtcttgggatttgctgtatcagcctataacaacgctgcaaaagtaaccgagcagagccttctgaaacagtttcccatgccatactaagcacatcctccattgtagaacagattgagttcaactgtggtttttttacttgcccaagttcaaggctcctgagcacaacaaaaccaacaatgaggaagagcatgatcgcataattttttatgttcttcagacaatgtaggagaacttaaaatggacagccaatttttcaaaaaggacaaattatttgaaggatttcttttcttatatgataaccacagtaaaatgtaagactagtgtaggtaattgtcctgccactccattctaagctgtgagtgaaagtactccatcagcttaatgagaacaccgtgaaatataaaacatctatttcaatacaagttattgagaagctttaacaggctttcgggagaagctaccaaaagaaaaccgaataccagatacttgatttgagactgacaaaaatcttctattctttcctacggaaaattaaacaaaatgggctattatatagcaggaagacagagacaaaaaaaaaaaaaaaaaaaaaaaaaaacggaagaaagagtaaattgtatgaatcagaaacttggaataataattctacctcaaatacttctcttaggtcttctgctcacatctttcaggcagagaacatctatttgatgccaaatgtgtggctagaactgggccaggtgctttacatgtcatagatcaataccaaacaactagtgaaatcagcacaaattcaaccaatgaagctcttaaaacaataaggtgaaaaaccacattgttgaggagagccatacaatacagtcaggttctagttcaaattacgtttctttccttgagatcttctggtccatgatatgttttgatctgtctaaaatattatgtaggcattctcaagtgattaagaaactccggattgtttcaaataatcaggtcttccccaggcaaacactggagatcacttgttttttgtttgtttgtttgtttctgagatggagtttttctgtgtcgcgcaggctggtatgcagtggcataatcttggctcactgcaacctctgccttccaggttcaagctcaagcgattctcctgcctcggcctcttgagtagctgggattacaggcacccattcttgagtagctgggattacaggcacccatcaccacacctggctaattttttgtatttttagtagagacagggtttcgctatgttggtcagactggtctcaaactcccaacttcaggtgatccacctgcctcagcctcccaaagtgctggaattacaggcatgagccaccacgcccggcccaatatcactttcaatgggtcccaacacattaaatgatgatttcttgacaaagttttacacactacttaaggatcaattgacatcaaccctaactcaaagccaggaagcttaatccaacatgaaaatattctgtggatgttgtacttaggcatattattctctgtagtatatactttcatattgatacacatatttaacatattgcaaagcatattttaaaagcattgatctatgttctactggtaattttcacaacgcttaatcacatggccatcatagtctttgcataagactaccttgttgttcaagaatggttttagcattccatccttctccatcatactggctcagaggtgagaactgaccttctcccagtagataaaagactctcataattgtattatgtacagcagcatcagcatcacctgggaacatgttagaagttcgaactatagacctccaacccaaacctctggaatcaaaactcaggagataggccttagcaatttgtgttttattatatcctccagctgtctggagaaccacataagttttgagaaagaaggcaatgcaccttatcattcttcaaggcaaagttcacttcacttagcttggtattcttcactgcacctagcaccctcaacataacaagcacttaatacatatttgtgacataaaatagattaaaatattctaaagacagaactcattttagagaacaatcctttccagccactatttggagattttgatactagagatgtatttggctgagaagtttcctttccttaacctattgctaggttctgtgaacttgccatgaattgaaaccaaggatggactacagtcagaatgaaggaagatgaggaagaaaaaagcaaagaagaaaacaaaaccactctattccttctgaatttggcacaaagatctcaggtgttccttatattcttaagacgtaaatcacaatgaattatgatcattgagcaaatattactgtgagcctaggtcaaaaagctaaggtcatagtgttctgacataaacaaaatcagctttatttcagaaagagcatagtgaaaggctaataaacattgctaagtaaagaaggggctgataacacagatacaacatggtaggtctatactttctagtgcttatccatttctctgccagcccctgcatttatggcacatcaatcaaaagtcttggttttggagccaggtgaactgggttataatctggctcaggtcttcactagttgtaggtctttggggaaattattcttctcctttctgactgtcttcatctataaaatggagtaataatggtaactaactcatagaattgatggaagatttatattaaataatgtgtgttgtaaatgctcaataaatggtagattgtttttctttgtctataggaggtgttgagggcttgtagtctacttgttcaagcaacaggacataaaacaaaagctcattaagtcagatgtggtatcccatcagcacttgcccagcactgagaatacagcaggtattccagaagtgtgagccaaatcacatgcattataccacagtacaaagaaaccttccccaagagtcatggttgagaattacacagcagagattttccacatcacagaacagagtagactggcttgacttcatgatatttggatacaaaactgagaaaattagatttccaaaatatattattacttgaatatgaaaatatcttttttttttttttttttttttgagatggagcctcgctctatcgccaagctggagtacagtggtgtgatcttggctcaatgcaacctccgcctcctgggttcaagcgattctcctgcctcagcctcccaagtagctgagattacaggtgtgtgccaccatgtccagctaatttttgtattttcagtagagacagggtttcaccatgttggccaggatggtctcaatctcttgacctcgtgatccacccgccttggccgcccaaagtgctgggattacaggcgtgagccactgtgcccggcctgaatatcaaaatatctttttcgaattctgtgacagcccatgaccccttcaccagagcaagccaaacaccacttgttttcgccaaagagacaggagcaaaaggttctggtatttatcatctgggctttatctttttctggatagattatgaaattccagtgtattccagacaggtccattttcatggaaccaaccactgtcttccctaaaagcataacagcatcacaggcaaaggtcccaagataatagaattttatatatcaggctggctttctaagagaagtcaataaaatccaacaatgatgggaaatgcaggatgtagcagagatccttaaaagcaattagcagagagcagggatgaaaagcaattatgcaaacactagaacactaggacattcaagactttttttttttttttctttttttttttttcattctgtaaggaaaggacagatccctgctttggaaaaagaatacaaatgtgcaggtttgaaagttccccattaggtgcatctaccatttctattatattcaaatactaagctttttaggacttatattaaactccataatcttaatatttatgaccacaacttaacaattaatcaaactattaaacactaaaagagtcaaaggctgagtatgggtggggcaagaaaatttttttttttgagatggagtctcactctgaaacaatcttgaaaagcctccagaaggtacaaatttgctggcactataaaagacaaaggcaacttaaggaggttcaaggaaaaaggaaaataatgctaagaaagagaaaacatgagagaaggcactggggccaataatgcacagagttcagatactaaatagtgaagtgatccattcagcctagaagaatgttatggtagaatggaaaaatgcaagtctttgactctgagagccctgggttttaattctgtctttctgtgaccttgggtaaggcatataacttcactgagattcactctgagcacccacaaaatgagggcaacaatagctatcctatgaaataggtaactaataaatagcagcaatatttaataggcatgcaaattcttttctcttcccttcaccaagtcataataaacctgttctttaattcaaaatcaatatggccaaagccaaattcacaacatcttctcacaagcttcccttctcaaacagcctgtcttatcaatcgagccaccatgtctccactgacccaggcttggaatgtctgactgatagctgcctcaacttcaccttcaaaacaaatgtctgctcaagttatatccctccaacacgattcattttgacctctttatccctgttttgtcaaccacaacccaaatctaagtctgaattattgaaaaagccttccgtccgacccatgtgattcctacttttctccccacaaattcatatacctcccactgcttagcttatctatttcgaatactggtgtaatacatcctggtgatggctccctgtttcctactactcagtgatatattcatccgttcatccaataaacagttactggatatccaccaaataccaagtactgggctatgtattggaggtgcaaaaatgagcaagtcatgcctttgaaagtccagtggggagaagtaaacagatagattataatacaatgctataaagaagagatgaaactagaaattcgctttataggttgaacgagacaaaatctcagatcagagatggtgctgtattggaacagcatctcaagagaggagaggtgtttgtcaggcaaaaaaatggaaaagggcactattctttttcaaaggcacgtacacaaaaaaatcctgtgttttataagtaaaagacacccccaccaactgtagaggaggttgaatggatttcttgcagcagtgagtgtgtaaatgagtgactagctaggatgcaagactcccctcctttgaccaagcaagtaaacaaaggatggattcttcatagaagatgcaatggcaacaggtgacaagtttctttgggcaactactgagtcagttatgtaggtaaaggggtagagattcaagaatcaaacaaacaaaagacaacaaaagcaatacaatatttcagacacagaaccccactggccagagagagagacagattttacccctcaatgacagtgaacacagaacttagaccatttgaaataaaagttcttaccatatctctcctgactcgtacaaacaccaaagggcaatagtaaaggaggataaatctttttgagggaagtgagctgtactatctcatatctcacgggaatccattcatgagaaagtcaaatccagaagtctgttccacttcagctctcatttacaaaaaaagttttctccttcctttcttaaatcaagtgacacaagtcaactcaagatgtgcagcatcacatcgtcactcaaccaaactgtgcacacatcttctgccatgggtgtcaccaatcttaaatctcagtgtttaatactgagatttaaaaaaaaataattttattgtgtgcatttgaagtttatagcatgatgttatagaatatatatagatagtgaaatggttactaagtgaaccaaattaacatatcatctcacatggttatttcttgtgtatgacaagagcagctaaagtctacttccttaaaaaaatccctaatacaatacaattttattaactccagtcctcacattatacattttagatctttaaacttagtaatcctatatatctgctggttgatattgagatacaatacttagaagctaaaagcttatcaaacatgaaggcttttctgttcggatttttttttggagagggttaacaaaatgtgttgttttaatttcattttcagaacaaattaatttatctcaccacactttttgtttctagcaagcatgacaccactaggtatgagctgtgtgcttattgtggataaggacagtgtgttagttacctctttatcccatcacagtgtctgccacttaagcattcagcaaattaaatcatcaacatgagaaacatgagatacatttttatcatgtacatgaga

SEQ ID NO: 2493 - DNA, 332421 bp, Homo sapiens
tgaatgcaaggcttgcctcaggggtttaccttgtctcaagggtcacagccctgcattgcctgttagccaatttctgaaaacagttgccgcatacattttatctaattttatagttattcatgaaatgaggtcaagaatgataccagttacttcattgtggcttgaaaactaaaatgctttagtatctctctccactaccaccatcaacacttgaactttacaaatgatcctatttattctaccacctgctactaaatgatgaaaaataattatcaagtgagttgccgaggcttcctgctcttatttctcttaccatgttctcagatatctgactgctagctaatgtctctgcccgggaacaaaagaagccagagaaggagaaagaggaagctcaagttctcccatattctctcttttcaaaagttacgaagagtagaaaatagtttaacaaggaagtttagagattacatgaaaattgtaatgagtctgatgcaccagcttccaataccgtcatcacaaccagcccttccttggtggtagttatgtattggttgcacctgatacctaagcagtagtctgctctcttttgcaataaatcacatctgtctctatgatagactctgacctcagcctaccaacagcatgttttttaatgacactggcttgcaaatgcatctgatttgaaataaactttctttgtaccatttttaggttctgtacttttgaataaaggtgcaatcacagcaaatcaaattctcagaagactacaataagtaaacattaagcagtgttcctttttgaaagcaggagagagtatatgtttaggaatgttcaaggattagtctggttcttttttaagtttttatttattgattttatcttaacagcaaaatacaatgcctggctagagcctttaaatacagataaacaatccaaacaagctgcaacttacgtatatcaatcttctaagatcacctcagaaaagagaaggtggctcccaacttgtcccaagttaaatacatttaagagaagcaaatgggaatagcagctaaagctgacggacagggcaattcgaggcatcagatgctccctttcaggttgctgagatgcttccagatggttcctgtatctgcatggccaaagtggtataatttattttcttagctttttcaatctctctgcatattacatcacaattttagctcaagtttatttttgttgtgtgtatttgacaatcctttggtggtgtggaacttaaatcatcacttcccagagcaagaaaacaaaggctgacacttctgatatagaaggctgcaatctggaaaggacgatggttggaagggcaggtggatgattgggaccaccactaggtttattctttatttgttcaacatgttttcattaaattagggtacagaggtggacaagtcagaagcagtctctctcattatggagtttacactctaccagaggtgagaatggaggacttaaaggtagacaaaaatgcctaatgtgtcacctagagaacacaaccaaaaatgagttacccaacaacttcatacagctgctacctgcagttagtatgtacatgccaggtaagctaggaagaggcctacagcctctcctggaaaatcttgggagaccaaataggttttgatcttgaccattccctgaaaatcctcatctataatcttcaaatgcaagaaggaaccaggaggtgccattatgtttcaccacaagaactcattttttttaattactgtttttttcttttagtgagcataattttttcttttgttgttattgttgttattgttgtttttgagacagggtctcataatgtcacctaggctggaatgccgtggcgccatcttggctcactacaacttccgcctcctgggttcaagggatcctctcacctgagcctccatagtagctgggattacaggcatgtggcaccatgcccagctaatttttgtatttttttggtagaggtggtgttttgccatgttgcccaggctagtctccaactcctgggctcaattgatctgcccgcctgggcctcccaaagtgtttggattacaggcatgagccactgtgcccagccaattttttaattacgtaaattaaaggggtacaagtgcagttttgttatatggatataccgcatagtggtcaagtctgggcttttaatgtaatcaacacctaaatagtgtacattgtactacctcactcccctcccaccccatcatcattctgagtctccagtgactattattctatactctatgtctacatacacacattattcagctcccacgtgtgaggacatgtggtatttcactatgtttctgagttttttcacttaagataatgacctcctattccatccatgttgttgtaaaagacatgttttcattcattttctgtggctgaatagtattctattatgtatacatatatacacacacatatacataaataaaatgtgctgtatgtatatatgtgtatatgtatatacatgtggtgtgtgtgtatatatgtgtatacatatgtatatgtgtatgtgtgtgtgtatatatatacatatgtatacacttatatacacacacagagcacattttctttatttaatcatcttgatttttttggaagagtttcagtaggatgagtatcagttcttctttgcacattttgtagaatttggctatgaagccatccagtcctgggcattttagggggaaggttttaaaattattgattcaatcttactattcattattggtctgtttaagatttctatttctttctggttcaatcttgggcagtcatatgtttacaagaatttgtcaatttcctctacattatctagattgtgagtgtacacttcttcatagtagtctctgatcatcttttgtattcctatggtatcatttgtaatgtcttctttttcatttctgacttttatttggatcttttcttggttagtacagccagaggcttatcaattttgttcatcttttcaaaaaaccaactttttgtttaacttatccttggtattgttatcttggttttcattttcattttatttttatttttaacaaccaatttatatcattcaaacagatagaactgccttgtgcttgtttcagccttgttttctggttattaaaagaagacctgaaccagatacaaattcaccatattttccttcaaggacacttctcataaaagctactaatatgcatattttggcatacaaaatcacatttgctaaaacttttttctgcttaaatacaattcttttttcatttagcaactgcatgttattatagaggtcaattcattgggttataagagaaaagaaacacttattgaagattcacaacatacattccattatatatcgctgttcaatagaatgcaaaattagtaaatatcacccctacaattggaccatgtaactgatagattttcctgtaaggagttaccaaaatgtcatcaaaatctagagtttgacaatttccaggccttatcctgaccttctcaatgcaagttgcacaaatgaaatcagttatccaagagaaaaactgggatagaaataggggttaatagattatgatcctaagttgaaaaatacagagctctcagtttccaagatttaccattttcaagtgtccctaattttgtcccaagagtggctccagcctgggcatgacagctggctgtaatggggacagatagctctttctttctaagaacaagatttaccatttgttttgtctgctctctccacaagctcttcctgaaacatatcagtggcataataaatatcatctcgttttccatcttaaggactttagtactcaaaggtaactgttttgagtccttaaaaaaaaaaaacaagcaaaaaaaaaagtggtttgcaaacttttgtctgtgacataacaccaaagccgtagtaaagtcaatgataataataataataggtacttacttgggctagggactgtgctaggcttcttttcattcattatctcatttaatattcacagttcctacatggcttagtatttcttgcagaccctttaaatgcttacatatagaaatctgccctactatttcaagtataggcagaagttggcaatacaagaaaagacaaagggataagaatccgtccaactggacaaaacaacttcaatccttaaaaagtcctacccattttagaaacaggtcaatgaagctacctgttatgattgtagaagtcatgtctgcttactgcacctaatttgagaattacagaaaaacatttttaaaaatcacatattattctatcactcagagataaacattgatagtgtttttatagttcccagtcttatttatatatttgccttctttttttgctatttgtttaatttttaaaccaaattcggattacatagcaatgcaattttcccatattattagatataatttttgaaagattttaaaacactaccttatgttccataatttatttaacaatttcactgtttactgacagataatttagagtacttaattattctataaatactataataccaaagtataataatgaatttttgcctgcatctctatttctttaagaaagatttctataaatgagattactagatcaaaaaacattaaaaaattctttttctagggagaatatccccatgcccaattccactacatttgccaactagctgaaaatgatggggttttttttgcatgttttaaattgttatataatggtattagattgcattcttctgaaactcattttcaaaacatctttactcaacatatatttatagttattcttgttactatatgttgtttttactcattctttttttgcttttcgaaaatcgtctcttagttgaataataatatttatgtattagctattggtgaacatgtacgttttcctgaattatcaaaaagatactattgtaagtatgttgtgcacattccccttggcatgtgggccatgggagttgcatgtcttcaactattctggatgatgccacactatattccacagtggctgtaccagtttgctctgtgaatgataatcttcattgctttacaacctctccaacacctagaattgttagatttatttttccctttaattttgacaattggatagatgtaaaaagctatactgtgctgattttagaaggcatttcctgattacttttgcagttgtacattctttcattcattaattgtccatttctgttgcttctccaatttatgtttcttcagaccccttagttatttttctattgatttttatttctgattacttgtttgtattaactctttttatatttcatattaattttctactatgaaacattctgcaaatacaggcataacctgaatgatgttgcctcgattaacattttcatggtaaaatgactcttggtttttaaaatccaaatttcatcatctatttttttttttttgccaatgttcatgtagcaaaactttagatttataataccaaactctgcaaaactttcaataaaaggaaatataggaaaatcatcaagatattttcaaaacatattcagtagaacatcagaataatatatagatattttggaaagcaagctgagtgacaacacacgaaacacccatttcagaagttgctgatgctaaaaggccatcataccatcagtgtgagccacacttggccaccaggcactagagcacatttcccagtgccttccccattttactttttttgcttattgttgaaatccccaaattgttgagaaaacactgaagacaattgtagagaagaaaacaaaacaagtgagaatagctactacgtacaaagcaaacattttataacatgttaattgtagaagtcatcaaggatataatttttttaagtacaagtgatcgaggatataatttttttaagtacaggcataccttgttttactgcactttgtttcattgcacttcacagataatgtggttttacaagttgaaggtttgtggcaactttgcatctagcaagtctattggcaccatttttccaacagcacgtgttcatttcacgtctatgtatcacaatttggtaattctcccaatatttcaaactaattcattattattatgtctgttgtggtgatctgtgatcagtgatcttagatgttcctattgtaagtgttatggagcccaatataagatggtgaactttatcagtaaatgtttgtgtgttctgactgctgcactgactagccatttttccctctcctcaggcttccctattccctgagacacaacaaattgaaattagtccaactaataagcagacaacagcttctaagtgttcaagtgaaaggaagagtcccatgtctctccctgtagatcaaaaattagaaatgattaagcttggcgaggaaggcatgtcaaaagctgagctaggatgaaagctaggcctcttgcaccaaatagccaagttgtgaatgcaaaggaaaagttcttgaaggaaattaaaagtgctactccaatgaacatacaaatgataagaaagtgaaacaggcttgttgaggatatgggaaagtttgagtggtctggatagaagatcaaactagccacaacattcccttaacccaaggcttaaaccagagaaaggccctaactatattcaattctatgaaggctaaaagaggtaaagaagctgcagaagaaaagtttgaagatagcagaggctgattcatgaggttcaaggagagaagccatctccagaacataaaaggcaaagcaggaagtgcttatatagatgctgcagcaagttatccagaagatctagctaagataactaatgaaggtggctacactaaacagcagattttttttttttttttgaaacatagtctcactctgtcactagggctggagtgcaatggtgcgatctcagctcactgcaacctctgcctcccgggttcaagcaattctcctgcctcagcctcccaagtacctgggattacaggtgcccaccactacgccctgctaattttttgtatttttagtagagacatggtttccccatgttggctaggctggtctcgaactcctgacctcattatttgcctgcctcggcctcccacaatgctgggattacaggggtaagccaccacacccggccaaaggcagattttcaagagagatgaaacagccctctgttggaagaagatgccatctaggattttcctagctagagaggagaagtcgatacctggcttcaaatcttcaaagaacaggctgattcttttgttagctgctaacgcagctggtgactttaagttgaagccaatgctcattgaccattctgaaaatgctaaggcccttaagaatgatactacaccaactcttcatgttctctgaaaagaaacaggaaagcctagatgacagtacatctgtttatagtatggtttactgaatattttaagccctctcttgagacctattgctcagaaaaaagattcctttcaaaatattactgctcactgaaaatgtacctggtcacccaagagttctgatggagatgtaaaaggaaatgaatgttgttttcatgcctgccaacacagcatccattctgcagcccatgggtgaaggagtaattttgactttcaagtctcattatttaagaaatacatttgtaagactatacatagtgatttatcagattgatctgggcaaagtaaaatgaaaaccttctggaaaggattcaccatgctggatgtcattgagaacattcatgatttatgggaggacaacaaaatattaacatgaaaaggtgtttgggagaagttgattccaactctcatggatgactttgaggggttcaagacttcagtggaggaaggagctgaagatgtggaagaaatagcgacaactagaatcagaagtaaagcttgaagatgtgactgaattactgtaattttacaataaaacttgaatgagtgaggagttgcttcttacgggtaagcaaagaaaaggatttcttgaggtaaaatctactcctgaagaagatgttatgaacatcgttgaaatgacaacaaaagctttagaatattacataaacttagttgataaagaagggttggagaggattcactcattttgaaaggagttttattgtgggtaaaatgctggcaaacagtgctgtatgcaacagagaagtcattcgtgaaagcaagaagccactgatgttgaaaactttactgttttcttactttaacaaattgccacagccacttctgccctcaacaaccaccagtctgatcagtcggcagccataaatatcaaggcaagaccctccaccagcagaaagattatgacttactgaaggctcaaatgatcaccagtatttttagcaaaaaaaatttttaaattaagataacatatttttttataatgctattgcatactagactactatagactgtaaacacaacttttatattcactgggaaacaaaaaagtttgtgtgccttgttttattgcaatattcactttattgtgatggtctggaagtgaacatgcagtatctctgagatatagatatgcctgcattttaagtctcagtgtgacattattgttctactatggttattttactgtgttttacttacacttcaagaaattcactagagggttggtttgacatataacacattttttcccatttaagtaatggcaaactgtctcaaggaaatcatttttgggtaatacatctgatcatcaggaatcaattagtaacatcaaacaaggggtgtctatatttttttctcagcatgttccttatcttttctttgtttgcttgtttgtttgttttctattttacatgtctcatttaatcctggaaaaatgctataaagtagctagctgattctatcttacagatgagggcactgagattcagagaggtcagtagctggctttattatcttcttcactgtggctgcaataaaaaataaccacaaactttgtggctctcacagctctggaagccagaagcccaaaattaagatgtttaagagcaaagatccctccagaggctctaggagggattccattccttgccactttcagcttctggtggttggtgggactcttgtaatagcatttaggtctcccaaaataatccaggatgatttcctcatctcaagatcctcaatttaatcatatctgcaaggaccattttttttgcaaacaaggtcacattcacaagctctagaaatttgatgtggatacgtttgcagagccaatattcaacttggcacactcaccgaaggccacatagcagaatacggtgtcaagtccagatataggagttccagactccagagttcatgttctttccactccatgtgcggttttccatcacattgtgtgacctgtcgtctccatccctcctcacacctcagattcccttagtcttcccaacctcagagtgaggttaatactctgttctctccgtgccagggtctcttccaaggagagtattcaagagctgtgccacccctttacaaattccattgcgcatccgtgacttcctttccaatacccagacagtttcctgagtctagttcacagactagatcaccaaagcaaccttcctgggagtaaatattacatctttcccattcatattagtttctcaaaagtgctcaagagcctgaagaatgacagaagagaaatgctaaagattgaaggagttcagaacacaatactccaaaatatgttgctctagtatattgactattttgagcttaaagacacttggaaaaacagcagatacaaaaaatatactctgagctttcttcttttccttagaaacaggagataacttgtcctccctacgccagagggaaagtagcgttcttatcatcaaagacgagaagttgatgctgagagaaatctgaacaaacacaccttattaaagtaacccttatcttcctagttacttctctacccaattaacctccctagcccaagcccgttggctttgtcacatactcacaattttctattcctttcccaattcagtacataggtgttcaactttcaactctgtctttgggtttcatttccttaagagggctcttgtgctcacataaaaattgaatgaattaaatttgtatgcttttctcccgctgatctgccttatgtcaattcaatcctcaggcccagctaaaaaaccctaagagagaaaatttggcctcccctacaatgtcatcctctttcttttttctggaccttctatctgctggtacttaagatactaaaatggacgggagaaagaaagcaaaccatgttatgtcttctgcattggcctggtacactccgtttgaaggttactcgaagccagcttgctttttgtcaagagattgcttgatctggagccatatagaaaatggtgacatctccaccccgtgacatatgggccagtaagggcttgcaaagttccattctgcacacttctcttcattctaagaacgagtattcattccatttaaacacatattaccaggaattcaatccaacctctctttttacagtctacctagaattactattatactatttacatacaatatggaaacctcacacatgtatgaatctatttacaaactccctctaaattcaagttgtcattgaaattacatctacctgtattataaatcccataaaaatgatgctatagtttttacttaaacaaacatacatattcttaaaacattaggaggaaaaaattgatttttatatttatcttactatttatgatttctttatttttacataaggatctgagttttcatctattttttcttgtcatcccaaagaacaaagcattttttacagtgtaagttggtctgctggcaataaatattctgtttttgtttttctgaatgcaactttattttgactccgttcctgaagtatgagtatctttggatatggacttcgggattggatagtcatatctccttacagcacattgaagatattgtttcattgtcttcttgctttcatagtttttgaaggtaggttggcagtatttagcagtgcagtttcatgtatatagtgtgttgtttttctccggctattttcaagatagtgtcttgggttttcagcagtttgattacaatgtgcctcagcatcttgaacgtgtacatttatctctcaccaattttgggaagtgtgtggggccactgtttcttcaaatattaggttggcacaaaagtaattgtgggttttgtaatgaaaagtaattgcaaaaccacgattacttttgcaccaacctaatatttttatgacccattctctatcacctttccttctggggaaccaattactcatatgttaaaagaattatcccataggaacctgaggctctggttgctttttttttaatcctttttaaaaatacaatctctgttcttcatagagaaaatctatattgatattatcaaattcactgactgctttggtctgcctgtgtatgtatattccaaaggtcagccagagatttgagcagaatttacaccaaaaatttgtaatgctccttttctggccctctttttaatgacattcctcccttactttccagtagctggggttgctccaaactctgtcccctggttcataaggccagaaagactgagcttcctacaggagtttcagccactctgtgtggccctacctgtggcttgacctcaggataatagtcataagaaatttaacctatactacttccaggtgtcttcaacccccttcgagaatcttgctgcctttgttcattcttcagatccctcagagagttttgttgttgctgctgtttgtgttttgtgagggtttacagactacatgggaagcagaaattgttctttgggatttaacttttacaaaaatcacaagcactcatctcatttgtggcagtgaaagtaatatttacaatgttaacgttaaataacataccttgctacaggtttccagtaaatatcttgtattatgctgcgtaagctcctcctatttctagctcattaaataaatattatttgcttgttggtcttatttaacagaaaaaaaaggagtctctatttattaattcattagttttattttccacagattgattttgttactctcctttaataatgaaagttctcagggctattaattttctgctaaatacagctttagccatttaaaatattgatacatagagttcttactctcctaacagtttattatatagtttcctttcctgtttgaatctggagtttttagaaaaaaatttggtttttgttatcattatttctcttttccaagctactgatttttgcatttaaacttttgctattaatgtctagctctatttcagtgtaggcagaacatggaggctgttaacactttatatttcataatttaatatggtttctttgagatataatatatgatcaatttttttctaaatgcttcatggctccttaaaaaagtgtattgcttatttctagagaacaaaatttaataaatatttattaaatcatctttgttagattattaaaatattctatcaattctgtgtttatttgacccatgaaagatcaataaaagtgtattaaagtgtcatacaacaattctacttccatcaatttttccttatatttctaacagcctttgtttcatgtattttgaggctgttaccaagtcaataaaaattcagaactgccttatcttcattgtgaagtctatcttaaagaaaatataaccttcttgattgcatttaatatttttatagcctttgattctatttcatctaaatattgccaagattacttttttttttaatttcgcttctgcctaataaatcttgtccattctattgttctttcttttttaatctaatgagttactttgttttaggtatatttcttctcagtaccctacagttagattttgctttttagctgaaatatacagttgttgtattttaatagactagtttaataaacatttcacaatgagattcagctttacacaatgctttcacatttatatttcctcttttcaacatatcaggtacaggggaaatgtcattcctatgttatgcataaggaaattcaaagccagataggttagatgcatttcccaaggtcattcaggtaatatatggcagtggcaagacttaaccaaaggatgataatactaagaaaatggctttttacaaacatatactatccccttgctgaacatcaatattcagatagactatttggtcaaattatgttttgtgtttttttttttgtttttttttttagacagagtttcgctcttactgccccagctggaatgcaatggtgcaatctcagctcactgcacccttcacctcctgggttcaagtgattctcccgcctcagcctcttgagtagctgggattacaggcactcaccacaaggccaggctaatttttgtatttttagtagagttggggtttctccatattggccaggctggtctcaaactcctggccccaggtgatccacccacctcagcctcccaaagtgctgggattacaggtgtaagcccctgtgtccggccatggtcaaattatctaatttttcttccactgggggactttatactatttatttttattgccgtaaatgatatgtttgtaacactgtaatcttatttcatgctttgtgtagtttatgctttactcttttttctttgttttatatactattggccctccttgtctgtgggttccacatctgtggattcaaccaatcatggattgaaaatgctcagtgatatggtgtggctctgtgtccccacccaaatctcatcttgtagctcccataattcccttgtgttgtaggagggacttggtggaagacaattgaatcatggggggtgggtctttctcatgctgttctcctgatagtgaataagtctcacaagatctgatggttttaaaaacaggagtttccctgcacaagctctctctttttgcctgctgccatccacataagatgtgacttgctcctccttgcctttcaccttctgccatgattgtgaggcctccccagccacgtggaactgcaagtcaaataaacgtctttgtttgtgaattgcccagtctcaggtatgtctttatcagcagcagtaaaaaggactaatacactcaggaaaaaaaaatggcatctatactgaatatgtacagacattttattgtcattattccctaaacaatacaactatttatatagcatttacactgcattaggtattataagtagtctagagataatttaaagtagtctgtaggttacatgcaaatattatgccattttattccagggacttgagcatccacaaattttggtatctggaagcaatccttcacagataccaagggacgacagtacttggtgatttagatcaggctgcacattcttttctctctccattggtttggaagtcatgcatcctacttttgtttctaatagtggcacctggtatatcaaaaagaatattaatatttgttgaacgaatacattttaaaactttcaaatatttagaatatttgagtctacccctagaaaaatgagaatttgtcacaaatttatttctggaccttgtaaatatgatcctgggtttcttattgcttagtgttaaatattaaggtattaaatatttaatgcttattaaagcattattttgtgtgacatattttctctttcaaaagcatagttttacatttgcattcagtattataattaaagttacaatcacttaaatctcactttttgttaacttggtttaattattaacaaccagccacttctctgttactgaattcttttgttgttgttgtggttgttatttagtttttatttcataatcataaacttaactctgcaatccagctaggcatggaagggaacaaggaaaacatggaacccaaagggaactgcagtgaaagcacaaagattctaggatactgcgagcaaatggggtggaggggtgctcccctgagcaacagaagaaatggtctggtggttaagataaaacacaagtcaaacttattagagctgtccacagtcagcaatagtgaccttcttgctagtcttgccattcctgaacacaaagcgctccatggcctccacaatatccatgccttctttcaccctgccaaagaccacttgcttgccatccaaccacttggtcttggcagggcacatgaaaaactgggaaccatttgcgttgggtccagcatttgccatggacaggatgccaggacctgtatgcttcaggatgaagttctcgtcatcaaatttctccctgtagatggacttgctaccagtgccattatggcatgtgaagtcaccaccctgacatacaaaccctggaataattctgtgaaagcagtaaccctcataatcaaatcctttttctccagtgctcagagcatgaaaattttctgctgtctttggaagcttgtctgcaaacagctcgaaggagacgcagcccaagggctcgctattgacagcaatgtcgaagaaaacagtggggttgaccatagctggtaatacggggctcccagtggcagcaccatctgtgaagtctctgttactgaattcttaacttcaatttctctctcagttacctgggcagtgcttcctaaatgttagtatgtttaagaatctcctagagagactgttaatgcacagattgctacagttcatccagagtcctaactgttctaagcagtaggttttatagcaatattttgtaccatatagtgtggccaaaaaaaaaatatctgattttttgctcctttataaggctaactgttttgtttgcctgtgtgtgtgaaggattttttttactttattctttaaaaaattaccaagttgaaatgatataaaacccttttcattaatgttgcctggagtacggaaagtcccttcaatttttgttttttggtatcgggttttgtttttgtttgttcgttgtgctccgaagagcttttattaatctttcactactatttgtgttctaattgcttctgcctcaagaacatctgtgattcttactttggttctgggtgttcaaatctatgatctctattttctatatttttaatcatctcttttgttattttaatttttattgcacctgttcatttcaacagaaattatcaatttttttcccctcttgattttttctttttcttctttttttttttcttgagacagggtctctgtcatccaggctggagggcaatggcacagccacagctcactgtagcctccacctccccaggctcaggtgatctacccacctcagcctcctaagtagctgggactgcaggtgtgtgccaccacacctggctaatttttgccttttttgaagtgacaggtttacatgttgcccaggctggtctcaaactcctgggcttgagcaatctgcctgcattgtctcccaaagtgctgagattacaggcttgaggtaccacacctggccatgagtgttttttaaatagtgatttcttttcagcttccaacacagacttcaattgtgttatgacattctggtctctttacaatattttcttgactaatccatctccttttccaaataatcctactttttacaatctaaacttattctctcatttcactttctgtttcctgatgctgttgaggatgacaaaaaatcccttcagatttctgtgacatatcatcttgggaggtcaacatttactctgagtctctgagatactgttcccttttccttgtccataatgatttctttttactttagtttatcatgaaagagaccgtgtttgccaagaaaaagatgaagattgtctttatgtgtcacttaaacataaatctcttacagctaaatgacatgttggtttacaaaacttatatcctaatttccatcctctagcaggttttccacctagcatacctgttgggattggcatagactcatcttgtatcactacctgcatctgtattatgaaaaacaacaatccccaaggccctcgtagtttcagcatagatatagtgctttaactgtgacagatcctgacaaacatatttccaaaaatattactgccctatttagtaagcaggataatggtcttccaaaggtgtctacatcctagtccctaaaatctgtgaatgtgttagattacatggcaaaggaaaattaaggtagcagatagaattaagtttgctaatcgtctgaccttaaaacagggagattatcctccagtaccagggtgggaccaatgtaatcacaagggtcattaaatctcaaaaacagaagtagaatagtcagagcaatgcaataggaaaaagagttgactggccattgctgatattgaagatgaaagggggccacaagctaaggaatgcaggcagcttctggaaggtaggaaggacaaggaaacacattttcccttagagacctcagaaaggaattcagcctaacatcttagcccactaatatccatctatttcaaacttctgacctcccaaactgtaaaataataaatctatgtcattttgaacctcaaagtttgtgttaatttattacagcagccacagaaaactaatatatgaccatttatttgagtaaccactatttgcattcttcacatgcatatgcaaaagatgtcttcattaaaagtgatgcttcacaaaagtacttacatgcatagtaattcttgttcacttttctgattagcgtttgcatgtttctgaagcaggggaaagatagcagccaaatgattaaaggtcttccctctgtttggccacagcataagggaatcacctgttgaaattgttcattctagttccaccaaacatctcattagtagaattctctacaagaatcaagactagcttgactataaaaacaaatttttagtggcagcgacttctttttggcatatatcttcttgagtatttttatagaaagttgaaccaggtataatagaggctactactccaatatgaatttaatttcattcattcttcaatcccttcttggataaggtgctgatccacctaagtcactccctcataagtgaatgcaaacttaagaaattataccttcataaaatgggcatatttttctaactgtaaaaatgttttctttaaataggcatgactatggcctgtctattttaatttcgtatagcagtaatttcccttggggaaggagtaaaagacaatattttttaaagtttctctctatctagataggatgctagtagaagcaagatttctatatgttctgatgtgaccaagtagatatttctctactcaccagcctctgaaaatccctgtgtttacccaagatttaactaaagaggctaaactcgtgggtaaatattaagagggaattgacaaaggcatattaagtctaaggagtagactatacttttctaaaataaacacataattacagagttaacacagcagcaccttctgccttgtcagtgctgaaggccccatggcagccagtactcttcacttgacctcgtcctgcaaactttctgtacagcagataaaggcccaaagtacactatagtttagtgaatagcataaactcattcatctgtaagtactagatattacaacatcaggcttctcactggtcctactataaaaataattttatgcttgcacattggacacaattgttctggtggcatagctctttagctacaccagcactgaatagaaagaggcatcctctactattagtctgcaacagaacccagcatttccaccattgcaaacatcaaactggatgaagactttttattcccagcaggattaagtcaaaacatagattgacctaggagaagaagcattagcccttgtcaaataagtataattacttgatgacattggttagtaaagctgcaaagaatactgaggaaattaaaccagctaatttgggaaagaccagaaaggcaatatgaacaccataaaaacatgggtaaggaacagtaagatgctgacctttactgttttctctgggcatgatcctgcctggcagagctatgtttaggctcctcagaaaacccgatgctctctttgcattactagccaatgtgaagcaacattaaataaaaaaaaaaagaaaggaaagaaagaaagaaaacaatcagagaaatgcaaattaaaaccacaatgagatatcacctcacaccagttagaatggcgatcattaaaaagtcaggaaacaataggtgctggagaggatgtggagaaataggaacacttttacattgttggtgggactgtaaactacttcaaccattgtggaagtcagtgtggcgattcctcaaggatctagaactagaaataccatttaacccagccatcccattactgggtatatacccaaaggattataaatattgctgctataaagacacatgcacacatatgtttattgcggcactattcacaatagcaaagacctggaaccaacccaaatgtccatcaatgatagactggattaagaaaatatggcacatatacacaatggaatactatgcagccataaaaaaggatgacttcatgtcctttgtagggacatggatgaagctggaaaccatcattctcagcaaactatggcaaggacaaaaaaccaaacaccacatgttctcactcacaggtgggaactgaacaatgaaaacacttggacacaagaaggggaacatcacacaccggggcctgttgtggggtgtgggggtgggagggatagcattaggagatatacctaatgtaaatgacgggttaatgggtgcagcacaccaacatggcacatgtatacatatgtaacaaacctgcacgttgtgcacatgtaccctagaacttaaagtataataataataaaaaaaagaaaaccattaaaacactttagaaatatataaaggtaggccgggtgctgtggctcactcttgtaatcccagcactatgggaagccaagacaggtgaatcacctaaggtcaggcgttggagaccagcctggccaaaatggcaaaagcccatctctactaaaaatacaaaaatttagccaggtgtggtggcgggtacctgtaatctcagctacttgggaggctgaagcaggagaatcacttaaacccaggaggcaaaggttgcagtgagccgagattgtgccactgcactccagcctgggcgacagagtgagactctgtctcagaaacaacaacaaaaaagaaatatataaatgttttcatttgtatgagaacttatgaaatagtgattaagagaatgggctccaaagtcaaactgtgagggttcagatgctggtcttccccttgtagaaatgttatgtaaattatttatgcttcatttcctacatctgtaaactgggggataatactgttacctcactggctgctttgggaggatcagctgtgataattcatgtaaagcttgtagcagagtgcctaatccctaacaagagttcaacataattgctgctgctgctagggagaggctgcaaagcattctgggtaagaacagggacgctgggacaagattgtagaggctctgccattgacaagctgtaatcttgagcaacgtatttaacttctttgtacctcacttccctcacctacaaaatggaagtaataataaccattatgagggttgttgtgagaattaaagagttaatatttgttaggtgtttagactagtatctgatacatgtctgacaaactattcagctgtacatgaatggttttaaagctgtgattatggaaaaccaagggctttgtacggaggaatggagataaggagagtgtgcagcccagtcccactctgtatgcaaacaaagtaattctagctcttttacatatttaactttcaagcaagattttctttgagtaaagggtaatgctgctttaaaagaagaaaggaaggaaggaaggaaagaaggaaggaaggaaggaaaccatggctctatatgtatgagcctcatataaaatatatcagtacaggtcttacaaaacactgaatgtttttatacacattccctagcagatttaaccagatcagttttaaggttccttctagaaaggaagttctccatacgttgaaaagtgaatttcagtacattcaaattttaaagacacgacttcccatacttcttcagggtaaacaaaaatctcaataattctaatttaacatgcaaaagccatgaatattcactacagtcaaatgaataataaatcacccctgggttcaagtgcttgccatgcaaaattgcctatttcctagaacatccagaaatctgtttttaaattgctttttattacttttgctcttgtgatggttgctcttcaaagcaacttggaaaaatgtgccattctcagcattaaggcgataaaggagaagtgaggacagcagaacacggtgccatccacaaaaggaaagagagtctgtggatcagagggctgggctccggaagacagtttttaaatgtcactagataaaatttatgagataaaagggaatgttccttagtcatcctgagcattgatatctacatgaataataaatcaaaaggctctttatccatttactggtaaacattacgaccttaggttgaagatgtgatttactccactgatatcaacacaacagaaatccagtgaaagtatcactggactggccccaagttctggaaaatcaatgatgcgtgggagaacaaacattttgaggggaagagtatttttttaaaagtaaatatttgtggcactagcaacatgagtgcactcattaagatttcttttaaaggattaccctttagtctctcctacatggaaaactcaagtatactcaagttgtcaattgtataatttgatggaaagttatccctagtattttcccccaaattggattgaattattaatatttcacctttacaaatacatgcagtataattcaatttatataaaatttaaaatatacagaacttacagtgattgcaagtacctaagctggtaataaaggtatcaattaatgaaggaaaatggatatgtcaaaggacaggatagtgactacctctaatatgatcagagagagggttcagatcagggaattttcagaggactgctggggatgctagaaatacaatgtattgacttgggtgaaccttgagataggtgtttatttatagttattcattaaactgttcatacatgtcatatgcacttttcctgtacaaattatatttcacaattttatttaaatagtatgtttcattctgagatgactctccaatctattacatgagacacacttatactcaaaaaggtgttcattctttttctctgaaattcagatttaactgggcatcctgaattttatctggcaattgtaaaccaatcagaatagcatggttagattacaaataatatatatattttaaaagacaggaaaataaaccacagataaaatgcattcttaaaagtcttagtcatttcatttcatattctattaatatgatacatttgtgtttcatggtttctgaccccttgtgtccagcggactataaacataagtatgctacctagacccaaactaatttacttaaaggaaggcaaagaagctgaccattataaatacagcatgccttagaaaggagagtttcaagtcaaaaacaaatctggaaaaaaaattaatttgcttcttttttgtaaagcaatgatgtgtcgtttttatgtgcatttgtttacacagtaaaagaaaagacaatcaaataggtaaaatggatgctgtattgctcccttatacacacaaggaattacacatctgtctaacaatgctaaccactctgagcgataattatggatcaatgctttaaaaaatatcctgaattgcctgcagaaatggcaaggagaatacaattaaattatttgtaaaagccagagtctttttttcctatccatctgctacttgaaatgggatgacctttcaaatagtgcttgctgttctcaatgcaaactctaaataaagaagtggagtgtggctttttttttcctttccaggttcagcatagatacagcatttgtactgacattctacaccactccataagaatgcagatttggcttctagaacataaaagaggcgtttcaggaatataaatcaggcttttgtcccataccttcagtcatgacatttggcttctatcagaaaggtgtgcggcttctgagataagtgtttgagaacaagctacatgaagtaatttactccctggagaaaaattgcaaacctcacccccaaacaaaccgcataaagtaaatgtgttagtgaagaaccttttgttaaactacctatggctggggagctaaatagaaaaggtcagatatttaagctaacaatgggctcaaaacaaaccttccaacaggtctctcaataggcctacattatcaactaacaacttgcactattaagactattaatagtaataagccatgctttcttcactgagtctatatatattttacattgttttattgctcccctaccctttttaatttttaaagcatttccagtttggtcctttgtgtgcttttttaaaaattaggattttggacaaactttcatgtatttttcttaataaaagtgtatcaagcacatttcaaaaagttcaaaaaatacagaaatataaaaaataatctattagcacatcacccagagaaactgacttttaacagtctggtgtttatactcccattcatcttaatacataagcgtatcacaaaattagatgatattatataacaatcaaaactaatcaactgttttatgaacatctttctatgccataagtaacaatctgtatcattatacaaaaattttcattacaccttttaaatgttttatgggtatctctgtgtgtgtatagttgtaaaatataacttttaagtgaatttatttaaatacccaactacttatgagtacatagatttacagctttttccactactgtaaacaaaattgaaatgagcatccatacacacatctttgcagttatttccttagtattactttccagaaatagtatagctggaccagaaagtataaacattattagagccttttggttaatattgtcaatctgccttccagaaagtttactaagcaaggtaggtagatttccctctactgtataatactgagaaatatcaattttttggatacttgtcagtgtgagcaaaaatgtcattattgctctaattattattgctttgataactaatggggctgagagttttactggtgttttataactcttcctttgtgaatcattattcagatacgtttcaaatggtaatttgtaaagtattttgaattttggcccatttttctataagataaaagcattatcgttagtgggtgcagcgcaccagcatggcacatgtatacatatgtaactaacctgcacaatgtgcacatgtaccctaaaacttagagtataataaaaaaaaattaaaaaaaaaagcattatcttaaagtacaacaccattaggatttaagataaatacacacacacacacacacacatacacacatacacacacacaatgagaaaaatcattttaattttaaaaacaatactcagcataacaaattaaacaaaaatgcacacatacgccaggtacagtggttcacacctgtaatcccaacactttgggaggccgaggcaggtggatcatctgaggtcatggagttcaagaccagcctggccaacctggtgaaaaaatacaaaaaaagtagccaggtgtggggtgcatgcctgtaatcccagcttctcaggaggctgaagcaggagaatcgcttgaacccgggaggcagaggttgccatgagccaagatcacgccactgcactccagcctgggcagcagagcgagagtctgtctcaaaaaaaaaaaaaaaatacacaggtatgtatgtatgtggtatataaaataagtcaatacgctatcccagcactatttccaattccattttcccatggcaactaaaaaaaacaaaacaaaaaatagaaacaattacttgtttatccttctacatctttttctagtttcataccagtacatacaaacaggttttgatatagtcattctttgctttctaattccaacggtctcatatcgttccaattagtcaaatgattagatgctgccatatcatggacatgctggacatcacatatagatgtatttagttattattattagttccataatatttcacagtatggttatagtataaatatattcaacaatctcactattcatgtgctgtttttatgttaatgttatttgtcttgatttttttttgccactactaaaaatgcagccatctttaaatatacattttcacatcagagattactgactcccaaaattaaggttgcagagtcaaagagcaagtgtaccattaattttgataaatatatccagatttagcaatatatgaaactcttccatttctaagcacctttaacaagcatggatattatcaatattttccaattttgtcaactacttgactggaaaagtatttatttcattgtgattttaatttgtatttccacaactactagtaaagttgagcagagttgcatgtctcttggtcacttaaattttccctctgtgaattgccaattaatatccctagccatttttctcaaatatggtatataactgtatgtcatcagtgtctaagaattcctatttttctaaaatttatattgtttaatgtacattcatatatttaattcatctgaatttttagatttttattgtaaaaaatagtggtctaacatttacaacttactgatgaaaagccaattttcatagcatcttttattagataaacatacatttcccaactgaactgaaaagacccttttttttttttttttttaagacaggatctccctttgttgtccaggctggagtgcaggggagtgacctcggctcactgcagcctcgacttccctggctctggtgatcctccaacctcagcctccaaagtagctgggactacaggcatgtgccactgtaattgcccagtgggttctccttgcctactgcctagacagagccaatttctcaagacgagggaactgcaatagagaaagagtttaattcacgcagagcaggctgtatgggagacgggagttttattattactcaaatcagtctcccccccaaactcagggatccaaacttttaagaataatgtggtggatagggggtcggaaaggggggagtgctgattggttgggtgggatatgaaatcacagggagtcgaagctgtcctcttttgctgagtcagttcctgggtgggggccacaagaccagatgagtcagtttatccatctaggtggtgccagctgatctatggagtgtagggtctacaaaatagctcaagtactgatcttaggttttccaatagtgatgtttccctgtggagcgatttgggaggtttagaatctcgcagcctccagctgcatgactcctaaaccataatttctaatcttgtagctagtgtgttagtcctataaaggcagtctagtccccagacaggaagggggtttgttttgggaaagggctgttatcatcttttttcaaagttaaactataaactgagttcctcccaaaagttagttcagcctacacccaggaatgaacaaggaaagcttggaggttagaagcaagatggaatcagtaaggtcagatctctttcactgtcataattttctcagttataatttttgccaaggtggtttcgccaccatgccttgctaattttttgtatattttatacagacagggtttcgccatgttgcccaggctggtctctaactcctggggctcaagcactctgcccatcttggcctcccaaaatgctgggattataggcgtgagccactgcatccagctgaaaagacacttttactgaatattaacttcatatatttggatctgtttctcttttttctgtttcatttataaaatgttctcgtggctaacaacataccattttaataacagtaactttatattacattttaatgtttagaagaaaaagtaaaaatgaaacctgttgccattctgataaattatattaacatatctattttataggaatgaatgacattttataataataaaaactattagggaatatgagtatgactcttttgacaggcagttttatctccataacatttttcttttttctatataggccttttttgttaaattgttactaaggattttatattttttgtttccaaagtaatttttttctatttctagataactagttattgaaagtataaagaaaaaatttgatttttatatatttattttgtgatcatccagctaacatgttttcttagtaactgtgtaacagtcataaattctctatgaatataatcatatcacatgacagtgaagagagtatcattttcttcgcttaatttttttgtttgattacaacaagcagaacccataacacagtgctaagtaacagtgctaatagcaaatattcctgtgtattcttcctgatttaatatgagtgacttttatattttactgtttaatgtaatgtttgattataggtctttataaatattccttattgtgtttaacttccttccatgcccattttatttagagtattgctagaaatttctaatacattttatcacatttcttatcagtatgcatactgagttgaatacagtcctccataatttatagtcatgtggaatctcaagtgactttattttgaaactgggtctttgcagatgtaatttgttagattacagtaattagaggtcataagggattagagcggcccctacccaatgactgttgccctcataagaagcaaaaccagagatatagtcagacacgcagagagaataccatgtgataaaggagacagagactggagtaatgtgtctgcatgccaagaaatgccaaggactgttggcagctactaaaaggtaggaaaaggcaagggagggccaccccttagagccttcaaaggcaggatgtccctgctggtaccttgattttgaacctctagctttcaaaactgacagacaataaatgtctgttattttaagccactcattaccaaattaccaaacggtaatttgttatggtggttttaggaaattaacaaagcatatgttgtataatcaaatcatttaatcttttaattaatggtataaagttccaattcagaaccagtttgtaatttttgaaatgaagcctattttaaacattttatcatgttttcataagcagatagatacaagttgctattttttaattatatacttccacatatgaaaatgaaattagcataaaatatctcattagtgttatttatctcaagttttgatataacattttgctagatttgtacagttgagccccattctattttctctatagtcttgaattgtttaagaaccatagggaatatctgttttttaaagctttcgtatgttacaagtatcttttaatcttttaaagtacctgtttttaaatatctagtttacatgtaaaactatctgggcctggtgccttttttctagtggtacatgtttaataattttccactttcttctatgattattggtattaaatgtttttattttgcctatgggaataatataatactgaatgtatatatacttttctaaagaatcatcattttcctagatttgaaagtgaatggctataaaatttttttttaaaaaaaatctagccgtaccagtattgattggcagagttgaccaagggaagctaagagggtacataccatcttcctcccacacgactacatatgcattaaatcagaagacgacagtcttccaagaataaaatgaatcatcaagggaataagagcagttctcatccctagttagaatctctaaacaaaccaaagcaaatgtttttatttgaatcatcaggactgtgtcacaatgaaacctagatggtttgtcttcaagtcatttactactcccctaaagtcttatcaaaagtatgctaaaaaagtttatgacatttccactgagctacaataaagcttctatttttttagatacttgacaaaattttaaaaagaattatttttcccccacacctgcacacattttaaaatatcttcaacttttctacaaaacaattttctctacagctctcccagacttcacaaacatattcttttattcatagcagatggaggaaattagagtaacatatttgctctaaaatcattagtgctgcatcagcacttctgatctaaatgacatttcaaggggttattgttacatagagcaagactttgctccaggcagaaagagacagaaaaacaacttgaaaaatgaacctttttttgcaattagcttctgcatcttaatttgttgaatgccattctatttggattttaaatacaaatcaaaggaagaataaagtgatccaattctgtcagggtcataccttccttactggtcagtcgtctgattaatcattatagctgcttcctaaaaaataatgttgttaaaacttaccatcaactacttgattctctggaaaactaacatattcttacttctcagagatatcttgagaggctgataagtctgctctttagcctcaagaaatgcctaaaattaaactatttaactggtgagcttcacatgactgccactctgtccaagagataaataaacatccctggctgaagaatgaaccaacccataggtgtttctttagcacatactctgttaagtccactgtggaattaaaaaaaaaaaaaaaagtttaaggtactacacacctggaaaatgcaatcttgtaaacataggagaaaccacagagaatgatacaagatagcaacaatcatactttatatttttacactgcattacaattttcaaactactttcatgacacttttcttattttatcctcacagtaaatccataatggaagcaggataaaagaggaaggagacataaacatagaacttcagagatgaaagcaacattaaaggcatcaataaccttctttacagataagaaaatggagaccaaagggaaataagaaccttcaccttgtttcagagtcaggcaagcaaagctaatgaagtgaaggcttgtcaccccaagttgcaaaaagaagtcacaaaaataagacaagaaagagaaagatgatagaaatacaggacactaatttggatttaatgtacttttttaaaaaatagaaaaggaaaagcaattctattgaattcgggtttgaaattcaacgttggtctctagggatcacttggctatggtggttttatgccattaccagatccctttgagaaaaatactattttgaaattcatggtttccagtaaatatgttcaaggctttgaagaacatactcctgtaggtgtaaatggtgtatacacatatacacaaaagcttgaaaacactacttaattactgaacggagtctaaacattctacagctcagttaagaagctacacatgcgtctcacacccaccatctctccagctgtcctccacacaccatcccagcaagtcctagctgaccctcttaatactgtgacctctctgttgtataataaaggttgaaaatcatccttcctttgaataagaatatattataactatattattttttgttacagccttctcaaaaatgtatttcaagccacacataggccattgtcatggcatcttttatttaacagacaatagctattttccatgactcagtccagaatattctttaacatctacatctaggatattatcataattataataagagacggcactacatggatgaagctggaagccatcattctcaggaaactaacacaggaacagaaaaccagacagcgtatgttctcactcataagtgggaattgaacaatgagaacacatggacacagggaggggaacatcacacatcggggcctgttgggggtttggggggcaaggggagggatagcattaggactaatgcatgcggggcttaaaacctagatgacaggttgatgggtgcagcaaaccaccatggcacatgtatacctatgtaacaaacctgcacgttctgcacatgtaacccagaactttaagtaaaaaagaaaagaaaggtgcaaaagtgaaaacattaaaagtggaatcatgattttaaaaaataaattcacagtggtgttgaaagatcatatcagggttagaggacaagtctttgggttagaatgaacacttaatttattatcagagtgaacaataattacctcgacattttaaaacagcattttgtcaccttttaaacgtttgggaacagagaaggcgaaacaccatgtctgacacactatggaaagttttataattctcctcaaaaaggaagaaaaaatatttctatttccattccagatctgcacaatatattcttgcatcccatttggtctgattcatttacattttgctgaattctgtttttgtccattttcatcattcaaaagattttaaaaattcaacaacatcaaaaagccatcaaaagatgctttcagatgaaattgcaaagaaaataagcacatgaattagtgaagcaacttccaagttatacaattgtggcacttacatcttttctcatcttgtccgagaattaattgtactgctgaaattagacatccagcctgctccatgcagacaggagcccaagccggaagaaaactctttgaataacaacactgccttctgattcttttcacatggctacatttttgacatttacttcaatattctacccagttgcagtgtgactatgacaaaatatttctgtaggcatgactggcacctctgcggtaagtggcagggaatggaataggaaacgagtccctttagtagctccaaaaagcccacaggcactctgcaaaccttttgcatacatgctgttaagtaaaggatgtgaaaaatggaaaccgtgatgacaattttaatcaccttacagatgattctatgatctactataactttataatggcaaagccactgacacaggagactgacaggcatatattctctctctgcctctaagtctattaaatgtttatttggggggtttacacatggatagagatgaacttaacagagtatttattgaatctatccacggataaattataaatgactacaactttaactaggtggaattttcatggttatttttaatttctaggcccaaatcacttccctaggctctagaactgtcttccaggagatgtcagatgtcagtaatcagagggaacccatctacagtcaatgcagccaaaagttctgcctacaaggtagcaattagagtccagcagtctcttctggaagtgccaattactgttctgtcttcccttttgaatgcctccttaatataagaataacatatcatttttatcctatcagattagaaaatattgtttaaaataacactcacagttggcaagaatgcagagagagaagcactcccaaacagatgctggtgaggatgtaaattggaatgtcctttctggaaaacagtccagcaaaatttatcatgatgtttttatcttcctgacattagtttgggtatactgttgcatatttttaaatagtcttcaaaagctagagttttaaaactctgtgtggcattttgttacgtgaatacgctatagttttcaattatttccacatttgtcagcattttagttgatttcaacttggggtattataaataatgctccagtgaacatcttcataaatacacatttaactcacattctgtttatttcttagtatagattcaaagtgaaaatacagtggttggcaaggcttatattcaagtataattttatcctagtaattatggaattagtatcagcaaacggattcctaagctagaattcaccatcatttactaggagaaagatctgtggtggtaaaacagactctgcttatttacacagccttactaatgggcaatttgccagaggaatccaaaccagagagcatgtatgattgactaaccattacatggaaagaagaaatcagctcctaccaaaagcacattcatttcaagtaatgccagcaacctgctgagtcagttgtattcagcccctatagaaacccttcccaagttcattgatatgtgacacccatgacatatttttaccatcattggttttcatgaatttgcctgtctttgagacctgaaaaacaatctgatttattgaactgaaaaaggcgaatgtagtgaaaccctatcctgtaattggcaaaccttttacctccctggtggcttgagtagagaagttactggctggaggctgttctaaaggaaaacatgaatggccctaaaattaaaattccagactttaggagccaattaatgaggacataccacttttaatccatcactttgcaatatatttaaaatgttaagactcattgttggcaagggaacagtattccccaaagcttattccatgggaaaatgtttttgtggacaaaagagtttgggaaagagtgatattggaatgaagttcaagctgaacttttaatgtgctattaccaactgtgaatctccatggggggctgtagctagtaacatttgtaaacttcttcaaccacaaattattcctgctttatattgcctttgtttctggcaactgggtttctatagcgcattgcaaggcagagcattctatggaacgtactttagagaatgtttctctaggtcagcagttctcaaacattttggtctcaggatccatttccactcctaaaaactgtggaaggccccaaagagtttgtggttatgttggttatatctatggatatttaccatgttagaaattaaaacagaaaactttcaaaacactatgaatttattttaaaatgacagtaataaccaattacatgtaaatatacatattttcccgaaaaaagagctagtgagaagagtggcattgtctcaacatcacattaatatttagcctaatagaagacaggtggattctcctatctgtttctgcattgtgttgtgatatattattagggttgaagtgtgccaagaaaatctagaaggaatattttaatagccttttcaaataactggattttttctctaatactgcatcaaaacttaacaaatggtagtttctttaaaagttacttgcagagtagaacccgaaaccacatcaagaaatttttagtgctctgttatgtgaaaaatccatggtctgtgtagcattttgaatggatcctttccccatgtgaaattttgtaacagtgcacattgctctggacaaaaatagtggttcattggattatgcagatcttccaaatgttgacacctttcattgcatgatataaaaaagaattatatttgcaatatcatcattgaccttttattagaaaaagtctttaagtattgggaagctgtcaagctcatggtggcatatccaagtttcccaaaatttgaatttttgcttagaagcttgaattttatcactatcaacaaatactggccaacggtttacttaaagcaacagactcactttgtgcattttaaagaaaatatgttaaatacttgagtttgcataattatagtttgtctttcaatgcttctttcatgcagaaaaatagtgttccatataaaaggtagctggttcatttcactacccagtctcacaagtgcttttccttgagacaaccatgatatgtcagtacacagcagcagttctttctgcatacttcccatttcagcacacagaatgctaaaaaaaaaaaaaaaaaaaaactcaacaatcaaaatgcaattaaattaataatttttacttttcaacaaggatattcttagaaaaagttgactttttattttttttaaccatagtgcatggcagtgaaaaatgaaaggccaaaagtacagttcagtgccactgtcttgattcatgctatggtgccagtagttttaaaaaacattacatttggaggagccaagatgtccgaagaggaacagctccggtctacagctcccagagtgagcgacacagaagatgggtgatttctgcatttccatctgaggtacccggttcatctcactagggagtgccagacagtgggcgcaggagagtgggtgcagtgcaccgtgcaccagctgaagcagggcaaggcattgcctcactcgggaagcgcaagggatcagggagttccctttcctgctcaaggaaaggggtgacagacggcacctggaaaatcgggcccctcccacctgaataccacgcttttccgatgggcttaggaaatggcgcaccaggagattatatcccacacctggctcggagggtcctacacccacggagtctcactgattgctagcacagcaatctgagatcaaactgcaaggcggcagcgaggctggggaaggggcgaccgccattgcccaggctcacttaggtaaacaaagcagcctggaagctccaactgggtggagcccatcacagatcaaggaggcctgcctgcctctgtaggctccacctctgggggcagggcacagacaaacaaaaagacagcagtaacctctgcagacttaaatgtccctgactgacagctttgaggagagcagtggttctcccagcatgcagctggagatctgagaatgggcagactgcctcctcaagtgggtccctgacccctgacccccgagcagcctaacagggaggcaccccccagtaggggcagactgacacctcacacggctgggtacttctctgagacaatacttccagaggaactatcagacagcagcattcacagatcacgaaaatccatggttctgcagacaccactgctgatacccacacaaacagggtctggagtggacctctagcaactccaacagacctgcagctgagggtcctgtctgttagaaggaaaactaaaaaacagaaaggacatccacaccaaaaacccatctgtacatcaccatcatcaaagaccaaaagtagataaaaccacaaagatggggaaaaaacaagagcaaaaaaactggaaactctaaaaagcagagcgcctctcctcctccaaaggaacgcagctcctcaccagcaatggaacaaagctggacagagaatgactttgacaagttgagagaagaagtcttcatatgatccaaccactccgagctacaggaggaaattcaaaccaaaggcaaagaagttgaaaactttgaaaaaaatttagacaaatgtataactagaataaccaatacagagaagtgcttaaaggagctgatggagttcaaagccaaggctcgagaactacgtgaagaatgcagaggcctcaggagccaatgtgatcaactggaagaaagggtgtcagtgatggaagatgaaatgaatgaaatgaagtgagaagggaagtttagagaaagaagaataaaaagaaatgaacaaagcctccaagaaatatgggactatgtgaaaagaccaaatctgcatgtttggtgtacctgaaggtgacggggagaatggaaccaagttggaaaacactctgcaggatattatccaggagaacttccacaatctagcaaggcaggccaacattcagattcaggaaatacagagaacgccacaaagatactcctcaagaagagcaactccaagacacataattgtcagattcaccaaagttgaaatgaaggaaaaaatgttaagggcagccagacagaaaggtcgggttacccacaaagggaagcccatcagactaacagctgatctctcggcagaaatactacaagccagaagagactgggggccaatattcaacattcttaaagaaaagaattttcaacccagaatttcatatccagccaaacaaactaagcttcataagtgaaggagaaataaaatcctttacagacaagcaaatgctgagagattttgtcaccaccaggctgccctaaaagagctcctgaaggaagcactgaacatggaaaggaacaaccggtaccagccgctgcaaaatcatgccaaaatgtaaagaccatcgaaactaggaagaaattgcatcaactaacaagcaaaataaccagctaacatcataatgacaggatcaaattcacacataacaatattaactataaatgtaaatggactaaattatccaattaaaagacacagactggcaaactggataaagagtcaagacccatcagtgtgctgtattcaggaaacccatctcacatacagagacacacataggctcaaaataaagggatggaggaagatctaccaagcaaatggaaaacaaaaaaaggcaagggttgcaatcctactctctgataaaacagactttaaaccaacaaagatcaaaagagacaaagaagcccattacataatggtaaagggatcaattcaacaagaagagctaactatcctaaatatatatgcacccaatacaggagcacccagattcataaagcaagtcctgagcgacctacaaagagacttagactcccacacaataataatgggagactttaacaccccactgtcaacattagacagatcaacgagacagaaagttaacaaggatacccaggaattgaactcagctctgcagcaagcggacctaatagacatctacagaactctccaactcaaatcaacagaatatacattcttttcagcaccacaccacacctgttctaaaattgaccacatagttggaagtaaagctctcctcaacaaacgtaaaagaagagaaattataacaaactgtctctcagaccacagtgcaatcaaagtagaactcaggattaagaaactcactcaaaaccgctcaactacatggaaactgaacaacctgttcctgaatgactactgggtacataatgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacagttaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacacaataaaaaatgataaaggggatatcatcactgatcccacagaaatacaaactaccatcagagaatactataaacacctctatgcaaataaactagaaaatctagaagaaatggataaattcctcgacacatacactctcccaagactaaacgaaacgaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacattgatgcaaaaatcctcaataaaatactggcaaactgaatccagcagcacaacaaaaagcttatccaccatgagcaggtgggcttcatccctgggatgcaaggctggttcaatatacgcaaatcaataaatgtaatccagcatataaacagaaccaaagacaaaaaccatacgattatctcaatagatgcagaaaaggcctttgacaaaattcaacaacccttcatgctaaaaactctcaataaatcaggtattgatgggacatatctcaaaataataagagctatctatgacaaacccacagcaaatatcatactgaatgggcaaaaaccggaagcattccctttgaaaactggcacaagacagggatgccctctctcaccactcctattcaacatagtgttggaagttctggccagggcaattaggcaggaggaggaaataaagggtattcaattaggaaaagaggaagtcaaattgttcctgtttgcagatgacatgattgtatatctagaaaaccccattgcctcagcccaaaatctccttaagctgataagcaacttcagcaaagtctcaggatacaaaatcaatgtacaaaaatcacaagcattcttatacaccaatgacagacaaacagagagccaaatcatgagtgaactcccattcacaactgcttcaaagagaagaaaatacctaggaatccaacttacaagggacgtgaaggacctcttcaaggagaactacaaaccactgctcaatgaaataaaagaggatacaaacaaatggaagaacattccatgctcatgagtaggaagaatcaatagcatgaaaatggccatactgcccaaggtaatttatagattcaatgtcatccccatcaagctaccaatgtctttcttcacggaattggaaaaaactactttaaagttcatatggaaccaaaaaagagcccgcatcgccaagtcaatcctaagccaaaagaacaaagttggaggcatcatgctacctgacttcaaactatactacaaggctacagtaaccaaaacagcatggtactggtaccaaaacagagatatagatcaatggaacagaacagagccctcagaaataatgccgcatatctacaactatctgatctttgacaaacctgacaaaaacaagcaatggggaaaggattccctatttaataaatggtgctgggaaaactggctagccataggtagaaagctgaaactggatccctttcttacaccttatacaaaaatcaattcaagatggattaaagacttaaacattagacctaaaaccataccatatgaggcactattcgcaatagcaaagacttggaaccaaccaaaatgtccaacaatgatagactggattaagaaattgtggcacatatacaccatggaataccatgcagccgtaaaaaaatgatgagttcatgtcctttgtagggacatggatgaaattggaaatcatcattctcagtaaactatcacaaggacaaaaaaccaaacaccacgtgttctcactcatagatgggaattgaacaatgagaacacatggacgcaggaaggggaacatcacactctggggactgttgtggggtggggggaggggggaggggtagccttaggagatatacctaatgctaaatgatgagttaatgggtgcagcacaccagcatggcacatgtatacatatgtaactaacctgcacattgtgctcatgtaccctaaaacttaaagtataataataataaaaaacaaaacaaaacattacatttgcatcattaatgaaaatattaacatagtgaaaaagaaaaagagcaacttagtattacagtaatatagtttcgaccttgcagactccctggaaggatctcagggatcaccaggagtctgtgaagcaccctttgagcattgtggttctagattcaaaatgtggccttggctgagcacggtggctcatgcctgtaatcccagcacttcgggaggccaaggcaggcggatcacctgaggtcaggagttcgagaccaacattgcaaaaccctgtctttactaaaaatacaaacaaattagccaggtgtggtggtgcatgcctgtaatcccagctactcgggaggctgaggcaggagaatcacttgaacccaggaggcagagtttgcagtttagctgagatcacaccgctacactccagcctgggcaacagagtaagactgtctcaataaaacttacacacacacactcacacacacacacatgcaaaaaacccttagtttaaaacacaaacacatcgtacagctgcacaaaaatattttctttctttatatcctttttctataagcttttttatatttttaaatatttgtattatttttttaaacttttttttgttaaaaactaagaaaaacacaaacattaggttaagcctacacccggatggtatcatcaatatcactgcctcccacctccacatctcatccaactggcaggtcttcaggggcagtaacaggcatgaagttcttacctccaatgaaaacaatgccttcttctgaatacctcctggagttcttgcctgagactgttttatagttaactgttctttaataagtagaagtacatgctaaaataatgataaaaagcacagtagatagttcataaaccagtaacagtcatttgttatcattatcaagtattatgtactgtatgtaattgtatgtgctatacagctggcagcacagtagatttgtttacaccagcatcaccacaagcacgtgagtaattcgtgacgctatgatattagcacactacaatgtcactaggcaataggaactttttagctccattataatcttaagggaccaccctcatatctgcagtctgtcattgaccagaccattgttaagtggcacatgactgtatatacaatggaatactattcagcatttagaaagaaggaaatcttgccatctgcaacacgaatgaacctggggaatgttatgctaagttaaataagccaaacatagaaagacaaatactgcatgatctcacttatatgtagaatctaaaaaagttaaattcatagaagcaggtagtagaaggttggttgccaggggctgtggtgtgggagaggaaaaaaatggggaggtgttggtcaaagggtacaaagtttgagttaagcaagataagtaagttttggagatctattatacagcataataactatagttaataataatttatacttgaaaattggtaagaggttagatcttaaattgctaagagagtagcatttaagatctactctcaccacaaaaatttatgagatgatggatatgttaattagcttgatttcatcatttagcaatgtatacatatatcaaaacatcactttttaccctgtaaatatacacaagttttatttgtcaactataccttaataaaggtggggtgaaaatgcatattcctgaaacccatcatgggcctactcaaacagagtatctgaggaggaggcagggctacccgagcagcagcgcaggttgtacactgcacaccttgcacaaaggtatacagttagcgaagatttgagcttgaagtttgccttttaaagaaattgcatatgtgaatcttggttatagtagaactttaagtgttctagagcagttgttcttcaactttatgtgcatcagaattacctgtcttggggttgaaaacacaaatttctttgtgccatgcttgaactacctaattagaaacctgagcatctgtattttcaaggaactacttagccaactctgccacctaccaaaatgtgacagccatttttctagactaaaaatggtatagctgtctacaagaaatcaactcaacaaaagctgaagacaacacacacacggcttaggatactcaggcatcatttggacagagtctattcaacagctataaatttgttgtttaaaatagccaatgttttttaaaatgcaactttccatagttttctgttgttatatttgttttcattctgtcagtatggtattggatctcaaccttgtatgttatttcaccaacatcttgaaatttatttagccatattttcatggttttatatgaatgcttactaaacatagtctgattttttaaaaggttttatcttatgcaagattcttcaagagaaaagacaaacttagtttactgtcaaattaccaaactgactcagatttttaaaaaccattcgaagtttcatgttatgcacttaacataaaaaaatgactcaatgtaaatgtcatgtctcgtaatgatcctattcctgggatctttcacatgaaacagagtgggcaggaacattctatggctgccaaaatggaattaaacacatggaaacaaagaaacaaaagcacaactcaccccttccagacaacaggaaaacatgtagataaatcagtgattttccttccagctaaccaatgaagtagagacatgtattttaacaattgtaagggcactgggcttaaggaaaggcaaagtaaaaactaggttataatgttcttctagatgcgaaaatgccaaatctgccagtcactcatgaaaagaacacagccccaggcaactgatattgatacattcaaagattatagttatgtatgattacagaatagcatttcataaactctatcagacagaacaactctttaatggaatgttaagagttgggagagagagaaaagttggtcattctaaggtccaattaatttgaaaactcatgagttatatagaattaaacaaatttttttgactgtggaacttctcagagcccttctgtactaatgtgcattacacctctccaagaagaaaaaagcatgcagcatttttcaaacttttgatactttgatgcttttttatttagcttctgactgggctagagttctctgggacacacccagggaaatattgatacagacaggtcaaacaattaaggcaaatgctcaggcatatacctgaactgtggtagaacaatctagatgccacagaaatggtgaaggcatgcccaacagccagccccactatatcaagtcccttagcctctctccattggccttagctctgaaagaaagatgatgcttattagtaaagtgccttgggatggttgggcaagaaacactaaataagaacaaattattaccctcattacagggtagatgatctaataaaccatctctattacttacaaagtttggaggcctgctatttttttccttttaactacactccaatttgaccttaaaaatctatgctaaaaataacttataggaaatatcccaaaaccataccataaactttcttatcggacctctgtctgtttgcacattctcaatgactgccaatcacctacaggtaaatgcaaatttcttagcctgctgtataactctccatctttcaggagctgtagagtttatgattaagatcatggtctttgtagggagacagacaaggttcacatgcaggctccactctactacatctgaagttatttctcttctctaagccctagattatcaaagtatggtccatgaactggcagcgtcagcagcatttggggcttcctagaagggcagaaattcaggctccattgaaaacctactgaatcagaatctacatttcaacaagagcctcacactgtagtttgagaagaactacacaaattctcatacgctttgaccagctcctctgcaaattggaggtaataatagtaaacttggagatggcattcatcgtctactcctttgaatccatcctcaagtcctaaggtccacgcaaatatccttacctgtctctttcccttcattaccttagtccaagctgttctcatttctctccagatctcctgcaatggccactcaactcattacaatgcatctcctcttgcttccttctattctgtttcacttactgcaaccagagagatctcccaggaaaagcaaatgtgatcagagcttccatgagctctcaaaataaaggccaaaagcctttcacagaactacaacctctgttgagggggtcgcttcccacctctatatcttatcttgcatgatgctccacctggtttcctctgctccagaagcactggtaaattcttttttccactccttgaactagccatcctccttcccgatacagaatatttgcaaaaccatcctcctggtcatcagtgccttcccctcaactctttacctggttaactccttctcaatctttagatgtcagctcaaatgtcatctcccctgaaagctttccctgaacctcctacccagcagccaaacacactgcctgacctgttgcctgtgccccataaatatttgttgaataaatgaaggaattaatgaatgttcattcatatggttattgtgacaatcaaatggattgaaacctgtaaatcatttagcacagtgcctggtagagagcaagagcttacttaatgcagtaccaatggtaatatattttgaatattagtcttgctaaaaactagaccccaagcagtacttaacaggggctaacaattagaatcacctgggaaatgttacacttctcaatgtccaggctctgctgcagaccaattaagtcagaatctctaggtggtgggacccatgcacctgaggattttaaaactctacaggagattctaacgtacagccaaagtgtgactgctttactcgttgtctcactgtggtctcccagccttccagagaatagcatactgggcgtcaagaagagtcctcattaatcatggcatgagtctgtggcccacagaaaggggcagtaatatgaatacatgtagtaaaaatctagcaattcatttcccctggctccttgacagcagccagatggtggaaactctccatctattacccaagccagaagaaaacctttctgggaaaatccaagttgcctgaactactgttgggaggaagtatggtaacacgtgaagatgactctggtcctttgggttaagtgatgacttaacaaaattcatcaggattccattataaatctgtcataattgttttgttgaagcaattgctttgtgggagcaattaattcctactgctaaaaaaaaaggtgagaactcctgagtgttccatcaggcaccaagaaataggtgagccgggaagcatttgcccttaccttctgtcttcttcactactcaagtatttggagtgtcaagagaccacactgtacttcaaaggcctcctcttccaaataaccaaccttctgctatgtaaaaacatgattaagaacacacatatttgtactgtatgtctcactcattttgaacttttcaaaatgtgatattgccaaagaagctttatctcttttaagggtttcacacacacacacatacactgccttggtttgaaaaacaacatagaatgcaggcctcatacaatttgagaaccatttacaattataacctaccaagtcagagctgataccaagccaacacaaaggcctcagaattgttataaaaggaacagaattgctctctggaaataatatcccagtgggctaaattccccctccccctgttcctccaaggtggtaaattgcaacaacaacaaaaaagcatgattcatgaatataaatttttcttggcttttaaaatcatacactggcatagtcctccccgaacttcagccaaatgagaatacacagataatgacaattttacaataagtggttccaggacacaggcttttcaagatccacaaatgaaaggcactataaaaaagagtattattattattattatttcaagcacccagaaaaaccacaatcaatgattagccataacaattaaactaacaatagtacatctggaatcagctccatggtaatatgtacttcatgcttaatagttcaaattaattcaatctgatggtgttagacataccagttaggagctggagagcaccaaaattcacattagcttccacttcaaaagatattatgaaaagagaaggaaggaaatgaggctataaacagcagtggtaaatacgaaaggctcagagatgatatggtcaggaataactctcagctattaggaattcagtgatgaaaatatgaaggctgatatttctatccttgcacattcctccagagtcaatgactgagccacccatctgagcgacagaactgaaaccctaaaatcagggcaattatattcaaagaagagggggccttcttcattctgcttacagcatcctttactagtagcccatttatattgcagaatgcatggagaatttctcattttcaggttatagacttcaagtaataagaaaagagagcaggagttggggcaggcataaaaggtgaggtagttattgcctgattaccttatttgtctcactcctccttgaagattcactagataactgtcttaagctgcactataaatattctctaaggcaggatttctcaaccttggcactgtagacactttggcctaggtcattctttgctgtgaagtgctatcctgtgcactgtaggatgtttagaaacatccctagtctccaccttgtagatgctagtagcatcccccacccccagttgtgacaacaaaatgtcttcagacatggccgtatgtcctcttgggggaaaaatcatactggttgaaaactgttaccttaaatcttttttttttttttttttttttttagatggagtcttgctctgttgaccaggctggaatgcagtggaatgcagtggcgcgatctcggctcattgccacctctgcttccaggattcaaatgattctcctgcctcagcctcccaagtaactgagattacaggcaggagccgccacatccagcgaattttttgtagttttagtagagactgggtttcaccacattggcgctggtctcgaactcctgacctcaagtgatttgcccgcctcggcctcccaaagtgctgggattacaggcatgaaccaccgttcctggcctactttaagtcttaattcacttgtttctgggcatcgggaggaaaatccagagggcagactcccctctagactcttcttcctcagagatgagcatggattgtattgccagctgtgtgcaaggcagcactcttcccacggcatgctgaatcctcctcctaacaccttttgcacatataggcttgttgcatataatacagaaatttggaacctggcagtcttctattcattgtgcagaaaagagttaacacagagcaggctcgagaaggcctatccttagaaggcctgtttgcaatgttggcctttggttagcagctgggaattggagctggtaaacagttccctacactaatatgacatttttcctaaattatagagtggccactatgcctcacctgtttgtacaaacagtgtggtttatgctgaacacctgctttccttctgggagtctggaatttgggtatgtgctaggcagatcagctcccagcagtagccttgggcactgagtctctaatgagtgccctagtaggcaacacttcaaacttgttgtcgcagcttgttgcttaaggaactaagagcatcctgtgtgactgcattggaagaggactcttggacgcttactcctgatttctccagactgcacaccatgcaccttttccctatgttgattttactttgtgttctttcactgtagcaaatcagaaccagaagataacaatgctgagtcctaggagtcctcctagagatttacagaaccttgcaagtggtcttggggaccaccaatgcagggactcattcagcattctatttgtgtgcctctatttctagatacagcaaagacttaaactccaagtcctcacagaatttatgtggtagcagcgagcaaagcattaattctagcatatttcaagcttctttcatagaaaacaagccctgtggcatctcttttttgtttttataacagctttttagagatataattcacatatcatactgttaatcaatctaatgtgtacaattcaagatttatattcatagagtcgtgcaaccacgaccacaatcaattttaggacattttcatcaccccacaaagaaaccctatatccatttacagtcactacccattttctcccaaccacccagctaggcaaccactagagtttctgccgctatggatttacctatttttgacacttcacaattggtcatatgatatgtggtcttttgtgagtggcttctttcacttaccaaaatgttttcaaggttcctccatgatgtaacatgtatcagcactacatttatttttattgctgaataatatttcattgcatggatataccacatttcatttatccattcatcagtaaatggaactttgtattgtttctactttttggctactatgaatagtgctactatgaacatttgcatacaatttttttatgcacatatgatttcattccccttgaatagctacctaagtgtggaatttctgggtcatacatatgtttaacttttaggacattttcaaactgttttccaaagtagctgcaccatttacttaccaatggcagtgtaacagagttctaatttctccacatccttgctaatagttactattaactgtctgttttttttttttgttttttttttttttgagacagcctgtcacccaggctggagtgcagtgatgcaatcttgactcactgcaaccaccacctcccaggttcaagcagttctgctgccttagcctcatgagtagctgggattacaggcacgccccaccatgcctggctaatttttgtcattttagttgagatggggtttcaccatgttggccaggctggtctcaaactcctggcctcaagtgatcttcccgcctcagcctcccaaagtgctgggattacaggcatgagccaacgcgcccaaacttatctgtctttttgctaataaccgtcttagtgggtgtgatgtggtatctcgtaatggttttgatttgcacttccctgatggctaatgatgttgagcatcttttcatgggcttattagccatttgcatatcttctttggagaaatgtctattcagacctatttgccccattttaactgggctatttgtctttttattattgatttgtaagaattctttttatattcatattctatctccaagtttcttatcagatatatgatttgcaaaacacttcttccattttgtgggttagttttattatttcaatcatgtcctttaaagcataaaagttttaatttttaggatgtccaatttatccatttttttcttgcattactgtgcttttggcaccgtagctaagaaaccattgcctaacacaaggtcatgaagatttatccctatggttttgtctaataatgttatagttttagcttttccatttaggactttgatactttaaggtaatttttgtatacagtgtgaggtagggggtccaactttattcttttgtgtgtggatatccagttgtctatggcatcttttgcatcactccaagacatagtttcaggtaatttttgtctatacaaattaaggtaacaggtaccaaaacacagaacctatgtatgtgacaaactgcctgaaagcctttataaaaacttttgcaattggtgttctttttttctattttcagaatatgctcagtattttgctatatcaggaagcagtaccaccattattaccactggtgctactgctgctaataataatagtaactagcagatattttgtacttagtatgtgccagacactacacttgcatttaacattcattaacttttaagcactacacatgctttaacttacatgatcttcctgccaacaccacgagataggtagaatcattatcttcattttacagatgatgatattaaggctcactgatgtaaaaaaattttccttaggtcatagaacaagcaggaaaaccgatttaaaaaaattgagggaaggaatggcactggaaagtggaggtcaagtaatgtcggatagcaaattctaacaaacagtagctaagcacgtatgcgaaatatacaaaaataaacaagccaaaatctagcactggtagatgacattcccagttctgatcaagttgctgacaacaaaggattggtctccccttctaactcaacaaagggtaggaaatcttatcactcaagatatcaatcaagatttatttgatcgctgaaagggttttgtcaacactccaaaaattgtattagtgactagatgattgatggaataagtcaattagaaccagattagaaatcgagatatgaagtcaattacttccaatctgaaaattaggaatcattaaacaataatataatagatggcatcaattttcaaaactacccttcgtgtgtttgtctatagggcaaaattcaagtaaaaaataactttgaaaagactaaaactatagagcaacttgatcttgggagtgttttcccagatgggtagtgggctgagtctggtcagttttcagtggagaaaatgtagacgagataagcagttgatgttcccaaattcaaataactttatggcagaaaagtcagtcaagtttaattctctttccctatactagctgtgtccttaatgataaatacaataataatagctgacatgtattgagtcttacattatatagctctctaggtacctaaaagatgacaactaatttatttaaaccaaggcatatgaagtaagtactattattattcccattttatataagaggaaaaggatgtgtaaagtgctaattgacctgcttaagaggtagagtgagaccttgaaccctgtagtctatgtttgtcctcctaatagtgtctctatatggtttcagaatagaagcaaatagacacataagggttaagcatggctaacctaactccaagttgagtctttttacactaggcaatgctgtcttcaatatatttataataactttatacaccaaataacattttgaagtttatttcctcccaatacagaaacatcactgcatttccactgggattttcagtactgtctgttgtggaactgatctgggcttagtgagtattgctttatcattcttaaataaaaaccattatagagaatgcagaaaacaatttccctttcagtttgcccacttctacccataccgagaaagacggatccttaaagctcagaatgtaataaaagctcacaatataataaaagctcagtatcagaaatgttccaagtccctccactctttctctatagttaggaaactaaaatttaatatagggcacaacgctccagagaattcagtgtatcgaaatgttaatacacttttatatattttaactgagataaacaagaaagagatagggaagccagagcagctatggcaaagacataattatgataagactaatccagctaacagcaatagaagcagatagtgactccactgtgatgctgtggtagagtttgtatggtcagaaaactatatcagtatacaatgttaatgacgcaggagccccattataggaaagcaaagataacttactatgtgactctataaagtaaagttcatccaaaagatcaaagagcatttgtcctattactaaaatattatccaaatgtattttatcaattaaaacttggataaaatcatttgcttcattgaacagtaatttaaaaggagcataggctgggcactgtggctcacgcctgtgatcccagcactttcggaggccgaggcgggcggatcacaaggtcaggagatagagaccatcctggctaacatggtgaaaccccatctctactaaaaaatacaaaaaattagctgggcatggtggcgggtgcctgcggtcccagctaatcgggaggctgaggcaggagaatggcgtgaacccgggaggcagagcttgcagtgagccgagatcacgccaccgcactccagcctgggcgacagggcgagactccgtctcaaaaataaataaataaaataaaaggagcatagtatgtccataaccaaataggaaggaaaatgcctattttgattttcataacagagcttaaacattgtggcaaaactttaaaatgcaggacataatgtaaaaattcttctaccagctctaaattcgtggttgtgctatcaactatgtcacatttctcagtgttgaccacaaaaataccatgagatacatacacattgctgaaatacactatttctcaaactcaactttatcttctactccaataaccctgtcaaaaggaaaactagtctggttacttcatttctggcagatccacattaactcctttcttttaatgctcattaatctttctgttaacaatacttctgaccctcaatacccaccctttcagacaggtcaaaactaaattcttcagtttaccatttaagcctttccttcaagtttttgcaggtaaaatgagataaaaacagacgtttgtattccagccagattgaaattttctactaccctctttgctcttcccattaaattctacctcgcagtttgtttgtttttgttttattttgttttgcgtcgtttttttaaaaaaaattgtttattgtttatttactaaatctggggcatattagatacttgaccaatttaaaatttacatcttttaaatcaattttgaagtgttttcacacacacatacacacacacacacacacacacacacaattggcatgcaacagttgtcctaaggtgaaacaatcacctcatcaacaaagtgtcataggtgttctcacccaaggttgcttatcctaaacctgaaaacctgtaacaaatttaaattacttatataaaactcattacttgtagttttccccttgcaaagatctccagaaatgtacaaataactaatatacatcagtcacaacataatcctggatcatccccacatcaaaaccagatgctcctttaattttaaactcattatcagagagcaagagaaagtcatttcgttttacacaaaacaaaattcacatatgccaaaaaagaaagacccaagagaaacaaaaacaaaaaccctagtgctgacactgatgttcagtgccctggttaaacagtggcccgaaggccacggatcaaaaataaaatagcggctgtatatcactgcaatgaagtttaacaggctttaaccttctggcttcagaaatccagatttttccaattacatgaatgcatacttcctacattccaagagtggagaaagtggatgcgccagtgtggaaatgaaaagagccaccattcactgggacaaccacagaactggctttaacagagactccttagaaagttacgcaaaaaataaagacaaaaaatggttgtatgcggcttgtgtcatcaattttaagtggaggtgactgagtcctaaggtacaatgtaaaatgtatgggggaaaataggtgctggggcaagtcttacctttaaaagcaaaacttgaaaacaaagtataaaagtgcccagcctggcagcatacacccaagccagagagctctgccatgagcatgcatagaaaatgtcaggattcatactattgtttctcataaggactcaacaaaatgaatccttaatagcttaaaccacagaatgagggaatacacagaatgcagtcatttcagtaaagtactatcaggctttgtgctgatttcctgaactaactgcattttattatcaaaacaaaaggaaaagaagattttaaaaatatatatatatatatattcctatatttcaattccagtgtttaatttctggaaggacctatataatggaggcagcatttaattaggaaattatgccaatcaattgtcaaattttcactatgactttcctaaaaaggtgttttcttccaatttctattaatcacaaagaaacataagctgtgactgtatagttcagaaaattaaaacatagaaattaatggcctatgacgttatcaccaaggtgtttggtaaacagtaaactatgagtttggaatcatcaggaagaggcttttgaaacaaccctctggacttcaaaaaatctcttcaggtagtagatgtgtcccaatgtcatggcaattagaacaagagcttcaaagaagcaccgaaggaccactgggctgtttgtgttgtcactaatggctctgtgtatcctctcccagattttcgtgtattcctctttgtgctgtacagctgtcatggccacagccagctcactgatcatttcttctagtttgttctggtgagcttctgtttccatgtcttctctttttgtagcctccccaatatcaatggtgaatatcactatctttggagtcatggtggacactcggtcactaaaacaaaatgtatttgttccatccatgtgagcagaaaatgtgtatttcccactggattctttgtctcctttataaatccttttattcttaggtcctgtaatctccatgttgatgcccaggaagccaccttcgaagatgaggcccatcttggtgcctgaggtgactcacttaagcattcttcagcatgtgcgtggatgctgatgaaatagcccaagaccatggtcaggagagtgttctggagcaacagcagctcagcgagcgtcaccacagtggggctggagcagaggccaggactcgcactgcggcctccagagccactgccgccatcaccaccctactgccttcgcctacctggcactttttgctaatcctaggaaaaacgcaaactcaaatgccttttgtgctgggaggtactgtaaataaatgaacagagaagtctagtgttaagaaaaataagacaggccaagtgcagtggctcacgcctgtaatcctagcactttgggaggctgaggcaggtggatcacgaggtcaggagatagagaccatccaggctaacacagtgaaacccagtctctaataaaaatacaaaaaaaaaaaaaaaaaaaaattagcccagcgtggtggcacgcgcccgtaatcccagctacttgcgaggctgaggcaggagaattgcttgaacttggcaggcgaaggttgcagtgagccagggtctcgccactacactccagcctgggtgatagagcgagactctgtctcaaaaataaataaataaataaaaataaaaaataaaaataagacagcagtacgttactggccgaacatatctgagtcatgcgtcatcaaagaatgttaccagcagtgaatctgtatgggtctgcagcaacctcagttcttacctcttcagaagaaagagttcaaccaaggggcataaggcagaaggagacaccaaagcaagttttagagcaggagtgaaagtttattagaaagctttagagctggaatgaaaggaagtaaagtacacttggaggagggccaagtgagtgacttgagagatcgagtgcatggtttgaccttttgacttggggtttcatatattggcatacttccagggtcttgcctcccttctcccctgagtcttcccatggagtgggctgttcacgtgctgggtggcctgcatgcacagtgtgtttactgcagtggtatgcatacccacttgaggcatgcttcccttacctatcaagcgtccctataaggtcatacaccagttaaactccaccattttgcctcttagtgcacatacttgatcccacgcacccacctcctgagatcttattaggaagctgctgatcaccggttttaggtttcttctgtctgttgggagactattgttccctggtgccagctgcaaccaattattatttgagagaaccatcttaacaactgcctgaccatcacctgatggtcgcctgacattcctggtgggatgtggggtgtccctttactgccccaactcatatctgactagctgactagctacctactgtaacaattacacttgattgcatttttttgttgttatttaatttttatttcataatcataaacttaactctgcaatccagctagggaacaaggaaaacatggaacccaaagggaattgcagcgacaatacaaagattctaggatactgcgagcaaatggggtggaggggtagtctcctgagctacagaaggaatggtctggtggttaagagaaaacacaagtcaaacttagtagagctgtccacagtcagcaatggtgatcttcttgctggccttatcattcctggacccaaagtgttccatggcctccatgatattcatgccttcaccatgccaaagaccacatgcttgccatccaaccactgagtcttggcagggcacatgaaaaactgggaaccatttgtgttgggtccagcatttgccatgggcaagatgccagtacctctatgcttcaggatgaagttctcctcatcaaatttctacctgtagatggacttgccaccagtgccatatggcatgtgaagtcaccaccctgacatataaaccctgtaataattctgtgaaagcaggaaccctcacacccaaatcctttctttccagcgctcagagcacgaaagttttctgctgtctttggaacctcgtctgcaaacagctcgaaggagacgcggcccaagggctccgtgtcaatggcaatgtggaagtacacggtggggttgaccatggctgatagtagggtgctcccggcagtggcagcgtctgcaaagactgcttttttttttttttttttttttgacaaagtctcgctctgtcacccaggctggagtgcagcggcacaatctcggctcactgcaatctccaccttccgggttcaagtgattctcctgcctcagtctccggagtagctgggactacagatgcgagctaccacacctggctaatttcttttgtatttttagtagaggcggggttttgccatgttggccaggtctcaaactcctgacctcaggtgatcggcccacctcggcatcccaaagtgctgggattacaggcgtgagccaccacgcctggcctgattgcatatgaaatgcactatttccccatcctatctcacccccatctttttttaacaaagacttctgaaaatgtatttttcatctttcaaactttgctggacaagtttttatgaatagtctcaacagtgcaagcatgatgctagagagcaattaacctttgacttcagtgttgggagactgcagggagaggtgaagactgcgacaaaccactcgtgtatcatggcaatcgctactccctctcagccatttcttgccaactaggaattcaggcagaatgttgtcagatctttcagttattacagaaaagtaagaaaacctgcattttatgtgaaacttccagattttctagtattttctaatttttgcttgaaatcttttattgttccaatatattttatttctatattcctgtgtagcacacatctggttttttatttgtgtggtttttgttttgttttgttttgttttgtttttaggccagtgagctgacagatcgagacctctgggttatgtcattccttggtcagtagctttcagtctttttcaccactacacccacctcaaccaaccatcctttccaccaaccgatgcccatcacttcctttcagatgttgctgaagaaactatttctccatataattttccctagatcactctatccttcattcctcattaccaaactgttttactcttttagcctttagtatgtatgctctgtggtccattggtgagccctttatctttctctaattacacctggactatagatttctaatgccgaggacccttggtctcctgccacattcacattcccttagcagaatgttgcacacccagcagacagtacatgtatactgtgagtaaatattttgtattcctagtcttgctaggatagaagtttttattctatacttgatgcatttctggatcaaaatattaagtctaagtcaagtctccatagttaaggtaatcttgaggattaaaacacttaggtggacaggcaacataaaacactttatctgaataatgaaagaagaatccgtctgttggtctgaagtatcaaagcaactgtcccaatcctacaaactttcagcattgggacttcctttcaagatgtaagcagggatggaaaatatacaatgcaagcgccattgtttcactctcctgggcctgtgacagacatcattaagtgatcacaacgttcttttcttctaaggctgaatgcagtcttagaaaccattttaacatggtatcctagatgtatcgtgtccatcttgtttatttctattaagaaatagagttggcatgagagctgaagatcctatcatatgaaggtacacatacaatttattattcaaaagccagagaacaacatacaactgctgctgcatctcagtctctctatattttaatttatttattgttttgagacagggtcttgctttgtgcaggagtgcaggctggagtgcagtgataccaacacagcttactgcaacctttgccacccaggctcagaaggtcctcccacctcagcccccaagaagctgggaccacaggcatggcaccaccggcatcccgccatgttaccaaggtctcaaacttctgagctcaagcaatccactcatcttggcctcccaaagtcctgggattacaggggtgagccatcccacctggcctcaatctctgtatattttagaggatagataacttcgaatgggaaaagttgtctctaaagttgaccagtcaagaagaaacaatgcttccactttaatgcctatgccagacttaccttacccattaacttttaatcctgtaagaaagatttgctatgtgatgaggctgcttttgttgcaccttgtaaaacatactgaaataaacaaactgtaaatgactttgcagggattgctgatttaaataaataaattgttataattgtagttacagttatagtcaaggggctatttcatttctcagactctgaaccaaagcaattaggaacaactcagacacaaaatgaccagcatcaagaattacaatgaaaagccaattacctttaactataagaaaccttatttgcatttattaaaacaaatgatctctcagtactggagaaaattatgtggattggttgattaacccttcacttgtaagagaccagaaattacttttcagagagcctgtatcttttctaaatttacagacaggaaaccagtaaatgataaatgatcaaggcccaaggaaaaaactgcatagcacaatggacatctatgagtttcacttgtgctagcatgcattcctcattgtgctggtaccatcatcctcactttcctctggggaatccccttctccagttctgactccagatggtgtagatggagctaacttcactccccactgagaatgagcaaatgaccaatcaatgtatttcaccgatgaatgattcagggagccaatcattaattcgagtcagtccagtactactcaatgctaagatttgagaactactgaaggaactattgtgaaagggaagaatttaaaaaaaatcttgctggcattctgagctggtaagataaaaactttgagcgtctagcggccatctaaccactacaaagtgagaccatgcctatgcgtgagaccaacccaatggaaagaaaactaagagatgatagagacatatttctgatgccatctttgagaagctgcatccaatcattctggaggcaaaaagctcttaactttatagataggcaagccaaaatcttcttactttcattaagccacagttagagctaggtttctgtcatttgtaaataaagaagttaagactaaatgcaaatcacttatagcttattttattactaggtactcaatgtctatgcttttgcatagctaagtgagagaacttaaattccaatactgatgggctattacctcatgcaggtaccctaataaatcttgtttcctctcagtgccattgtttcctcatttctaaaatggagattaaaatggtagctcacaaagaagaaatacaaatggcctataatcacatgaaaaaactgttgaacatcattagtcaagaaggaaatgcaaatcagctctacaatgataccacttcacactcactagaatggctatgatcaaaaagatagacaataacaagtgttttctaggctgtggagaaatttgaagtctcatattggcaagtgggattataaaatggtgcttcaaaaagcatctggcagttccttaaaaagttaaacatagagttaccgtgtgacccagcaagtctactcctaggtatatacctctgaggaaataaatatacaagtacacacacacatacaaattaaaaagtccataaccacattattcttaacagccaaaatgtgggaaaaaaaaccttaaatttccatttactaatgaatggataaacaaaatgtgtcatatccacacaatgggcattatttggcaataaaaagaaatgaagttctgttacatctcacaacatggatgagccttgaaaacattatgctatgtgagaaaagctagtcacaaagaccacatatcatatgattccatttatgtgaaatgtccagaataggtaaattcacagagatagcaagtagattggcagtcaccaggacataggaggagaggaaggacagtgactgttaatggctaggggtttcttttcagagtgatgaaaatgttctagaattagatagtggtaatggctactcaactttgtatttatactaaaaccaccaagtttcacattataaacggataaacattgtgctatgtgaattatttcaataagaaaaatatcttatagaaaaaaaatggtagcctattctgattctcacaaatgaccattataagaaatccatgatgataacaatattaaagtgacgttcttgttggagcctaaggaaaaacaatccatacaaatgcaaaggcctattgtttttaaggcctcagcaagtgctaagagaatgggaaaagaaaattaccaaatagattttcccagatcacttagcttcctttgtatccagcaatggtcaacaaatatatagcaggcatacataaaagctattcggagatctcttgaggttaacagcatgcaacatattgccactgcccccagcctggccaggaatattatttatgccaccctttcacagctgtatcaatctcccatgaaacattcagagcctccttgttaataaactacattatgagccggatgcattgtctggataaactgcattgtccaaaacactgccccattattacagaaaatgcagaatgtaattagtattcttctttgcataaactgcagcttccaaaaatggtgccatattataaagccttaattaataaacaagagttgggccatgaccagttacacttatctgaattttatattgtgaagaaaggccactgttcaaattccgtttacaaatatctaaattctggctagcctacatgaagatagtctaaacagaaagcctgagaattctgtgttgctaatagcattgtgttggtacaccaacaatagcaagccattaactgctgggacataaaccatcctgagaaatgttcagagtggaaggatgataacattgtatttcagctgcatcgtatggtgcaattcttctatttgttcatatgcatttcccatttaatagatggaggaaccagggtggcttttcatatctctgtgaaaccttaaatgtgggggagaaaagtgagctggcaaaaaaacaaaaaggataagtacgaggtattgtggggtgggagcagggttacatcacaatggaatgtaagtacacagttgctttctccatttccagctggtttttattgattttcccctaacctaaccccaaagcaaggccatttacataagtcatgagcattgaactaatatttgggaccataatattaagcagcccattttatgaacctcggctaaaggagcatttgcattaaactgcactcacctgattaaaatccatcaactctagcaccttgagaattgtagagtacctgttaagctcggctgtgggactctgcatactgaggcagaccataatcagaaggcagcaaggaatccgaccgggagaggaaagggaggaggagaacatgtgatgtgtgttgaaaagcagatcgcatgaaagaccgccagtgctcaaatctgaaaagagtcctaagcctactgcaaacacagagctgtgcgaacatgataattctttcagcaaagtccataatatggcttatagggccctgtgaaaacaaggtggatgagatagtattacagttcagtgaagagtaactggcccagcaatggaatgtagcatacacaggaggccccaaaatggtccctgcctcagcagaatgagcaagagctcagagagtccaagccgagggactttctgcagcctaaacaagccgtcttagatcactgccctttccatcagctccaggtaccaagcacaggctcagagtcctatctgtctcagaaggacctgctttaccgtgaccgcaaggatggcatttgaatcagtaataggctgtcagaggccaccttgatgcatttgaagaagagctatccctgagacattggttcaagttctcgatctgtaccacctagctgtgtggtcacggacaagcagtcttgctcatctgaccaagtggatgcagataataaacacatgtgaaatgaatgaatgagagaataagacctctgaagcagaatttctctccccagtgatacagacagaagacaaggaaatactgggtagaagagggaggttccctggcaaaggccccaacctcaagcctggagacctgcggcccctaagtggggcatttctgtttttgtacccaaacggttgccttttggcatgccacactcccttatcctgtacccatataaatcccggaccccaggctccaggagcagacaaggagaagaggagaaaagcagacaaatgacacaacagagaaagagagaggagaaggaatgtctgaacgccgagaggaactcagctgggggcagtcggagaagagtttggccgctgaacagccaaaactccaggggaagatcatcttcccattccatcccccagccagctccccatccatcccattgagagccacctccaccactgaataaaacccctgcatgcatccttcaagcctgtgtgtgacccaattcttctaggatgctggacaagagcttgggatacagaaagctgtcacactggccctctgcccttgcagaaaggcagagggagcactgagctggttaacacttaagctatctgtgaatggcagagctaaaagagcattgtaacactggggccacaggcacccacccctagacactaccatgggactggagcccaaagcactcactcttgctcctgcacctggccatctgtgtgctccctctcccacaaggggtttgagttcatggtggttgaacagagagccgcacccctgtcgcatgccccatgagtggggccagggaactcttctgtttcatcaacactattgacatttgaggtgggatgattctttactggggaggctgtcctgtgcattgcaggatgttcatccctggcctctacctacaagatggtagtagcacacatactccctcaattataacaaccaaaaagtctccagacattgccatatgtctctcaagagccaaaattattcccagttgagaatctctaatttatccttcagaatgtacattccaggatctaaattaatgagccatacacccagatagtgccccctaattattaggaaaacttacatagataccttcattatcactggaaattcatcaagacaaaaattttactgagcacctattatctgccatgtagaaagatactgttcctgctcctgagaagctcacaagtttaagtggaaagtggcattttacaacttcacatcaaagaaaagagaaatgttcaggtaaccatctttccaataaataatagaatatccttctatctgattagagaggtgaactgtaaagacaggcaagaatcagagcatatctctttgctattaaaagaatactacatgtatcaaagttgctgacatttgataaggtgaatttttggtaattttgactcattttagatgtttgctgcagttgtttattgctgggtgcagggagtctcagactcaaaggacaatcttatgaggtggtttagcctaagagcataagccaaaagagagagctctggaatgaaactgcctggttttaaatctagattctgccatttgcttgttacgtgacccctggcaattcattaaccccttcaatcctcaaatccttctctatgaaaaggagataatcaatgtacctacctcacggatttgttaaaagggttaaataacttatgtaaagtgctgaacacaatgcctcccacaaagcaaaaattgtaagaacaatagctgttagcattgttatattgatattgctgcctctccattttattatgatcttttttattgtagtaaaatacatgtaatataaaatgtgccatttcaatcatctttaagtctacagttcagtggcattaggtacattcatattattttgcaaccattaccatcatccatctctagaacatcttttattttccccagttgaaatttcccattcctccctccaccagggttgttctcttaaaccagtccttacccagcaaaataccttctaaggaaatgaggacaaagcttttgtaaatgagactaaaggcaattcaaactcaggtaccctggaaactgaatagaggtagtgcttaaaatggccatttgggccacttggggttatgttgatgagtttagtcaccatgaaccaactcctaggagtaacattctaagtgggtttttgttttgttttgttttttgttttgaggcaaatggttcctggctctgtggccttcccatcttaccatcacagaagcattcactctactcctctaatcaatattaacccagaaaaaaagtccagggacatatatattttggtagcctagaattaatgggaaaagacaagttgctgggtctaaactatcaaagtcacgtactttttaacagagaatgaacaaacctcctcccttcaagaatccacctgtttttgcaagagcattctggggtgggaggaaaaccttctgatttctagccagctcctcaaaatagctaaagagttcctaatttcacctcaaacctctgtttcagcacctactgtgttgtgccaagttatttctcatccactatcatttttgacagtggatctgaccctattgcaatcgagtttaaggagtttgtagacaggaaccctatctgagctgtcagcacgttgcctgatcatcttcagcaagtggtctggcagaagcatgcaggtaaggatgccctgaagcaggctgtcaagaaaactgaccaatgagaaaggtgttttgtgctccacagctgaagccaattctgctgggacatcccaagacagactccactcggactcaactgataatacacactttacatctgtcactatctgcccaggcatattgactttgtaacattccccccaggcacttcaagtccagtttcgactctgtgacttttgcctgtggtcactttgcctgaaatgccctttctccttctccttcttatccattcattaggatctagcaaaatgtacctcctttgaaaagcactttctgtagccctcaggcacaagtggggatggctgtgttggaccagaaaaagcaaccattgaaatttccaaactgaatctgtactttgatttatttcagtgtggtataatgtatggtataatatatggcaatgttttccaagtctgactgtacatcacagtgacctgggggacttttgaaaaatagattcccaggctcccctccaattaagacagcaggtcagaaggttgcaactcaggaagctttacttaatgtctagaagtttcccaggatattctgatgcatgaaccgtacttgaaacaatagtcagacattgctacttatcagctgtgtgatttggggcactctgagcttgtttcctcatctgtaaaatagcggggaagtaggggagtgtcacaaggtcttagaaaggaccacatgagggaatgagtgcaaaattcttaaatgatgcctcagtaagtgaaattatgatgctaattacaacgaatgtccttaaaaagctacttttcacttccaatagtccagcttgcaaaaccttcctctatcagagaaaaatttagtgaaagagtaaatgggcttcacaccaggatgatagcctggaaaaatcaaaagagacattgagacattgcccacatagaaagcaggggaagagcatgttcagtttttctgaaggtctatattcttcattcctactgtccatttctcctgattaaaagtctctcccaatagctgagaccattaacaaatataagcccatcaaatggtagctaccccactttgtaaaattaggcttttgtgtctctcatagaataatgttctaacacttcactacctgtaataaagtatttgcaccacaagaaaaaaatgtatttcatgaccagcaggctacaaccagcattctgcttttaggaacccatgcgtttgattgtatcctaagttggtaatgagtcaccacttttgcatttagttaaggacaccaaacaatgactctgtgaacctcagctcagactgcccctgagtcctcagaagatgcctaaatatggactgttctgtagcgcttaaggatatcaaatgacagtataccatgacaatcacaactaatcgaagtcccctgcagagtagttcctcataaagagatggagatggaaaagtaggaacgtttttcaatgctatgcagaaggaaaataatacctactgaccatattcatcctttcaaaggtctgccctgaaggcaagttgacaacacccaggcttggttctcccttttggaagagctaacgctaggagagttcacccttgctccctctggcgggaatcagcagaacagagcgggaggcactgtggcattaggattgcaaaccctggcttcggacacagtgctgcttgaatcagaatctacactgcagctgggcaactggctgaggtcacatttttaggctctgagctgctttctctatttgcaaagtgagaatacacagcttctaaggtcataatgcagatcaaattatatataaagcacttaacatgtgctcagtaaaaagtcattgatctaattattgttgtactttattgtcattaatatcaagggaatgacagcatagtgagtctcctagggatgcaggtcaatagatgttgaactgctattatgcagcaggtactgtgctaggtcctgggtaataccagagcaaacaagatcaacacaatctgcacctccaggaagcttatggtctagttcagaggtaggaaaaatgtgttttgtttggcctgcaccttgtgtataaacacaaaacatagagcaaacattttaaacttggatgacttcacaccacagtccagatttctggcttctctttgaaaacatcagaaattctgagagtaagggagatttctgtccacatgccaagccttctaagtcccaaagcaccaaccttccactggagagtggcctgctggctcttctcattaagaaaaatctccctctggctacacatgatgaggggcctggaggaattaagagagatgaggtagctgaggacacaggtccaggggaccagaactgaagcaaggaaggagaaaggagactcagcgctggttctctttcacggggtttttttgtctctcagctcagctcgctctgtttggctggacacagaaaaccctggaggagaattctgattccaacttgctctttgcacagttaattatttggagctcccagaaggttggagagaacaatgacttcccctgcagtggcagctggactagcttagttcccttttctgcccccaggggtcagaacccaaggaaggggggctatttgttttggccttaaaccaaatctgcctagagacacagagcgatgctctgacctgagaccacaaaagctactatttcaatgcctggtaaagctcctctctcttgccgtccacagcagtctactgacgaaaaacgcgttttccctatgcaaactgtttacttctctcctttgcaaattggaagtaatgtaaaaaaaaaaacaaaacaaaacaaaaaaaaaaaaaaacagaaagaaaagaaaagaaaaaaacctatatgcacaagaattccatctctccttgcaaataagatatttcacatttccttaggcagatagcatgcagacaagtaggggaactaattgggatggatcagtgaaaacaacgaaagctcatttatacacaacttgctaagtgtccacaactttgttctaataggggatccatgacaagtccctcaaaaacagagaaacaggagagaataatttacactttatagttgtgagccctgtaacagtagaacaaccttcctgcagtcccagagagattgtccccacatctaaccaaaaccattaccatcaatggtgtcctgcattttgaacagttgttaatgaagtcttgcctgacccaatacagagtgaaatgggtgtagttgctgctacaggctgccttctagccttcctgcatctgaatacattttctctgttggctgttctgatagagattcatctggaattcttaactagataaatccctcaatgacaaggtaaggcccatcttctgattaaacttgtattgaatttatttatttggccaatcatgtaatccatatttattaggtaccttttaagcaccaagcattgtgctgagtgacggggatatcaaggtgagtcaaaacaaccatagtccctgtccttagaagtccagaggggctgggtgcagtggctcacacctgtaatcccagcttttagggaggcagaggcgggaggatagcatgagcccaggagtttgagacctgccagggcaatataggaagaccccattctccacaaaaagggggaaaaaagcaagtccagagaaaaggaagctactaatcaaaagatctcacaaatataaaactgaccctctgaaaggtgtataagaagtattttggtactaggaggctctattacaaagagttcgtctagatatggggtggcagataatttgtctcagaagaaacagtacttgagctgacatttaaagccaggggaaaagcatcataggcagcgggaatcaaacactcaaaggccttgccgtgaggctgagcagtaaacataaggactgaataaagaccagtgagattggtgtggagaatgcaaggaatagagtgatgaagatggagagttggtagggaccgtgcaaggccttgtggagcacttcaaagatttccagcaacataaagctatttaaagatgtttaagcagggtataatggtggtagttgatgtgatcagatttacgctttgaaaaaatatagattagagttggcattttggggggacacagagtagatccaggtagatccaggtagaccaagtagtctagacctcctaggtcacaggtgtctaggaggggatggtaatttggacttggatggtatggcgctagaggtgatgtagccacattgacatattctaacaatagttactctggtaccaacccaatataccagagtcatccaatggcccaagagtggtactaactgtaattcctgattctgtgaagctgagtaaaaacatttagaaagaccaaactaaaaaggatctgaacgcatctgtactccctcatccccagcagcaaggtaccaccacgtactctgagtgatcatagctttatacttgaattgacaaattctgcataagactccacaggaaacccattaaataggcagggaagaaaatgctcaccattcagcattgacaagaaagatgataacaagcaagttttcagtcaaagtgggtaaaatgttgaatttctactctagtgtcattagcactgcacctgattttttaaaacaatattttggttaatcaaaactctgggtcaatcaactgttccacagtgacagctcctgtggtcatcaatctttgttatcgcttgaagctgacatggtctcggtccacaggagagtaagcagcaaaagacaaaggtttctcttcatttcccccaaagggagttaagcaatgagtcataaaagcatctaaattattcacatggctttccagaagtttatgattcaagatttgggagagataattgaaggaggtggggtgggaaacgtaacactggatgaacacatttattttgaaaatgaaaggatgagtttctgaggtagacccaattaccacacacagggcttcaggagcgacagcagcggcctatggttccgccacacaatgcttcattcattccttacatgggttcggacgatcattattaacctacagtcacctgagaaaagctcagtgtctgccaatcagtcacactggacttttgtggaaatggaaaaaggaagagagagtaagaagggagggatggagcaagggtatggagggaatgtgaggaaagcacaaggaggggccagaaggtgtcagctggtggaggagataaaatgttttctgtttctgttttacttgtagggtataagaaagagacatcagtgtgaagatatgccactgggtaggggctgagggttgtttgtatgtttgtttgttaataaacgtggcttgaattagatatatggctctccgttttagtatataagaaatacaagtaaaagagttcagctattgtgaaacttcattctcttgccaaatggagtttccttgactgtaatgctccaagactgaaccatgtacattcactatttataaaagctagacatgcatttattgaacctaccagatgtaggtactgtaaccaggcatgattaacagtagaaagaactgaaaaacccttcatgattcagccttagtttaccttactggttttatctcctgtgaattctcctttaaaactaagatcacagttctgtggttcttggaattcacaaaaaaaaaaaaaaatgctctacttcccctctgtgtatgtgagtattctctctgcactgaatgcccttcctccttcatctagcagcactgctcctctctgcctggaattgtctaattcctgccattcctcggatctgtttagacataacttcctcaggatgccatcctgaattctgagctgagtcaggtatcccttctcagggctctcactgagcttatctcaacagtagtctaggtagcattcaatcataattagatagtgtgcaagctttctgatggcagaggctaagacgttatcatgtttgtatccccagcccctagcacaccatgaaacacaaaatgcccaataaatttttgctgaataaataaaaaaatacaatacttgatacccaactccaaggcactttcagtgtagttagtaaagatagaacattttgaaacataacacagcacagggcaatatgaaagaaaataaaaaattaaataaatctgttataagcaacaaagcaggtatttagagaaggcaaagattacttttagctggggtgacaggagcaacagaatcaacgacaattcaatgtgtgttcatgacacaagtcctgtgttagttgttttcaacaacaaccctgtaacttgataatattatccccattaacaaatgtggaacccaaggttcagagaggtaagtgatttttcaaggttatataatcagcaatgccaggatttgaatgatgaatctaagatttcaaaacactgagaatggaaaggtgggtatcccaggtagagtaaaaacagaaacagaaaaaaatgtgcaagtgcatctcagtgtaatgtatgtcctggggattaaaaacaaatcaacttgatataatctattataggaatgctaaggatgctgatcctagcaagtaagctgtgactagactgctgggggccttgagtgtcatgctgaggaacttgggtgctgaggagccattagaagctttggagtagagaaaatgtgatcagagctgaaactctgaaagccttattagagagtgggagataggatgaactggaaagataagaaggaagtttgcaggcaaggtaattctgttggggacaaaaaaacttttcctttatcttcttatgttaggtatttgggggcctgcaaattaaactgacaaaccacagattaacaggagaaaagtttatttatgtgcatatggaagcttacaaaagaagtaactcaataaatggttaaagttagaggcttatacagtcttgcctgggtatccatggggaattggttccaggaccctctctcgccctccatcggataccagaatccaggttcacattccttatataaaatagcaaatataacctgtacacatcctcccgtataatttaaatcatatctaggccaagtgcggtggctcacacctgtaatcccagcactttgggaggccgaggtgggcggatcacttgaggtcaggagttcaagaccagcctggccaacacagggaaagcacatctctactaaaaacacaaaaattagccaggtgtggtggcacacgcctgtaatcctagctacttgggaggctgaggcaggagaaatgcttgaacccgagaggcagaggttgcagtgagcctagattgagccactggactccagcctgggcaacagagtgaactccatctcaaaacaacaacaacaaaaatcatatctagattacttataacacctaatacaatctaagtgctacataattattacattgtattgtttaagcaataatgacaagagaaaaaagtctatacatgttcagcacagatgcaattttctttttttcaaatagttttgatccactgttaattgaacctcagatatggaggggcaaatgtataactaccttagtagggaaaaaggagtgggagaaaagacctctttggaaagaataagcaggtttctacaggaaaaacaatgagagataagaaagtttgtaataatgtttgttcatccaggtacgagtggtctctctgtcttcttcaaggctataaaactcccccagagaggatatttatgatatattgagtctccttcctaggagtaaaagccaccctgaagaaggaatttatgaaagcctcatttcccagaagtttctgctattagtcaaataagagaagctctgagacggttttttttccgcatctgttgaatcccaaatgtcttcagcttaaaataatcttcagaccaactctgggcttctgagtgggtacccgacattaccacctaggagcctagcacaactctccagctccaaaggcactgatgtctgggatggagggaaagggtggattcaagccctactgtgagagaagacaccaacagcccctaacagctgagttattgtgcgtctgaaagagaaggaactaatggtgacttaaaagcattaagccaagatgacagagagatcattgtcaccactaacacaaataaggaagccagtcaggagaaagtactagtttgaagggggaaattttaaacatgctgaataagacacagcaggaaaaatctctaggagacaattggaaacgtggaaccagaaaaccagaaagtgatcagtgcaggaaatgcaacttgggagtcatttgcctaaagccataacttgaagccatagtaaatgtgggtatatctccaaggattaaggaatagagaaagaagactagaaggtaagcaacaaatcttagttaatactcaaatttagatggtctgcatgtgacattaacaagtgaaagatacaaagaattaagattaaagtgcccagtataagtctgacactaaactgggaactttttctatgtcattttatgacgtaggcactacctctatttcattaaaaccaaggctgagagtaatgtatcttgtcaaagccatataactagtagacaacagagatgggatcaaaggcatgttgcctcactcagggaccatctgactcatgccttcatggacaggactgtgggatggagggcaatggaggaagagttttcaggagtgcataggatgaacgtagtcaaaggcaatggggaccgagaagaggccactgaattctgagtcctctgagaggactcacctctcagaaatagttgcagtataaggtctaaaatcaaggcccccatattttgtgctgctttgacatatggagaaattcaggagggcctcaaatgacctaatgacaagttcccctcctgacatggtttggctgtgcctccacccaaatcttatcttgaattgtaactcccacaattcccacatgttgtgggaggaacccagcaggaggtgattgaattatgggagcaagtctttcctgcactgttcacatgatcatgaatcagtctcacaagatctgatggtttttaaaatgggagtttccctgcacaaggtctctctttgcctgctgccctccatgtaagatgtgacttgctcctccttgcctttagccatgatcatgaggtctctccagccatgtggaacagtaagtccaataaacctctttcttttgtaaatcacccagtctccgatatatctttatcagcagtgtgaaaacagactaatacacctcccagctctgctcctgcaaataaagtcccccagccaaacaaccctccctgtcatgtgaaccaggcatggttcctgcttattcctcttattccggagtagtggatttcagtttcctgccagcctgcagaattattcagacaagccgacttcatcctcccatagaaacagggataatcccacccctcttaatactaaagccttcttcccacatcccctgattgctcactgtgttcccaagtgcaactcccacgtggacctgtgtggcactcagggtccttcctccctgggctgtgagtatatgtgactaacaaactgctgtctcactggtccagtgttgttcagtcatctttctaaccctagggtgggaccctttctcaccaaccaggtaagtcgagagtggttagaacaacagaagacaccagagtgtttactgtggaagtaacatgggtgaaatgcttcactttaataactactggctttattacaactgaagaaatctgagaaatggatgattactcttttctaattttatataggaggaaactgaggaacagagaggtgttcaatggatacttagagtgagacagcaccaaattatttttctcactttaatgttgcattgttctcaaatattttttttacaagatcctttccagatgcttctatgagaatcacatatatccagtatttacagaaagccattgcaagcaataaggaaaatccaaaaagcaaaatatgggcaaaggataggaacagataatttccaaaagaagaaataggaatgccaatgatggcataatgtccaacctcactatgaatcaaagaaattcaaacaaaaattacaacaaatatttttgtccctttttggttgagaaagctttatactacccactgttggtgagattttaaggaattggagatgctcatacacagatgggataagtagaaatcagtatctctctgaaaggcagggtagcaactttctcaaaatctttaatggtagtattttatgaaaaaaaaattcattcgtaggattatatccaaaggaaacaacttgtgaaattcataaatgtatatggatgagaatgcttattcattgtttttttataatataaaaaaaccagaaacaatctaaatgcccatcaaaaggggataggctaagtaagttgtggtacacctataaaatagaatactatgcagtcttttaagtggaagatgtagatgtatatttatcaacataggaagatgatatttggttttaaaaactaggttataaagctgcaggtggaagagtacacatattatgtaaaatgtttataaaattttgtgtttttctacgtacacgcataatgagacatttgttgggaaatttgcaaagttttagtattccatagtcttcaaatttcaggtgagtcttactctcttctttagtttatcccaaaggcacatatcagtaatcaggaaataaaaggttgttttcactgggggtgggggaacacatggagaggaatgaataggtcacctcaaaaagaaagcatacttcaggaagaacttacacaaattacacaacatactttgcttttgcacttattttttatttcccaacagataacacgtgaaattccagaaaggggagaatcaattgtgcattcgatttttcacagggagctcatgaaactaaggcttctgtgcagcagcagggccatggagtggaaactggaaggcgactggggtcagtaggtgctggccagtccctctctgattgaaaaggacatgtgaagggtgccaagtgagacctcctctccaagttctcaacaatggctacttttttgcgttttattttgtgaacaattcgaacccacaaccctggatacattccacttgtgtaggtttccccttcagacagcaaatgctgctgtttccaaatccaatcatgagtgtttgctgttggagcgcttggtgtaaggcatgtgtgtcctataaaatatgtttctcaaaacttaactttttaagaaatcagtcactggtttatctcccaattctatcacccagaagaagagaaagatgccaaaacagatcccacagagagtttcattctgaaaaacagacatttaatgtagttattctgaaaaaaatacaaactgtattatgtcactttagaaatttcaaaatagagatctctaggtatcccgttaggcatctgtcgtgctcccaattacattactttcgacagccctaagagaagcaatatttattggcctactaagtctttaagaatgcaaaacttaacccatctggaactagttgtgttgttggctccagggttccttacatcagaacaaattcagacataaactctgggacagttcttgaatattgcatgaaggtgagttgcaggcattcacacaacacagcattgtcttttaaagcatttttataaagcagatccaaaggctggcaaacctttccttcaccataaaggaaatctaggctaaaggggaaaataagaagtttatgaactattaaaaaaataaagctgtggagttagggagttatggattaggttccaatccattaattcttttattctctggcagagctggctgaagatgtgcagccctctggcgggtaacagaaacattcatgtccagaacaatcacaaaaagggagagaaatggctggcagagcagagggcggatccactcatttggatgttaatttatacagaaatctggaattcaataatctcacatcccccaggtaagggagcgatccactctccaatttcatttgggagttctattacattaagcaatattctgtttggccagacatgccattcttctcttgaaggaaattaatttcttgattcttccatctaataatctaatataatcccaagtcagtgctttaagttttctcatgacactactagacaaaataaactctgaagtacctcttgtgggaactcacaagatacagatgaaaacaaaagaagaaagtaaaattgaagagggtgaggccagggacaattaggtattgaactgcctgccctgcctctgacacatgatacatgtgatttgttaagacgattttctatccttaactcttcactaagtagggctgctttacaatttccataggaaatttatttttaagtatgtaaggcctgtgaacaggataaataaaagattacaaggaaaaaaaaaagcagtgatttctggttgtttaaaaggcaactcaacaagcctttcccagcaaaaggaaaaggtcaggatcaataaaagggcctttcctttgggaggagatctgttttcaatttaacaaaaataaatccttatggtgtagtcttctgaagaccaaggaaacatcaagctatacaagggatctggccttaccaggataagaaaacttcttcatttgatattctccaataatatcaaaacaaagtaaactgtacccactttgcactctttctcggccccctgcctgttagtgaaaggccagttaacctgaaaaatgaaaaccagctcttaaatgtaaagatgatactactcattgatgcaatgttatcctgatagtggcttttcagagatatcatcttaagcgtgatatcaacagggggaatctcacatacgagtagaggctggtttagaaaaatcctgcaggatatggagtgtctttggtgacagaagtcatactcttaaaggtatcttggtcaaactcatcatctcttactctttttatattagccgggcgtggtggcacatgcctgtaatcccagctatttgggaggctgaagcaggagaatggcttgaacacaggaggcagaggttgcggtgagctaagatcgcgccactgcactccagcctgggtgagaagagtgaaactctgtctcaaaaaaaaaaaagtactggctcaactactatgatgagaagcttttgggagatactcagtggtaatgtcagccttattttctgtggcaaatctgaatctttgctgccgtaacacagttgttttcaacatttaccctttctacactcataggcacacacacaattttaactgatgaattcatagaattcataaacctgacagtgtcccattgctggaaccttagtcatacccattcctagctcttgctaactataacttctccatttttccttcctctcaagaaagtatattagattgcaaggttgcaagagagtaagagtcttaaccttaaatatgctttcatttattagaaaaaaggaaatcatctgcatccttcagcaatttaaatattattagagaaaaacctggtgggattcagcatcaaagttattctcctttctggcatgacctcctctcagcacttcttcaagtatataaatcctaccaatacctcaaggtccatctactctgtattctgaaaatactccaatctcctctccctggaatctaccaggactctcaaactcaagtgttttccagcagtcaggaaagttagttgcatgctgcaggccaattttcaggcatgtgtgtttactggatgagtgatgaggacatgacaacagaagagaacacgtcctccctgaagggggcagcagccagtcagtcccatcccattgctgtcaggtgggaatgcaggcccatagctacccgatcttccaatgttttaagataagtcgaaaatctgcattctatggataatatctcaacttcaaatgttggctcacttaggatgacaatgactctgtgatctgcattggacccatggaaccactaatttgcaacctctggtttctacaaaacatgaagctgactgataaatgacaagcttgtgccatttatcagcaagtgtttgctatttcacatcatcagtcacatcagtatttcagagagccataaataaatgtataagttataggtaacaaaaataaagcagggctttaacttaattatctttaatttagcttatttaaagtttcaaataacatgtaaagagggcctgagatatttatatttagaaatttagagacattggttaaataagttaaggaacaatgagccagactctgaagtcccagcaaggagggactgtatctttgttttattcagtacctatcaagagtgctaagtacacaggtttgaatggaactgatttgaatcatttaaggaaaaaggttccagacaaacattgcatgcattagaaactgagtatttcccgattaaacatacaccacccttacatttccaaagtgtcagcaaagcattctgttctttggtcaaatcttgtaaaagccacttactcctaaatatttttactttgtaaccttcaccgttccaagttcatctaaaagaataaagaaaatacctggcacagagaatgcattcaaagtgtattagttaaatttcactaaaaagaagtaaacaaaagacaaaaaacttcaatgcatcttgattctctgtagagagagcaccttgtggcttgggcttcttctatcaaacacatacccacacctttttgtcagataaactcatttggtttttcttgtgtaatggggtgagtattgtacaaggtttcaatgccttttttttccaactcacattgtcccttagaagctcgaagtactaacaaagtgcttcaccacacaaaagtgctgtctacatttgtctggcaaatacgatgccaaacgaaaagcctgatgagtctgcaattcgtcatgggcatgatcaagctccaggctgcttccaccagagagcaaattcaacattataaaggaagtgtggacaggaaagccttccagcaagattctcagaatatggacatgagattcaaagactaataaaatgggttggggagacggtattgatgaagaagcagccggagaggaaaaaaggaggatttgagcagatgtctgtcactaaagaaagtgaaagacacagaggaaagagaagatctatgttatcacctgtgatcctaaaacaactctaggaattaggccgcattatccttgcttttatagaggaagaaaatgtggaacagaaaagctgaataacttgtcacagtcttacccagccaattagtggcttaactggagtttggccaggtctttttgtctgtatagcacaaaccttgtgaccacacagcactaacttccaataagtcacccaaaaagtcagctgcatgtaattagctctgctgtgaaactatggactggggaaagggcattgttcatttgttagcttaatttttgttaaaggcatacaagaccaaccacaaaaaaagaaaaacaaaaacaaaacaaacaaacaacagcaaaaaaaaatcagccagagctgtagaaaatcaactctgtcattagtaagtatattttattcaagtatgtgttattaatatatttgagatctcccaaatactaaagagatagaaatttagatacattggagataaacttcaagtaagctattttttcactattgcataaatgggaagatattttcattgaaaataatgttcctttactcaatcacccaatatttattgagaaaccacctgggccagacattgttctgaattctgaagatcagagagtgaacaagaagcaactgactttgttttgtttacagttcagattgaacaaagcaatggcaacagagaaagaaagagaagccatttatggtttgtgataaatgctgtgaaggaaatattttctgatagagaatgaatggaaaacttcctttaggcaaagaggacaggaagggcctccttaggtgattgtgtctaaatgagtcaagcatgtcgagggttgaagaaagggtgctgcaggcagagagataagagtatgctaagagccggtgaggacactgaacttagctcttcctgggaagtggcagccccttgagttggtgcagtgaccagggtggacatgtgtagtataagcttcagggaagaggtgagtagaaaccagccagcccctcatgggtctggtataccactagagtgcgtttggaattaattgtaagcacaagagaaagctgttgaatgattcagtcttcaacaagggaacaacatgaacagattggtggttttattttggctgccatgtgaagaatggatgacacgacactcgcatagaagtggaagactagtctagagtttggaagatagcacttggacgtcctgctggatgcctgccattaccctctggatctgccctccaccctttcctcgcctgttgcctgcctcagaggctggcttacatggactacggcccagggctctctagcttccagttagtttggtcaatgggaaaccccagccagagatcagaagggaggagaaagaacttaggatattagtccctcagcaccctgtcacctccaagcagagtttctcacaggttggttgtatcccaccacccagggctgctggtccttcaggtggcctctgccaaggggcctgtcacacagctctccctcaggtcccaataaccttccctctcctatgcctctttcctcccctttacccttcaggagttgagtagcatcagaaaacgctgcagctagccccaaggtactgcactctgtcttgtagtttgaaaatgctacctttgttaaactctagtcaaattacccaatgtatggatgccatctgtttcctgtggggctgactgatacaggaagagagaagcaagatactattttgacacgttcagttactgtgatccttgagtaacattctgtttagcttgagttcatataactcaaaaggttatcaaggaaatcttacacccttttacctttttaggagaagcaacaaattcaccaaagaggtaaaatgccaaaatcatgggcgtgcggattcagaaaataaaataagcattagtggtcatcagtatttgatttcaggccaattgttagagctgtcgcttaaaaatttagatgtacatttctcattccatgtttcatttattcaatcaatgtttattgagtgcctactacttgcaaggcactattttatgaactagacatagagcagagaccaaaacaaaatgcctactctcttggagcttacattctgggggagaatcagaaaataaacaactcaatgatatcttatgtgcttataagaaatggttaacaggaatagagagtgggagatcagcaagaggactgctgatttataaaagacagagtaggcctttcttaaaaggtgataatctgagcagagatctaaaggaaaagatgaagcaagctacggcgatgtccagggcaagtgtgttctgggggcggaaatcatgagatgacgaggtgtgggtggcacttttgagtaccagtagaaggccagtgccactgtagcagaggaagtaaggaggacattggcagcctatgcaatcagggagacggcagggacaagatgaatagcctcaagaactttggcttctattttgagacaataagtttttatggttttgagtagaacagtgataggaattgatttaggttcaaggggctcattctggctactgtgttgcaaataaggtggcaaggatagaaatagagaacacttacgcaaaagtctagagcaaagatggtgacttagaccagggttgtagcatttatatttgatatgccatttaaatatccaagggaacatgagtaggcatgggatgtgtaaccgaagtctagagttgaaagaagaggtctaagctagagatagagatttcgaaaacatcagtatttaaccttgacagtggatgagattttctaggaagtgaggagagcattaagagacaagtttttaaggatggagccctgagtcattacagattgacagatcagaaagaggatgatgaccagcaaggagaccaaaaaggccagtgtggttaagtgggaaaccaagagggtgtggtgtccccaaagccaactgaaaaaaaagtatgtcacgaaggaggaagtgatcaactgtatcatgtactgctgatagatcaagtaagaatagaactgagtagaaaaatggatttggcaaccaaggggccatggatgacccagacaagtgcattctgagaagcggtggggatgaaagtgggatggagagaacatgtgcaggcaactcctctgatgttctttgctgtaaatgggaagcagagaaacgtgggagctggaatgaattatgcaggcttctttctttttttcttttcccttccttccttcctgctttccttttttccttccttcctgcttgcctttctcccttcttttctttcttccttcctttatctttctttcttttctccctctcttactctctttatttcttttctttatctctttctctttctttccatttctctctttccttcctttgttctttttctctctcctttcgttctttcatctctttagtttagagacactacagcatcttcatatcctctcagaattgtctagtagggagaggaacccaaatgatgcaggagagaacagataattgcggaagccaagtgtttttgtaggcatgtgttgaggttcacggcaccatgaaggccgagggtggaagcagaacagttcagagagcacatggtctaggagcaggtaggctagtgagagcatgtggaggtttcctcctgactgagctttgctcagtaaaacaggaagtaagggcatacacatagcaggaccagcagagagaagctattggagatctgagaaaagggtgggaaatagtcatccagggcaagtgggtggagtagggtcctgcagtaggattgctgagcagtgtgttgggctttaaactgcctttcatatgaatccacaaatcctactaatattaatgaaagatattaattttcatttttcctgctcccgtcagcttaaaacgaaaagtttctctacttagcccatgaggagtcagaaaagaaaaagtaatgcccagcaaatttctccttcctaagctagaaaggaaaaaataagatattcatgtaaggaaaataaagaagacatggcaacttgaaattatgaagaaattccaaatgttgcatttggtagtgttcttaagctaccataagagatcttcattctattctgggtagggagaatgtacgtggcagttgctaggaatgatcctttgcccgtgatccttcccatgtggtaccccactgtccccaatagacctgagtggcacaaccaacaaaacaacattcaaatatatggaaatgatctttattttagactctttctcatttagcctgttgggctccgagaatgtgaaaaataaatctgaagccttacttttaatagctttcttataaattatccccagtatgtaaaagcccagctcctagatataaccagaagaagggggaggggggaaagactaatgacctttgacattaaaatttaaaatgtcctgcatgcaaatacactttcctgccactcttttgtaatgcaataaccagcaagaattagaattgcaaaaattccaaaagagctacatggaaattatacaacaaagtggtttcacagtgatattgagaaaggaatatgaaatgaatacaagataacatagagacagaatggggtgttacagatgtatgagtgaacgtgcgtatgagcacatgcatgtctcagagagagcaacagataaaaaattatttctttttttatgttgctcttcatgagcaaaattttaagacagacactgttctggtcacatttcaataatgtgacacatggtttctatttacattccaaatgagttttcactaaatgactttcgaaatatttacttgcaagtataaaggagaccctttgaatgtctgatttgaaaaaagaacaaaatcaagcaattatcaacatagatgttctaatacaaactgacactattttcttccatgtcttttttttttttttttttcattcctagacaccacaaaagaccaatgctacagatgtctctctttcggctttaaatacttcaactgtgacaatgatagtgagacagactgcttcaggccctgtagctaggacataataaataattcaaacaagttttgaaaaatcatttggcccatataatataccagctatccgaacatttaccaatgcccgccccctcccctcacacctcatccttattttcattttttgctgcttccatcagcttaaaatgaaaagtttctctacttagcccatcaggagtcagaaaagaaaaagtaatgcccagcaaatttatccttcctttgctaccggcttccattaaattgaaggtgacttcacattgatcctgggttcaattcacatatccaaagagacctcagtgattaacataaagggcagtccaatcaaggatagacacctccatgtgtgtatggtgagcaatttggtgggatgtaaaacataaatgatgtagcatcagaacacctggtgtggatgatgccaccacttgcctacccagttattctccacttcttgccctgagtttttctttctctctctctcttttttaacttagataaaaaataatcagcttcttaacctcccttgcatctaggagtcatcaaaaagatatcggttgatcaataagatcaataagaatttgataggcagggcttccaaaaaagtctgttgaaaagggaagactcagataacacagtttgttagtgtttgccttttgcccaagatccttccctctttcttctgcctgtgatgcccagggatggagtagtcagtttgtagcctatgaggacaaaagtcccatggcaaggcataaccatgcagaaagatagaaggaactgtgtcccgctggcactttgaacttcttgaggcatcttggggaaaataagcccctccttggtctagcagtatgtgacagttaatttcaggtgtcaatttggctaggccatggtatccagatacttgttcaaacatatctggatgtcactgtgaaggtaatttttagatgagattcatcattaaatcagtagactttgagtaaaacagattaccctccataatgtgagtgggcctcattcaattagttgacaattagttgacagtcttagaaaaagagtagcatcccccagggaagagggaattttgccagcagtctgcttttggacttgagtggcaatatcaactgttccttgggtatttattgtgttggcctaacctgcagattttggactgagatctcagccttcataatcatgtgagtgaacggcttaaaatcgatcatctctgtctctctctggagaaccctgactgctacaccattacaccattctaactgggtttctgttcactgaaactgaatgcaattctctctgacacatctgagatcaccacttcatacactgtgtaactgtgtaggtgtctgtgaccctcagcttccagatctacaaaatgggaatatgagtactcctgactccacaggcttgttggcttacacacgagacagaatgtgtaaaagtgctgtgctgtgttaagttacaaagcccaatcgaaatgatagggatcattatcatggtgggctcactgtcaattcacgactgtaagtctgttatgattgtattcacttaaaataataatattcttcaaatctgaccataaaaagtcattatagaacatttgaaagttcaaaaacgcatgaggaagaaaacactcaaccacctccatcattccatagctactgtcatctaccaatacctagcatttattgagttattatatagcaggcaatgtgtgaagcaattcaatgcattatctctaccctgtgaaggtaggtactattttggtgcccatttggcatatgggtgaaaacttgtcaccggacatatagctagtaagtggcaaatccaggattcaaacccaggtctgaattattctaaagcccatgtatgtatccagcaacacatggcgatgagctgtgttctttaataatgtattggctactacaaaattggagtgtgatcaggtaacccttacatcaggaaaaatggggtatgcacattgctcagcatatacacaaatcaagactcatattacaaggctgctagctctcttgtcagggataacattttaatttgaaatgaagtggaagaatgtttcatatcagctactccggttaacactgctttttacttcagataaagatatcccttctgtcaggcaccctgaagtttttctgtaaaaagttgtgttcatttgtttcaaactgcccatacatccatggtctcatttcattttccctatagcccgctgagttaagaggggcaggtattattaactccatttcacaggtgaaagaactgagccctagagaggttaactaagttgcttaaggtcacacagcaaattagtggtacgacggggattggaaagcctaacgcctgacatccagcgtggtatgttttccatcatgtagtgctccatcacctgtcactcccaccattcctgaggggcttggagttgatggggcatgctatcaatttctcagggtaaaactgtcctatctgggtaggaaaatgcacacacacacacacacacatatactagacacactgtaattgcatctgccaaaatggttttataacaatccagtcaaggatacagaaaactcccaggctgcctttcagaaacaaagcccaaaggatcaatttcatcatgaaataggatttcctcagctgtaggtggatgggtaggtggggaggtggatgaactgcattaacaatggaacagtggactgcagggtaaaagctcatttgacattcactgctattaagcagtggcaatgtaaacctggggtagcaaagagcaatacccaggaaaaaatacgaagaaaagtttcaacttaacccttctgtaactttctatttataagtctcagggtattaagtctcattctttagaaataacaaatgcatattttgactcactctgtaagatatttataagaaataaagagcaagggggtattgattaagaaaaaactaggatgagattatagatatattaatatgtgttaatatacaacatataattacatataattaatatataataaatgtacaaatatataatgttatataaatgacatgtcaatatatgaatatatatatttcaagatcatattcttaacctgaaaccaaaaaaagtacaaatagaggtaacatattgcattgtctatttagcattgaaaccaggattttcagatagaaacatttgcctttcctaagctacgcaagccatcagatatttacctcagtggcactggtctcagtgaaacatcttaatgtctcttctctcagttggttagatgaatggatgtcataaggtaaaaagaggaactgcaagatttgaagctcatagaaaaaagactggcactgggaatggcagttaccgggagattgaaacaagaaggcttctaaatatgctgtcaaaaccagcaccagtgacctctcatcaagtgaggggcagcactaaaagctataccttctagaatgatgttaccttgaaaatcatgaggaaatctcaagtgtctttctactacattagcaaaaggaagtttagggagtttagacaccaagagactggaccttctcaaaagggaatttgccacagaatcatagatgttcaaaatgtgaaccaagctttctttcaaataaaagtgaatatcagggcttaaaacagaaagacacatttcatcaaaaatgattaggggcccacgagtgttgactggggaatgagaatagtgggtaaggttagggggaaagccagaaaaaaaggtgaatcaaatatacttacactaaaaatcctggggctccatgtgatccagtcacggtaccttgtcacagagagaaatgtaatcagggatccaggaagttctttacaggtttacttggtgtgatgcttaatattaggtgtcgactagattggattgaaggatgcctagatggctggtggagtattgtttctgggtgtgtctgtgagggtgttgccagaagagactgacatttgagtcagtggactggagagaaagatccaccttcagtgtgggtgggtaccatccgatcggctgccagtgcagctagaccaaatgcaggtggaagaaggtgcgataagctggcttgctgtgtcttctggctgccttctttctcccatgctggatgcctcctcccatccctcctgcccttggacatcagattccaggttcttcagcctttggaactcaggaacttgcaacagtggctcagactttggccacagtctgaagcctgcactgtcagcttttctggtttgagcctttcagactgagccactaccagcttctctctctctcaatttgcagacagcctatcctgggactttgccttgtaatggtgtgagccaactcttcctaatatattcccttatatatatacatacatatatcctacttgttctgtccctctggagaaccctgactaatatacttggacacatgaaaaattattaagaagagatgtctattcttaatgcattaagaatactgtaaaattattctctcctcattgctgcctttctgaaaattcttcatgtggttggcagctgactcaggagcactctctttcctggcacttatccaatggctctaacacccaatctgggcagcctgtccggcttactgtctccatctctccactcttgcttatgtacttcaacacagactctttatttctttacttttatttctgttttctttactttagggaggacctgggagtttaccaggaagctcaaattcttcctgtatagaagctaggaaaatagtgaagattgtgactatccatactcgaataattttatcctataacatctcaacagattttgtctctaagaattctattgtctcaaataaacccagaagttagcactttaacatgggagccttttcaaatggtagagtctcaaggccacatctgactccagagatcatggtgttcctacaacactgagatgatgataggaactacagttgaaaacagatctttctccccacatcaccttgatcaagtcaataaatgttagtatatgccaggtactgggctaggtagtaggaacacagagataagcaagacaagatccttatccctgaagaagtcacagttcagtgtagtatttctaaaattgcattccttagaatgaaagtgacccttgtaaaaataatccatggaccaaataccttttggaatgtggcatgctcaatctccttttggacatttttcatgctcatcctaatgcgaaatgattatataaacttcagttctttactccagcatttcccacatttaactcatcgctgacccatttggcttgcaaaacttacgtcttgaattgagcctacaaatgttaacagaaattctaccattagcttaaaaaacagacaaataacaggcattttaaagataaaataagaaataatgatagcattttaatataaagtaaatagtatttcaaccaaaaggcaagtgaatctgtatgttgtcttaatggagattatatttgtttgctcactacagtttataagaacagagaggatgataaagacaccacaatgatgaccatgcacagagtgtttctatcagcaagcctatattgtgggtctttactcacaatattttatttaattcttacatcccttctatgaagtaggaacttatatttcccattttcctccataaagaaatcaaggttcagagaatttgttaatttgtctgctacgatcatgtgcctggtaagtgatggaagtgagattctaatccagactatttactctgaaaacctagtggctcccaattctagttatatatcccagagaatctactgttaactgatttaaaatgtccattagcagagaaacagattaacaaaattcggtgtcttcacatgatagatgatcagatggctatcagactatctgtggcttctgaacagaaataagaaagaggctttggcaagctctagattagaatcaaagaaaggctttccctcttgttaagcaactcttgttctattgcgccccaacaagagacagaatgtttcaagataggacaccaggtgactgtgtggcctgagctgcccaacctgaattgggtgttgttttatccactgtctattacattgggtgcactcagcagcagctgtctgtatcaaatgaaagtagattacacgggattgtactattaggcttactctggctatccctgttttaacccaaacctaagacttcatggggcattttttatgtagttacctgaagaaggaaaaaaataaagcctactttacagacaacattgcacgataagctagctccagcctgaagtggaccctgaatattataaccccactcaaggtgagtagccctaaaggacattgaagaagaaaaatcccatcagtgggcaaaacttcaaataattacctcttgtggtcaacactgcctggaaaaatagttggcctgaggtattgttccacgttaattcatgggctcatgaatgaggcattaggaagaaaaagaggggaagactgaaagggaagggaacaaatacacagtaaggcttctcaaacttttaccagagtgtgaaaatatctgtctatgtgaatgtagactagaaggtccccactgtggagaaggcactcagtagctaggtaggcaaggcctctttccctgccaactcagagcttaatcagcatattcataaaagctatttagtatctacggtggccaaatacagaggtttgcatgggctgaccaataaggacttcaccagttctggccactgccactcccaaatgtaccacttgctagaaacatcaataaggaaatctgttggagagttagttttttgattcagtgaataccaatgtgctctcccacatttcctctaccttttgtggtaaggtggggccatgtgactagtgcaggccaacgggctacgaggaaacagaaacctgtcatgcctgtgaggggccctggcaaggcataccgcctgacctgcacaccaagtgatgaggtcagagaatgccagattgctctgcattctctgtatagaggaaaattgccccgcaaactgcctgattaatataccaatcctgaatcaaagatacagaaaaataccctgactggaccctccagccacctgggggcatgctgtttgtatggaccccatctatcatagaggagatgaaaatgtatacttcttggaaaagacatatactcaataagaattatttccctgtttgccaggcttctgtgaacaacctcaaatgttttattcaccttgatggtctcccacagaaccttcttgactaagaaactcattttatatgtacatatatttatatgtacatatattaaaaagtaaagcaatttagttggtgctcatgggattccatagtctcacctagtaccccatcctcaacagtggaatggccagttaataacttggctgtggttccagttaaaagacaacaccctgaaaagctaaaggactatcctacaggctgcagaatgttctcttaactagtgattaattatagtgctattttcccataccaagaatatatatgtccaggggtcaaaggggagaggggagagcagtgcctttcaccattacacagaacaaatcactcattttgctttccttaccaggaaatttgaggtctgctgttgtagaggtcttacaactcaagtgaaaaatgcttccaacaatagatatgataaaagaaaaacttcagccgagttaaatttaaaggactttaattgagcaatgaatgattcacgaatcgggcagcccccagaatcacagcagattcacagactccaggggtgcctcatggtcagaacaaatttatagacaaaaaaggtaaagtgacgtacaggaatcagaagtcgggtatagaaacagtgagattggttacagctcagtgtttgccttgtgtgaacgcagtttgaacattcagcagtctatgtgtggttgaagtatggccgctgggattggccaacactcagctattgttacaggtgcatactattaacttaggttttcaattttgtctgttaagctaggttacagttcatccacaaagactcaaatatagaagtatggccttttcaggccatatttagtttgctttagcagatgcaagagtgtttctatgaaattggaagctgaaactgtccagtggacattttggacacctcacaccccactcaaactgagtaaaaagggagttattgtgttgggaggggtcattagtcttgattatcagttgggaaatgaagttcctgctcagcaatggaggccatgaagagaatacctaccatgcaggtaaatcctctggagtattcctgctactgccgtgtgccatggtaaagggttagactccagcaaccccaaatgagcagaagcattgagggtttcctggatagaattactgatggactgtttgttcaagggtaagttagagtatgttaagtcagagcaaggtattataacttgaaagttgaaacatggagaaaaaaaaaaaggagtattattgatatttggtaccaagaaagggatcagagcgaaatttgtctcgcgtggctgcccaatatcctctggatattcttgctcataataatgtttgctccacatcatgaattcttccttttcaaagggaatttcagaaaactcatatcctttgcagctaaggagcaggcatgcggtctgccctcctcttctcaggccacacaagacttcactgtggaagtgagcaatgaggaaaaacaggctatgtgtggacattcatttttccagtataggcagtgagaaaggtatccagatttggggatgttaggataaattgcaataaaattaaatccttcgtatcctagatgttacagtcaggaaaacattgtggtatccagtaagtagatggtgacaattgcctcataagcccagttctaagaaaatgttctgcagtcaacagcatgtcaatggctgttttctgaccagaccagttctgcaacatagttttggacattgttcccaaaagcttagcctcaagcttatttctctgggtctacaatgattcttccaaatgccccatatcctttaataaattccttctctatttaaattagagcccattctattgtttgcaactaatgctcctgaccatattttccttctcccactttcaatacccaggcaaagattgttttaatcattcacaacctaacagttctctctcaggaaagtctaatctagcaatatttttttctgtggaatctgcaacctactcctttacctttaagccataagcagtgaatgaaactgactcctatttccagaatcccacctgcattccttttccaactcaatcttctttcttagcctaaggctagcctatttattgtatgaaatattcttttctgtcagtgaacatggcaacatctttggctaagtcaaaagcctaactcttcatctagctttcaacttggaagcacatccctggacacacctatgctttgaaagtaatatttatctctctctctctctatcccactgttcaacaatcattttgtctgctttttttgagttacactttgcatatcaatactctttctgaaaactcctccaaagtgttaaatatctggcatagtcatttcaaaacaggaacggagtggtctgcatgttaaagaaggcaagaatgccagaaattgtcccatttcccatgttgatcagtgactgtgtaactcagacacgttgcagaggcctacatggcctacttcctgagaggggggtctcactgccttgtcaggattccagtttaagagcacagggcaagtgagaccactgaatacagtcatttaaaaagtgctacaggaaagtatttaaatagtcatcttatagaagggggtgaaaaagcacatttattgatgcagtaattaaaaaaagatttagatccagtgtgtcaattcccatagaatcccacttagcccccttatctatgtcaaagcaaacttagtttcacatcagcagtgcttctcatttatcttaatgctaaggatttatttcttatgcaaaattgttcattttcaccagcctggaactttaaaaaaattcacattctcttcttcaagaatttttattaagccaagatgtcatcaagctgaaaatctcagacacaattttggctctcttctgcaggaaactcagaggagtgcccaatccaggcaacagcagattagcactggcactgctgacaggttcttaaaagtgttggaaagagaagaacaaaggtggtgtacaatgattgacaaagatttctgctataaactaaagttgaaccaataaatatgtctagactctgccatgactatctgtggcctggaagctgcattcttcagaagaaaaaaaaaaagttgcagttggaatttggaatggttttgcccccatgatgtgcacacaggactttgatgagtagtctgatatgcagaagcatccagattatcactgagatagaaatgaaacatccagatgatagattaagtagattgttcacttctcatctatatatatatatatatatatatatatatatatatatatatttgacatcatagaggcataatcaaaatctgagtaggtaaagtcactaaccagaatacgaataccaagttacctgtgtggtttcatggaaaaataataggggaattgacatcatctttataaatgttgtatcaatgagaaaattatgacagtcggggagatctgatctagcccatctgcctcctgtctttagcattcaagctgccaagctagctttgggagacatttactttacagtttaaatgataataacccttccccccaactcaactgcctttgtaaagctaatgagggaccaactgagggaaggagagatgcctggatgctgctaaggtacagacatgaacaattgccagccattattccagagatcacaagatttgcaacttccctaattactcctgcaggcaacatcactattgtagattggccttttgagatactgtttcaggttttttgcatgtctggcacccatggctctacttggacccaccaactgatggttcctctggccagaagcaactcagtgtaagaggacagcttcaactccctatgattaaatctccaacccagccaatcggcagcaaacacccattgcatagccatccctacgccttcgcccaaactacctttgaaaagcccctaacctacaagccttctatgagattgatttgaataataactccatctccggcatggtgtggctagccttctgtcaactaaactctttctttactgcaattccatggtctctgtttgtgtagcaggcaggaagaacccactgggtggtcacagaatttcaaggctgcaaagagtcagactttactcaaatattctaggcaaaaaaaatagaatttaagggttacgatctgcacaatcatggtcaaaatcaaagacacatcgaaacagttaaaacgcaacagttatcccaaggtcaaaaccaagaatatttatttattagtgtaccctgtagctctgtacccaattaagcccaaacatctccctagacttcatctccataatcatatgggtatctgatacccgtcaatgcaattttcttgatcactaatgaaacattccttgttcattgcattagtctttataatcacaatattaaatcattttccctggtgttttcccctagcaacaatttatgagccattacagaatttctgttttttttctatgtcttctctcttctcataagttaaaccattccagtatcttgcaaatgaccagacaactactttaagactttggttgtaactagagcttcctaccaagctatgtaattaagccacagtatctttgctcttctagcttacaagataatcatctgattcccttttgttaaactatttgccctttggccttatagtttattcacttgggaactagattacagtttcccagactatatagctacagagaaattattgtgacttattataagtttaattcatgccaaacaataccagtctgatttctggcttaataccaccttctttcataaagctggaccatcattttgcctttaatcatcttcttgattagtatttttccaagtgtttctcaactcatttcttctatagaattaaaacattcctactggatgggctactcattttaaggatttaaaattttcagtctggatttggggttacacctttgatggatgagcttaaggaagatacgaaaatggcaaaattatcttcatgatgacatcataatggatagaacaaagtaaattttataaaatggtttcacatgccttattccatttgatacttaacagacttgagaactggacagagtagatatagtagttccctcttgtgcacagggaatatgttccaagaatcccagtggatgcctgaaatcctgtatagtcctaaaccctatacatactgttttttccctatatatacatatttatgataaaatttaattaatttattctttttgagatggagttccattcttgttgcccaggctggggtgcaatggtgtgatctcagctcactgcaacctctgcctctcgcgttcatgcaattgtcctgcctcagcctcccgagtagttgggattacaggcacctgccaccacgcctggctaatttttgtatttttagtagagatggggtttcaccatgttgaccaggctggtctcgaactcctgacctcaagtgatctgcccaccttgacctcccaaagagtgggattacaggcatgagccactgtgcttggccaaaatttaatttataaattaggcacagttagagatgaacaacaataactaataataaagtagatgccagcatcactacttttgtgctttggaatcattagtaagtaaaataagggttccttgaatataagcactgtgatactgcaacagtggatctgatcacagagctagctataatgtcactaacgggcaagcagcacagacatcacagatacatgggatgattcatacactgggaagggcagagcagggcagctcagatttcactgtgctgctcaaaatggcatgcattttaaaacttacaaattgcttatttctggaattttccatttaacatttttagatcgagttgaccacaggtaactaaaactttgaaacagcagataatggggaactactgtattactatgcccatctttataaagcagtggtttccaaactgtgttaatgcagaccaaattcatgacattgtttcaaccagtgcagctcctttcatattagttttttaaaaaaacacatctaagtaagatcaccatttgaaatgaatagagtgtatgttggcttttaaataaggaatgtttaaatgcccctgatagaggaagaaaccaaagctcagtacaaatggtaaactcacatctccacctgtaaacaccaggtaaaaattgaaggagcagggacaaccacccaagtctccagcctgtgagacagccaggtgaggaggggtccccagaagacctccaactggcctgtgcaccggggtggagcctcgggaatttcatcatgtttgcagcggggaggagcctggcccttccttttcctgtgtggaacctgggattcaagctgtgggcgggaagtgctctatcagggactcaagccttgggagactccctctttcccctttacttctttttcacccaataaaaccctgctcaccctctccatcggtctgtgaacctaaattttcgtggctgtgggacggacaagtaccctgtctttaactgaactatggaaaagtcctgcaatatttttggcgcccaacgtggggactcgagaaggggtaagtgagatgcaaaccaataattctttttccctctcccttctgagtcttctcatccccgtggccttttccttccttttttgggatggaccggcgagcagcagctgcccactgctcctcactccatgccggggctgggacacatggcctaagtgtcctgcacagcctgctggctggttccccgtcactcctggctgtcccagccttccccttccctggccaagggatgtaactctatcagacagtaattaagcttaaatttgtctccctggtggaggaaccacttgcaaagaaatatgaggttcttcctcaggcacttttaaactgtttcttttctttccccttctctaccccatcagcaagttaacttaaatttttttttcttttagaagatgttgtactaggctagcctccacccacccccaacaactgtcagtgtattctctgcaaagtttcggttgtgaaatcaagcctccatcttgttttatatcctgagggcatggctggtaattgtggcaaggatttgtttagcaaagccttgagaggatgaaccctgtaagattcaatgtctgcatgttttcctagccctttctcttaaagggccccacccagcaactgggttttcttctgcctgcctgtgtgtgtactgtacgtaatgtttgtcaagagaactctaattaatacagcctaaagaaagacaagtgcttgaatctaatattttttaaagggaagataaagtctggtacctttcagttcacatgactttaatctttaagaaatagaaacagtcttaaaaactattggtcaaatgcaggtattatcaaaatgtaaataggtaggctaaataatgcaggtcagatgcaaggtttgctaagtgttttgaggttacaaactgctttttgggttttcagaactatattgacttgccagcttcacaactggtaaggcctggggacacacggaactaaccgcacccttaactaagaaggcaaaccttggctgcagttagcacacaattaaagcaacttaacaagttttagtttacagttaaaaattgctaggagttaattgaatccactagaaatagatttacatgcaaggtgtatgagaacagtaaaatgtgtttttcagtaaaaggttataagaagtcatggaaatgtaaacttttgcctagggttaaggattgttttgagttacattaggaaaaagctgaaggttccaagaagtggtggaagaattgtggaaattaatcttgcagaagaggttctctgtgtgaacatactgactacattcaaccaagggtattatatggtttttctgtaaattgagcgttgaagtaaaagcataacgaggttttcctaaggtgctaatcttaatctgctctttggcaaaatttgtaaagggttataaaaggttttcgcttcttcaaaatttctgagtcatcattttgacaaaataaataacttttggtaatgttgacaaaaggagtcaaattctgtaaaatatttttacagacttattgtgagccacatatgagtgaccatggcccgtgacacagccctcagaaggtcctgagaacatgtgcccaaggtggtcagggtatagcttggtttgatatattttaggaaagcatgagacttcaaatatatttaagaaatgcattggtttggttcagaaaggcaggacaactcaaagcggagccttccaggctataggtaaatttaaacatttttctggatgacggttgagtttatctgaagacctgggatcaatagaaaggaaatgttcaggttaagataaaggattgtggagaccaaattttattgtgcagaggaagctctcagatagcagacttaagagagagcaggttataaaatgcttcttatcagacctaaaagggtgcctggctcttagttgattatctcctggatctggagagaaaggaatgaaaacaaagggggaaggggattctctataaaatgtggatttttcccacaagagacgttgcagggcaacttcaaggtatggcaaggaaatatattttgaggtaaaacattttgatttttttccttgttatgccacagtcagattggaaagtaagtcacgatatacagggttaaataaaacccatctgatgaaaatttatggtttgtaagccatgactccccaggctccttagataggaatttgggcaatattaaaaaaaaatcagagcttagtcctcagtaatctggaattccgtttcataacatcaagtgttttaaaccttgaacatttaacagccttcccaaagtcaaacttcagtttcaaaatcgtcttccctggtacatggcttttcaaatacttcagagggcccccgatgtgtccagaactaagagaggtaaacagaattatttgacatgtttaggtacatgggattgccaaaatgatgctcaatcttctttaggttatagctgggtgaataatgccaatatatgttccaaaattgtatgggatttctaaaattctaatgtctgagtatatgctatcaaccataattaaggtttttatgttaagttatagtaaaccacggagataactaaacttctttgtcagtcgtgtttctaattgtaactaccctggaaattttgctattcacagacaattgttgctttaattctttttcagaagatggtttataataagctataggactttgacaggtgctttcaaatacaggcttctgataactttggatattgtgacactgaaatacaggaaaatgtacaggactcaaaagctgaaatgctcatgattatcaagcaaaacaagagttagccaaatggactgaactcaggaagctgaagcaacctttttgacttttgcttggaatattgctaatccatgtttcatttttcagagtcaaggaaacttattttgaactatttacagcctttaacaattgagtaaggtatactcctatgaacaaagtttgaagcgtgtttgtttctctctgcctggttcctctagaatttggaaactatctgtgaatattgttatggcaatatagttgtttgcatcagtgccaataagaatccatttttcttttgcagcaggacacatttggagaaagtagttattttaccaaggttttgactggaatggtatgcttccctttaaggagtcaagctcaacttgcagagccaataaaagccccatggggaaactggcctcatactgttgtctatgcagtccctgtacagggttcctgacctgtggtcagtaaagaatgtcactttctagcaggtccaagagctccaagtttattgtgggaccttaagaggagaggatcacccaactcacaggtatttgaggatgcaaacccatggctaggctcagctttaaaaggtcttatctgtgattccttgtggaaaacatttccatcagtgccaatccaaaaagcctatgtagaaatagttattcttgctgcactttatgcaaataatcaggccaagtgtaagactaaagtctattttgcaaagcactcagtcctaccataatttttttaacaaaaatgaggactggagagacagaaattatgttccaaaatttgccatacatttgtcattaaatgctaaactcattagttgtttttaagttttcatctaccttttagaccaaccctgcttgctcctgtgaaccaagcagcaatctccagctgcagctcagaaagaacaggagggatgggtaatgtagaaatatggatcaatattctagctctgaacaattatcctgcaaaccctgccaggtgatggaataaatagggtgcccattaccaggaggtttcctttttgggaaagtaagaccaagtgaactaaccaaagccaagcatcacgtatccaaatcctggcaagcataactatagctaccagttatctgggtgtgtcacaagacatccttttctctctcttgttggaggagaactgggttccacagcttcactttagcatttgtcttatgataaggaggccatgcaatgccccatccgagatacatttttgtcccagactgaattccaagcttcacatcaaagccttaggaaggaaaatcggatcttagggatccagaggcaaatgacaacagaagttaaaaggcacagcacaggtgagcgtgactgattcctgctgattaagccaaccccaaacttcctgtttcatggataaaggccacgttaatatccatggcataaatgaggtctacggaactccaaggctactgacagcaggggagatagggcatacgtgggtaagagcggatgattcccacccctaggcccccctgcttcatgggtgcaagttgctttaacacccatggtggcacctaccaaggtcactggaacttggggatgcaaggatagaagatggaaagaggatgctcttccctctctacctcacatacctaaggtatctgctggaagaaaagggaaccaggtatgcctgctcccctctttctagatgggtagccattcatcttcagtctgtatccctttcaaatgcatcctgaacctctgggactcctttaaaaggcaccttctttttgcctttcttctcctctgttctctcttcactaataggtaattgtgtctccatactacaaggcactctcctcagatgcatcctccaaactagaaagagttggtttcccaaaccttaaactggttagcttaggattgggctcaggggaaggggacccagaagcccaacgtgccagcaaaagggtaaagttttttttgccagtcaggcttttggcctccctctacgtgtgcaaactggcaaaaggcctcaggatctttgagctgtccttaccctcccttcatttcgttttgatacatagtttctaataacctggtttgtctgttcttgccttcaggccattaaactctaaacaatcatgcaagcagagcctctgacaatggccctttctgctgtgaacccttagatgggcctctgccgtttccccaaaacagcgccccctctcagcaggaagcagttaaggtcagtcttcatccttatccttaatctaaacggcagctggatgtacctctttagagggaggaatgagacagctaggtgggagggggtccccgaaaaacctccagtcagcctgtgcactagagtagagcctcagaaagttcaccatgtttgcactggggaggagcctggtccctccttttcctgtgtggaacctggaattcaagctgtgggcaggaagtgctctatcagggactctagccttgcagaggctcccggttccccctttgtcttctttttcacccaataaaaccttgctcaccctctccaacagtctgcgagcctaaattttcttggccatgggacagacaaggaccctctctttagctgaactaaggaaaagtcctgcaacacctccaacaactaacaattgtttccagtgcacctccattctccaggagggagaaggccaaagcacataagtggagaatgcacacgttagcccattttcaatagtttaatactttaaaaaatagtagtgttgctgactttcaagctttagcatctacacgtgctagattcacttattgactcattaaactattcttttaccaatgagcttaccatatgccaaaaactatgctatactgggaacccaaaggcacacagaaaaactagaagactatttctgcaccagtcaagaagcacacaaatggacactcatgaagaaactatagacccaaagaaaaccattgacaatataggacaaatggcatatcaagtcctgaggaaagagattagtaaggaggttaatattttaaaaaaaatagaaaagggagaaataatgaatcactggaaatggtcccatcaacctgcagttcttcactatttttcaacttaaaattggatacatttatagtcacttgacctctctaggtcccaatctccccatgttcaaagtacatatcctattgctagctctctctactttgctaagtctattgtgaaaatatcacaatataaaatactttgaagccttttagggaagcttaaggtcttctacaaataaaataacaagaagtaccacttggctgaaaaatgaaagaggtaggacaccaatggtagtaaatcacttgtatcactttgttcagaaattatttcatttttttcattttattgaatatagacaaattatagttgtatatctttatgaagtacaaagtgatactatgatatatgtatacagtctggaatgattaaatcaagctaattaacatagccatcacctcaaatacctaccatcgattctcctaactgaatcattgtaccctttgaccaatatctccccatttcccctactcccagcctctgggaaccaccattctactctctgcttctatgagtttgattgttttagattccacttgtaagtgagaacatatggtatttgtttttctttgctagcttagctgacttagcataatgtctgcttggtccacccatgtggtcaaaaatggcaaaatttcctcatttttaaggctgaagaatatttcattgtgtgtgtgtgtgtgtgtatatatatatatatatcacattttctttatccatttcatctcacacctattaaaatggcaataataaaaagatgaaagacaagtcttggcaaggatatggagaaaggggaacccttgttcactactgatgggaatgtaaatttgtacagagctggttcaagggaaatccaagaacatggctgtgaggcaaggaccagatgagggtattaagggactatcattacagtggaaaaattaaccctatcttttttgagagaagccagttacaatgcttgatgctatccctgacacactctctctagcaacaagttccttttctttcggcccttaagtaaggctataagaagaacagaacaaaacagcaaggagatgaataccaaagcactggccacacttttcccctgtgggcctgtcttattccattcatgctgctataaaaaataccacaaactgtgtattttataaataatagaaatttaattctcacagctctggaggctgggaagtccaaggtcaaggtgccagtagattaagtgtctggtgaagtcttgctctctgcttccaagacagtacattgtttctgtatcctcacgtggacgaaggcagaagggtaaacaggcataaagggcctagctagttcccccaagcccttttaaaagggcaccaatcccattcatgacggctctgtcctcatgacctaatcacctcaaaggctccacctcctaatattatcacactgggttgttttttgttgttgttgttttgacaaggtctccccctgttgcccaggctgatgtgtagtggcacaatgtcagctcactgcagcctcaacttccccagactcaagtgattttcctgtctcagcctcctaagtagctggaactacaggagtgcgccaccagctaatttttgcatttttttttttgtagaaacagtttcgccatgttgcccaggctctcactgggtcttatgttccaacatacgaatttgtctgggggatgggtgacacatacattcaaaccatagcagggccttcaataggtcattagagagagagccaaggaacaccagtgtggctttttgcattgaacaacgataagttaatggaagtttaacatagcccacagtctgtagtcagaggtcagaggagtaaggccttacatgctacagatgcccacaaaggagataagaggaagccagaagaaatagaaatttgtttgtcagtggataaagaacaaggccaaggttttcttaaatagtgattgatgaggccctggtttactgtaacagtgtacttgtgattttttaattttgtaaaaattgtcccagtgtgtaattctctgtttatacctgagtgtggggaaatgaattttaaggaaaaagccctatatttcctgataaatcacttctataactaattggttatttaatgattcatctgtgtaaaaagggggactaatggttttaaaataaaatttcatcaacagttgtctctttcataaggtttgaaaacaaagaaaatggagatgatgatgcaggtgtggctctttaacagaacccacaggggagcacacaggctctggggagagcaaacaaggcaagggctcagaagactaggttctaatcccaatgcccctttctcccggatatttaatcatagtcaaattacttaatgaccccaaagtacagtgatttccttaatattttacaaaagaataaaagcactatggacttttcttcaaacagacatatcacccctggcctcaggagtttaatattcagtgactctttggcaggtcgtgaactgcccatcagtcccagtggttgttatgaatgtcctctgctcatccatccagatcccctccccatctttcttcatcctgactcttcctgggagggtgatcaatatagacctgccaataggctcctgcaccctctagcttctaattgcattctgtccacgggaagccctggtgagagttacatcattccaggattgggagcaacctgtaagaggccccggacagctgtgtccatcctctgaaaatgaaggctgttctcaggtgacctgctctacccagatctttttccttccaggttctttttttttttttttgagatggagtctcactctgtcacccaggctggggtgcagtggcacaatctcagctgactgcagcctctgcctcccaagctcaagtgatcccctgcctcagcctgctgagtagctgggactacaggcgtgccccaccacactcagctaatttttgtccttttagtagagatggggttttgccatgttggccaggctgatcttgaatgcctggcctcaaatgatctgtctgcttcggcctcccaaaattctgggattacaggcatgagccacagtacttggcctccttccaggctctgataaatgtttcttcccctcatctcttaaagcctaggggaggttatggactgaatgtttgtgtccctcacaaaatttatatgttgaaatctaatcccaatgtgatggcatgaggaagtagggcctttgagaggtgattaggacatgagggtggaacccttgtgaatgggattagtgcccttataaggggctgaaaagaccagaattctaccccttcaccatgtgaggacacagcaagaaggcatcctctattaaccagaaaatgggcactcattagacaccggatctggacttcacagcctccagcattgtgagacagacatttctgttgtttatgagccacctggtttaaggtgtcttgttttagcagcccaaatggacaaacacagggaggtaagagcccctaccagcccctgtccaccagaaagatggggatctgaacagaagccagaggtgtaactggaatggactcaggtgttttcctcacagagcagataactaaagctagaattcttgataagaaaaatgggataaagaaataacagttgcaaaggtaagaagcagagacagagttatagtccagaggccaaaaggataattttaagaagaaggagtaggtctgaaagtgatgactgagactagcccttggctgtggtgattaagatctttggtgacaatagaaaatgtaacaataggagtggtctgttgtggtgatagaatctgcagaccggtggaagtccatgggcccatttaccatgccacaggcaaagagtatattaaactcccacgaagagaagtgcctctggattcattttgccaacattcactgtactgatattagccatggacttgcagagggtttatttactattgcagcctggctctctgctgtgtctgaaagttgaccttggtgtcctctaagttttatcccagagaaaaagacagcaattgagctattccccaggcacagggggcaaaatttgaaattgacataaaaccaagattccctgtctgacttgggcctctgggattgtattgctgcatcctgtggtggcaaaaagagtatcctgggcagtaagtgatttcaattccacttaaagcaacaagtatttgctgaaaaccaaccatattcttagtaagaagatgggtgctgtaggagacagagaattaaatgaaatcattccttccctccaggagcaaacagcttcatgctagaaataaagctaactcaaatgcaacaaacagaagacacacacacacacacacacacacacacacacacacacagagagagtacttttcaagattagtaacaaagagattatctacagagataaagacagaagaatccaatgtctgcatgttttgttattcatgtgtataagttttctaactttcctacattcagtgtgaattagtattgaaatcagaataaaaaagcaatatttttttaaaagcctaatttttagaaattgatagtaaaaaatgagacagccctgggctgaagtcccaggcgtccttcttcctaacaacttgaacttagccaagttgcttaactacttggtgcctaaatgttctcatttataaaactgggaagatggcatggagaggcaatgggcattttctggcaagaaactaagaaaaaaggccataaccaataagtaacttatggaaatgaaaaaatcttttaagttttataatcttgctttagttgatatcttaaaacaaaattttgaaagttattaagtcactcataaggatttcaggaagcactgcagtgtaatatgcttaagaatggagatggttcaaatgctagctcggctacttagcaatacctgtcctcaaataagttatttcaccctacctgagtctgttacttcatctctaaaatggagataatcctaaaacgtacctcacaggaaccttgtgaagataatgcatgtaaaatgctatcacagtccttggcatggaataagtgtctaattaacttttatatataattataattatcatctaaaaagtttagtggtgtttcagacaaatctaagagaagataagcatgaataggtatatgtctttttcatctttgtatttcaccagtgctttgcacagggcctgtcacaaagtagggatctgagaaatacttgtgaatgaagaatgaatgaatgaatgggctgattttcctatttgatcaaaagccacatccatatatgactaaatctgagtatataaaagaagataaaacttgtgtttcaattcaatctagtgagttaaattaaaagaagaaagggaggaaggcaaattaaaagaagaaagggaggaaaagaagcaggaaagagggaaataagacaaaaagaaaaaaaaaaaaacaaaacagaagttggccaggagaaagggtgtctccatccttaaatattttactccttattgtgtgatatattattttgtcagcttcttctagctacaattcccaaggaagggatagagagcagcagcttccaagtaatgacccatgtgggtataaagagaaatttttatcatattagaaaaaatatatttatatacatgctaccaactttacctagaagagaagagcaagggattggaaaacaaattagcataaaatccctgctccagctttttacacatacagatgttttcctgcatatttatccatccttctgagcactgctcaaatgttacatcctcagagaagctctcctggacccctcatcctgggctggatactctgtcacatgctctaatagtgtctgatacccttccactagaacagggatcactgttgtaattaggtaattatttgggtaattaattgtttaacatctgtgtccagtgtcagtatgcaagcaagctccatgaaggcagtgttcctgtctgcctgttcaccccaaaatcaccaacacttgcatatgccttgcatgaaacaggtaagtgaacataaatgtgtataaggttggcatccattctttgtgcattctgtgtttgtgaatttgcccactcaataaaatgcatttgtaacctcaacatcgatacttgccacatttctgtggtcatttttgggcatcacagagaagtgaaaaatttgtcacccaacatgtacattccccaagtgaagcagaacaaagcaaagctccaccttcttgctccatctctcatactgtaaacaagggtctttttctgatctattaaatgccaggttgttggggtgggttttcttttgcatttttgtacataatggccccaaaagaacagtgctgaagtgctgtctcttgttcctgagtacaagaagaatatgatgtgccttacagaggaaacatgagtgatagaagcttcattcaggctcaggttaaacagctcaggctgtgtcccatgacttcagtgttaatgaattagctatatgttaaataaggcatctttaaataaaagtaaacatttaaaaagtttacatattaatcaattaacaaaaatgttgtgaagaaacagccagtagcacgtgcctgtagttctggtttctcgggaagctaaggtgggaggattacttgagcccaggagttcgaactgcagtgcactatgattgcaccactgcactccagcctgggcaacagagtgagaccctatctcttaaaaacaaaaaaaatattgtaatcagaggctctcaggaactcaaccctggatttcccctaggggcaatggttcattatttgctaattcagcgtttgtggagactttatacaacaatttcctatgaaaaatcaggatcaactatatatatacatagaatgtatatgtgtatatatattttacatatttgtgtgtatacatgcacatgtgtatatatgtatgtttagtagtttttaaccattttggtgttatacacctgttgtaaaaatttaaggaagacgtggatactaggggctgagggttgccacaaagggaggtatgtacatatatacagccctgtgctatgcatctccagggcaggagacagggtgttgacattcacagtatagcctaagtgaatattcctactccatagaattgttcagtgtggtgacacttcatgcaaataaatacatgtatacacatacacatttgcataagattctgggcatttgtggcctcctatcgtgtacctcaggtaaaaatcctgacagagaaataatagatacacaaatataaatatatattatatatggcacattcaattttacttcaaatgttttacataggctaaaattgaaactaaaatgctttgcatttcagccaccaccaacagggactagacaattccaaaatatatgtatccccagaagaaagataatttgttgtgaaacactggctaaagacattccctaaggtaaactaaacacaggcagaaaactgagagttgaaaaaaaatatatacatatatagagagagagatgagagttgaatatctatatgtatatatagatatgtatatatagagagagatgtgtgtgtgtgtgtatatatatatatatatatagagagagagagagagagagagagacagaggagagagagagcacaacaagaatacgaaggttggccaggtgctgtggctcaagcctgaatcccagcattttgggaggccaaggcgggtagatcacgaggtcaagagatcgataccatcctgggcaacatgatgaaaccctatctctactgaaaatacaaaaaattagctgcgcatggtggtgcacacctgtactcccagctactcaggaggctgaggcaggaggatcacttgaacccaggagacagaggttgcagtgagccaagattgtgccactgcactccagcctggcgacagagtgagactccatctcaaacaaacaaacaaacaaaataccaaggttaacctgccccgtttgctttcctaagagtctaagattctctggattctcaggtctgtatggtgggcagcaatgtaaatttaagcttctctgacatctaagttctttggagacagtaactattaaacacctgactctgtcccttgaataacagacatttcttagtaaagcttttaattagatctgttggttgaggatgaaaatagaaagacaccagaaggaaaaaaaaaattcatccctgtaaatggtcctgtggaaatagtaactaaaacaattatactgttaataattcaatgttggtttaaaactatacaattgtgagttatttatacagaccagagttggcatgtgttgtaccacaggtggatgtgaggtcaccaagaaaccacttcacagttttcccagaagtgtagcgtcaaaaaggtcacttgtggtaaaagatcttttggattagtcttttaaatcaatgcatgaattaaagacaatttacatataaataggctaatactctggctttgaaattaaatggatttttaaaagatttaagtaactgcagaaaaggtcagttaggcagtaagtgtacataatgtgattcttgaaaactgctgtcttgttggtttattaatattttgtattcattgtcagtgttgttctaaaattgtgtgcataattagcaatgcaccaaagtcaacggcaggtcccaaaagtaaggaaagcggaatttacaaatcagtgaaggaaggacaagtctagatttggacatgaaaatagtcaaaattaacctttgcctatatattaatacacattagattcaaatatgtcacaacatattctaaataagcatggcatcactcgctccagttaaatttaccttggcatttagcctcactgataaattttcaactcttccaaaatacaaaagctgcagtagtctcctgagttatcacaacaggatcatgattgtaatttgaaatcctgattccccttttagggaacagaaacctgcagtttttccaactgtaatgaaaggatagagcgaaacttccataggatcaaaccacattccattaccaccactcctctgaacattaatgtaccttaaaacatattgaaccataggatgaatatatggagcaggggcatttttaggagagtgaaactattctgtatgatactacgagagatacatgatgttacatacttgtccaaacacacaggactatgacaaaagattgagtcctaatgtaaacgagggatgacttcagttaacaatagtgtagcaatattggttaatcaattataacaaatgtgtcaatccaatgcaagatgttaaccataatgaatactgtgggcaaagggaggggatttgtgggaaacctctgtactgtactttctgctcagtttttcagtaaaactaaatttgctgtagaaaatcgtctgttttttaaaatagtgaaccaaatgtaataatgcactcaaagactctttttagacaaatggtttataaactatattcagaggagccctagtggtcctttgctggccatttggtttaggagtgtttgggaaaatagagtaggagagaagagggaacaatgaagaaaagactgctcaagctggccccttatctttcacccctgtttcaaacaaagcaacaaccttttcacctgtacatattgtttctccacattggagcccagtaaagaagggtttctcagctaaagagaaaaaaaaaacatgaaaatcaccaatgtatgctcaataaagtatcttgctacataaatcagcaactcaaagaagaaaaagttaaattataaaaaccttgctaataatgtacactaattccctcagctacttaataaacatttaactaaaactttctgcctgaccattattacttcctatgattgggctaagcataagctaaatgactaccttggaagaactccaactaagaagtatttatttcacatcaacaatgaaccagtactctgttagaacatgcaacatgctttggaaagacaggtgaaatacaaagcatcattccagctgtccagaagcttatcatcttacaggacagagaacatgaacacaacaaaatgcagaaacaatataatacacctgaggcacccagcacccaacttgatgagctaaaaaatagatttcaggtcttctgtcaggtgttaacaaattgtcaactctgaataatgtgagggccagtatgaatgagaacagtccaatccccagttaagccccacttttctaaatcttcttctctctttaaaaaagcaaagtgaatgctaacgtagtctatcagtaatggacagtgtcctcataaaaagacatatgtaaaaaggaggggaagtggaaggtaagcagtgcttactattttatcatattcaattgtatacacacctcctctcaaaattggtgtccccctatcagtagttactaacaagttagttcccaggatcttgcagatggtgggctggtttcagacaaaggcacagtggtccagaggatctggcaacctctttcaggggctgttgggagatgccctgacggcagcagaagcagcctccaatgaggatggcttcctgctcaagacctcctcacactcctcttgcataaataaatgatttagacaccgttttctcctctaatagccagcactacaccaaagagaaaacactccgctattgatgacaggagagggctttttttgtaagtgtgtatgtgtgttatgctataaattaccctgttggtgggtgtaaaaataaatatccatgtatatagttgtgtatacacacacacacacacttacacagagagaatatgttacagttaaaatcatgctgtcgacagccactcaaatctagagcaatttatggctctcaatgcagtcacacattcaggataaagacaggatgataataaatactttgaatattaccagcataaataaactgcctgaggagcttaaacatttgcaacatagccttgctggctcacactgacaaccagcagacctgttgccagtgagcgactgaaagatcaaacatgattaaaaatgcaaagatgctgcacccaaatgacatgctttatttgacaatgaactctggactcagaggcaccactgcaatctatgagcaaagtgctttttggtaattcatttgcccactgaggccagctactgaggaatcacaatacaagtcccttttaaagtaggcacagttctttacagccattagtaattccatcttgagactgcccttcgagaaaacaatttctttttttttttttttactgagaattgatggtttgtgttttgtcaaaatgagccccagaagttgttaagaacttgtgtaatacattagctatgagtagccgaataatggtcttcaagtaagtacaggaaaatgaatggctgtgatgaagatggtgggcaggtatccttttactgaaactactaaagcaggggctgaagtcaggttttaaaaaagattcttgtgaccataagacacaggaatgtccagtggaagaaagccagttctagcttggagttttaggaacaagccagtttccttggtgtctcagtatcatttgattctatagtatgttatttcttttatttacatacatatgacattcatgatttctttttaaatatccataaattcaaagtggaatacaatgtcacaatgtcttaagtctcagaataagatgctgagaagaccatgaacaagtgatttctttttctttttctttttttttttgagacagagtgttgctctgtcgcccaggctggagtgcagtgggcaagatctcagctcactacaatctccaacccctgggttcaagcaattctcctacctcagccaccctagtggttgggattacaggtgcctgctaccacgcccagctaatttttctatttttagtacagacagcattttgccatgctggccaggctggtctagaactcctgacctcaggtgatctgcctgcctcagcctcccaaagtgctgggattataggcatgagccatagcgcccagacaaacaagcgggggtttcttaaggaagggcttccaagaaaaactgcttacagcgtggcaagaagtagaacagggaaaggcaagaagccaagcgagggtgtgattcagggtagaatcctctgagggacgttttcccaccagaggcaaggaaactgggctttcactctcactcaccaatcactctgcagctaagagccatcctgggggttcctaaactccaagcacttccagctctcagcagacctagtgaagccagcagctccaattggtcctgcaaagaccattgccgaagcagccattggaaggtaaatacacagaagctggggcagggctcacagatatgttgaaaggtaccagggcagtgctccgacaccttctgctacagcaaagaagcaaatggtccaaaaatcaaaatgagggtagaataaggttggagaattcaaaaagtgcagaaaaaaaataaaagtcccccttctctcacccccaccttccactcacccttcacctagtccttctttccaaaggtaacctttgtttacagttttctataaatccttctaaggaaaaatatacacatatactatgtatctatttaaacattctttttaaaaatatgcagattggacaactgttccactgttctactccttgctttttctcactaaagaatatatcttgtattctagatattatattagatctatatacatattctaaatagagagatgatagattagacagataaatgcaaagaggaaggaagggaaggaaaaatggatggatggatggatggatggatggatggatggatggatggatactacacttcattgatttaaagataaaacagttttccacattttaacatttctgaaataggctgtcttatacttgacagcattttagatttgctaaaatgcagtagatagatatatagctatttatggatggattgacagttcacacatagctctgccacttgagaagtagtgcaggatagtagttaagagtatattaacacattgcttattaatgagatactttcgtacttgaggaataaggacctcttttgatggggctaatattttaataatctgataaattgtttattaactttaaattttcataatgagtccgtaaatgagtttgatttatagttttctattctgtgctgtctctctcagactttggaatccatattacattggcttcataaaaacacactggcagtttttttctttatttgtgctatgggcaattttgtttacttttataattctttgactatgtaatacatgtactgtgtatcaaattcaaaaagtacaaaagggcatgagtaaaaaagtatctctacctgtcttccagctgcctagtcccttcccccagatgcaatcattgtaatccgttgcttttgcgttcctttagttatgtatgacacatacacatatgcacaaggacacacacttttactcaaatgtcggtataatagacacaatgctctgcatcttgcttttttttcacttcatgtgttttgtagattgttccataactatacacagaacctccacatcctatctgatgacttcacagtattccattatgcagatataaaattaattttaccagttttcatttttaaatagaattaacattatcagttccttgaaatgcaaaattatttgcttctgaaagcataaagacctgtggctttttaagatctttgataactgcttcagatttttccgatgttattaaagttctctttcctgttgaatatgtttgggtaacttatttacctgtttaaaaaatacattccttgaagattttcagttacttttgcaaaagttctcctttgaatattttaatttctttagccatggttctttttcctttttcctttgttttttgtttttttttttttaagacagggtcttactctgtcctctgtctgtcacccaggctggagtgcagtggcacgatcagggctcactgcagcctaaacttcctgggctcaagtgatcctcccaccttagcctcttgagtagttgggactactggcatgcgccactacccctgtctaatttttgtattttttgtagagatggggtttcaccatgttacccagcctggtcttgaactcctgggctcaagccatccagctgcctcggcctcccaaagtgttaagattataggcttgagccactgggactgtctgctttccattttttgtttttgtactccctaactttttgagtaagtgaatttcattgcttggcattgttttcaaggtgtgttagtctgttttcatgctgctgatgaagacatacccaagactgggaagaaaaagaggtttaattagacttacagttccacatgacaggggaggcctcagaatcatggcgggaggtgaaaggcacttcttacatggtggcagcaagagaaaatgagtaggaagcaaaagcagaaacccctgataaacccatcagatcacgtaagacttattcactatcatgagaatagcatgggaaagaccagcccccatgattcaattacctccccctaggtacctcccacaacacgtgggaattcggggagatacaactcaagctgagattttaatggggacacagcgaaaccatatcacaaggagacagtatttgagcttatttatgattcttatggatttatttttaaattagaaaacctaatttcttatttttatctttattatttagttctttctgcattttttccagttttttggctgtccctttcttaagtcagatgcataattcctttatttttattcttttttaaatattcaggtgttaaaggctgtatacattttcttctaagcgaggctttagctgtagcccatagctcagatgtgttatattttcattatcaatggtgtctagatatttttcaagttgggtttaaaatgtttctttgaattaagagttgtttatcaaagagggttgttgtttgtttgtttgttttgagatggagtcttggtctgtcccccaggctggagtgcagtggcacaatcttggctcactgcaacctctgcttcctgggtcaagcaattcccctgcctcagcctccttcatagctgagattacaggtgtgtgccaccacactcaactaatgtttgtatttttagtagaaacaacgtttcaccatgttggccaggctggtctcgaactcctgacctctggtgatctgctcacctcggcctcccagagtatcaaagagttttaaaatatccagattgtaaggttttgataaaactgatttctaatttattgcattgtaatcaggtaatggggactttatttgtacttcagcttcttgaaatttcctgcaatttcttcataacttataaaggccatgtgtttgtattacattgttttattatttgatatattttgaaccacatattttagaggggctttcctatcacaaacatatttcaaagttgtttgcaaaatattttgcattttctaatcaccataagtgaagtgattagaaaacacatcagggcttctgtggctcaggatttggtgcttgcctcacatagacacaaccagtaactcttactcttgtgccaaatgatgtaattgccctaggaaaatgtttctacacctctcttgcccactttcattgaagaaatggtgactgaatctgaatgtcaggaagggttgtgggttgtggatatggcaactgcaaaactgcagacaatagagatgtacactgcttttgtggtagggacaggatttgagcagtggaaaggcataaataagaaaaagagaaattaattcatgattaagacagattctggcataaagaaattgcagtagtagtagtagtagtagtagtagtagttagtgctgaataccgtatctattttctttcatcagaatctgctggttccatttcatagttcagaggtctcacaaattcaggcaatattcacagctgtggacatagtaacttaggcatattttgcattattaaacgattgatgctatctttaaatttaggttgcaacataacatacatgaaatctgataccaagtcttcacattggcaactagatgggcattgaacacaaaactagaaattgttttatttttataaaatatttaataagatttaattaaagtgtcataaaaatccagctacattgaaatgtttgatttaaatgttttttattagctaacccattcttcattttgctttttaaattctaatgtataattttgaatattgtgcaagaaatatgactttcttaaaaacattaaaaattaattttaattttttcaatgtataattaatttatatgcttgaggaaaatatattcaaattgtatacattttaaatacaaatgcagtttaatttctaattctttagatcagggatcagcaaactttttctgtaaagaaccagacagtaaacattttgggctgttacaacgactcttctctgtcactgccctagcacaaaaggaatcacagacaatgcataagtgaatgggagtggctagagttggccctggggccttagtttgcagatccctgtattagatcataactgccaatagacaaaaagtatcttaaaaaaaaaccccttgattataacaacatgacaattttactgaaatgaagatgagaaaaaataacttaattggaataaatatataataatttaagaaatatttcagtcttttaaaaaactcactaaaatgtcatcagcccaataacagaacatgtacaataataatcaagagctgttgtctttgatatttggtcaattttcaatcacgtaaaaactagggcttcacctatacatttagattttgtccttaaaaaagttatctcatggcagaggataaaaaacacttctttaatggcttactagctggatttgttaatttttaaatatttagacagatggtatatggcctcctttttgccctgggccccataaaccttagatgtaggcctgaatacaacagtgatcaagagacaaaggccctactgtcttgaattacagtctagtaaattctagtgcacatccattgactctaatttagaccagtcaatcatctattctcacatgcactactgcaatagctttttttttttttttttttgagactgagtcttgttctgttgcccaggctggagtgcagtggcatgttcttggctcactgcaacctcctcctcccaggttcaagtgattcttgtgcatcagcctctcaagtagctgggatcacaggtgtgcaccaccacgccctgctagtttttgtatttttagtatagatgggatttcacccggcctcccaaaatgttgggattacaggtgtactgtacccactgtacccagcctgcaataggttttttattgctctctctatatctattcttgccctcaccaacctattttccacataacaaattaatatgttaaaaacataaactatcacctctttcctaaaagctcttcaattgttttccattacattccagattaaatccaaagtcttttatgattagtattattatttttgagacagagtttcgctcttgttgcccaggctagagtgcaatggcgcaatctcggctcactgcaacctctacctcccaggttcaagcgattctcctgcctcagcctcccacgtagctgggatcacaggcatgtgccaccgtgcccagctaattttgtatttttagtagagacagggtttctccatgttggtcaggctggtctccaactctcgccctcaggtgatccacctgcctcagcctcccaaagtgctgggattacaggcatgagccactgcgcctggcccaaagtctttttttataacatatgaaatcttgttcttccctatcttccaactttatcttgtgcacttccttccttgcccagtattatctggccttttattgtacttctaacatattgaggcatttcttgcctcgggacctttgcacatgcaatcatctggctacagtgtttctcctttccctactcctttttcggggctacttttttcatttttacatctctgcttaaacattttcacctccaagaagacttgtaagtccattcagtctaacatatatgattcttgctatattctgtcactgcatcctgttcaatttccttcacagccataggaagaaaacctgtaattctatatatttatctgtttacttgtatatttcctattctgtaaactctttgagagccaggataatttttattttgtttatcacttccagtgcccacaatgcctggaaatcatacatactcaaaagatagttgttaaaaaagtaaatgaatatcaattcatttgttgaacaaataaatatgaaatggataggcacattctggacctatcgaaccattctagcatgaagcctttattcccagagtgatagcaatatcagggtccccccaactaatgattttcaagcccactcagatcctttattcatgctgtatttccaagctgaatttccttcccccacttctctctgccttctcaaatatttatttctttcactaattcaaacacacttctctcaacaagtctttggtacccttttcagccccaaataataggtcttgatttctacatttattatctgaatcattcactttagtatcatcttacggtgcctaattctttctaaatctaagttccttccatagtgtatgtagtagagaccatgtgcacttaatccagccagcagcatggagtggaaccccaaaacatattgatatcattggcagccttagcctgtgttccccatctgactcttacatcccactcaggaaagcagaccctaaacaaaggcttacaactaggtagtttattttgggaaaagaaccctagataatcaaattgaggaacgagggagagtaaaacaggggaaaagggtatcttaaatcagattccctagaagtacactctgaaatgggtacgcttgtacaagaaattgattgaaatagtgccctcaggagaaacctatggggaaatgagggagtaggatgggccagggaagaagccacggaaagatatggcttcagctggagtccagccatggcccaaacccagagtatggacaagagtatggagtatgaacagcaccacagagttattccccttgacagcttctgttagtccttggctgtggactgcccttgaccaggcataggggatcctctaaggtatttctggggaagttcatttccctcaatagagggttaattctcctgagatgagttcagctgtgagaccttagtatccaacactctaagcagctggggcatgggtgtgttgacccactaatggtggtcttggtaggggaccaacagcatcctctacagagggaaatacaatataagtatacattctcaagtcgataacaactacaggcacctagggctcaacctgctggaatcttccgagaaaacttacatgcttcagatgtatatgtataatgtgcttcagacatgtctaaacaaggcatggaagagattatttatccaccaactcccagtccccaccagtcaggggttattccgtgggttaataactctcttatacttccaggttgccagtctcactcccaaggtggtagaaaatagggatgaaaatagggatgcccaatgccacttaggcaagaggcttcaggtcacacttgccctaacctggtttccacagcgacagccctaatacagaaagggagacaagaggatgtgagatgtgtcacaggaagtgtccaatccactaactacttgccctagatctttggagaattaaataacctgtcctactgctatgcatgacagaagccctaccagtgggggctagttggccttcacattggctcctggccttctcattggctcatcttaggtgtcttgggctatctgcctgatacacattttcagttaggcacgtcatgtgaccttacagaccaaggttatgcaaaagagaaatgaaaattaacttattaatcttatgacagtattgggctctctgtatttttctcagggtccctgacactgatggtattatctcattctttggtgatgattatgtgtggaatgtttcatttaaaaattccagtgttgtctctcatgaaagcctgatacggtaggctctatatacatactggtgatgatcgtaatatgtgtgtagcacaaagtagtccctgaacaacatttttaatggcaaacagtgattccttcccccaacaaattaagtaaaaatgataaattcctacattgaaagaaatcggcaaaacagaacatttccttcaattcacataatcattaagaagtatcattcataaggggttagaaacatataatatccaaccttcctgtttaacagagcccagcaaggactcaaatgcacagttcattactgtcattatgagagaatttctgccaacaagttacagtcaggttactatcattcaatcatgttgctaataggactaatttcatggtaattggcatattctagaccagagaagaactcaaatggttgtggaatcattaatgatttatgctttcatggtaaaaatgacaatctattagtttaccagatgctggatcaagccatgggccattaacaggagggtgttctcagaacgttttcagaacaaataccagctactttattttcagcttgcagacataatcacatgcatcccctatcagatccaccactatactgtcagatacatcataaattaaaggctccatgggctcattattggctcttattcgtaaaagcaacacgttgccctggcaagacccaaaatattaaatgggcatttaaagaaactgcaaaatgtgtagttttggaaaaatgaaatcttccttaaaactatttacagtactcaagttttcaaaatgtccttcatcctcgattttgcctcaatatttgtttttttgttttttgttttttaataaaagcaaagaaaaaagaaacaaattcctgccctgtcaggaaagcttttaggccgagtctcttaggaactgggtgtcatttattagtaaacctaatatgctgccttcagaagaacagaggtgccagcatcaaataaacaggcttaaaaaaaaaaattccaggaaacttaatgtacactacgttagtaaccaggacaactcttgtttcccagcaatctatggcatagatacgttggtatgagataaagcctccatctttcctgaatcttcaaaacaaatgtaaagctgattaaaattcctcttctgtcttgcctatgtacaaggctgctctcccaataccaagcaatcctatttggagacaatgggatgtttgccaaaccaaaccgaaataaataaataaataaataaataggagagtttctgttttcaactgttgatggcatcacccttgccatttgtggtgatcagattatccacctagaaagtgtaagaaaacaagtcttccggttagcacttactgggcaaagggctgagtttcaagaatcacaactgaaatcggtggggttgctctttgttaatgggaaaaagcaccatgttaaagtgaccagggcctggtgtgtgcaccgcatgatctgtgagcatgagttgtgtgtgcaacatgcttcctcgtgattaccgcctatacggacagtcactgtgcattagtgcattggtagccagccgccgccaaaaacaggatggcattcttccatcgtgattagaggttttgtgagcattttgggatgggggacactttctcagtaaagactcttccgccccattcacgttcattcagctctttctaggggaaattaaaagctgcagtgataatcccttaaggacaacttggaagagtataaaaggtgcagtgtataagcaattggatgagaaagccttttatgtggaaagttactgaatgggtggctgagggtggtgtgagtggggagaaagaggggcagcttttcttttctaaggtggggagcagcggggatatcatggcacttcagttccctttaatcatccagattcctacgctgtccctgcccctggtgtcaccttgttttgcagtgccagctagctcctccctgccattttcccctcaaagagggagaggggagcaatgcgatttttggtaaggacccagtttctcgctgaatgccaactcagccagctggcaccgaacaggccaagccttcttcagaagaggttagcaaaatccaaattagcatggtccattttaaaaacttgcttttatttaaagactgattcatgacaaacagtggctcccgtactgaggtctggcaccccaggggctggcatccaaccaaacacatgcaactaattgccaccctcggatgacacgcaactaacaagctccattttgaggcagtagattcactaagaatgtaaccccggaaggcagcggaggcagaaaagctcctttcataaccctgtcctaggctaaccatggcagcagagagcctgaaaaacacttttgtttcattgcaccaacaatttagctccacggagggctacaaacacggctaacttgctgaaaagtgatcaagggcactgcgatccccctcatggttataggaggcaggggctctgcttttctctttgctcaaggaaacacacaaaattgcctactatcttgaaactccgcatcttgcaccatttgcaaatctatcgacccccagtacttccccttatactttagttcagatgctctcaggcttcctttgtacaagcaagggctctggagccaggatgcctaggttcaaatcccagctccaccattcattagtaattggcaagtattttaacccatctatgcctcagtttcttcatctataaagtggagagaatattagcacctacattactacgagtaggaacgagtcaatgtaataatgtacataggacaatgcctgacatatcatcactctgttatgaaagctctttgagtctgagatagctcggccttatgaagaaaaaatttccctttgcataagctgcattttagtcaaagttcttgcttccctgtaaacttctagagattcaacctctaagcctttgtttaccattctttctcctctcaactgtccttcctccattgcacagccctgtatgactaaatctcatcatcctccaaaaccattcttcaatgccacctcctccgaggagacttctctgccatcccagctgccatgaatccctgcactcttggcatggccatggcaatttctgcaaacaaatgactgtgttttacttgcctgttatatttccttttctagactgacagatccttttgagcataatccacgagtaactagcacatagtagatactcaatgaatatttggtaaagaagtagatggtcagatgaaagaattgctctgcataaatgagtagctttatactatggttatgctgggcattactcaataggcaggatgggggaatcgtttcttaaggactttcatagttgctttggcccaaattaagagttgtatttaacttgtcatcaactgaggctcataaataaaatctatcaaagaaatatgtcaattaccaccttagtcagcttgggctgccataacaaaacaccaaggattgtgtggcttaaacaacagaaatttatttctcacagttctagaggctgaaagtccaagatcatggtgtcagcagattctgtttctcctgaggcctctctccctggcttgcgtatggctgccttttcgttcaccatgtcacatggtctttcctctgtgtgcttcctcccctagtatctcctcttcttcttcttataagggcaccagttgcattggattaggtcccacccttatgacctcatttaacattaattacctttatttttatttttattttatttatttatttatttttgagatggagtctcgctctgtcacccaggctggagtgcagtggcgcaatctcggctcactgcaagctccgcctcctgggttcgtgccattctcctgccttagcctcccgaggagctgggactacaggcacccaccaccacacctggctaattttgtttttgtatttttggtagagatggggtttcaccgtgttagccaggatggtctcaatctcctcacctcgtgatctgcccacctcggcctcccaaagtgctgggattacaggtgtgagccaccgtgccctgcctacctttaaaggggtaattaaggttacctttaaaagttgtctccaaatacagtcacattagggattcaggcttcagtgtatcaattcaggggaatacaattcaggccatcacaatgacatatacatatagaagcatgaatattctgtatattacttaagtgcataggaggaacttaaccataggaagtccacaagcctttgctccttaagtcctggcatccagatcttcattatgttagcaaaagttcagacaatggaaacaaatgtggcactcaaatacacaactattttatctagatgaaaaattaagctttctttggaatttgtgggattcagttggggggctcagttgcttctctcttagaggcaggaaaacatcagcaccccaggcagcagccacaaccctgtctcctgttaaagccattgcctctcccaagaacaaatgcaaattcccagctaaactcctgtgcactttctaggaggaggctcactttggtccttctaggatcaatttatctgaatcttttcttttgaaggcggacctgcagctttatgtagccctgaaactctgaaccagcttctcatgccagcaccccttctttagtcacttcataattcaaattgctgttatcagcatacactatttgtactgatttgactttttcacattgttttaaatcactaatttcctattaggcagattcctcacatcaataccataagctaatggctcccatggtatttgttcatatctttctcttaagatacttaacactttttacctggtaggaggatgatttatagtcatatgtgtctttcttgccagaccttttaactacttaaggttagaattgcatcaaacccattgttttatcccaaccagtgcttaacatgatatggcacacgtagcagagtcacagtaaaagtttgctgtaattcacatagactttgccaggagtgcatagaaggattaagcatcagaagcaatgcaatcgcaaaggtatctcgtaccatcaaggggtgaggccaacatcttagaaaattaagatcaaatatcatccttcatttttaatttaaagcttctagccagttgacccagaaacatcccacacctccaccatgacttaccaatttgtctgaaataataaagaggaaaatgagaggctattagcgccacttccattctccagtcaatcattgttctaaattattaatcagttgaagtattgccaagaaattttcaggcctctctccaaaagtgtaaagtagtcattttcaagtgaacaattaactattttattcatctagaagttgtagaatttatagacaagctgatttctgtggattttcttccccccttttggatgctggtggaggtaagagaggtctacatgaactacaaatagtttcctttccatcactcacttattaataactagaatcctgtttaaaaggaatgtactaaaatattttctaggctgaagcaggaggattgcttgaacccaggagtttgagactagcctgggcaacatagggacaccctgtctctacaaaaaaaaagaaaaaaaaaaagaaattaaattagctgggtatggtggcatgtgcctgtggccttaactacttatgaagctgaggtgggaggacgccagagcccgggaggtagaggctacagtgagccatgattgtgccactgcaccccagcctgggcagcaaagagatactctgtctcaaaaataaagtaaaataaaatatttcctgaccagttcagcatttataatattgttcctaatagcatgccactcctgactgatcattgctggcaaaagcaaagtgatcgattgtcaccaccctgtttgtccccaggattaacttggtaaagaagtacagccatggtttctgctttcgtggagcttacattctagaggagacagtgaaaaagaaaggtaaatagacaaatgaaacaactacagcaaattttactaaaaaaaaaataaaataaaaaaaggaaaaaagaggctaagataaagaaaggggaggtgtaccttaaataagatgtcgataaagacctcactagcaggaatcatcctccgtggatcaggagaatcctgaaactggggacctcataggcagtccaatccaaagtgtgaataggccatgaacatttttaaaactatatattcagttctggtcatctattgacctcagagacactagatttccagtggcatccactactatgactgcaattgctgaggggtaattttctgagccagagttgtagcatgcaatttgccttgtcattctcatctgatgctcattaatagtcccaacttttatgtaaggtatgtgctttcaaaggtagtgtgatatgtggctaaaaatattgatttttttcttttacacttttgtttcttttaaaaggaggaaaagtgagcactaatttttttatttcaactgtatcttttgaaggttcattatgcatatattttgataatcttgtctatgagaatgaaccctaggacaattaaatatcctttaattttgagatgtgtagtctggaaatacctacatggccgtcctaggctttaggttcattttctttgagaggctcaaccccatattatatcagatatatttacaggtcaaaaggcaagattgaaacaaatttagtttaaagatcttaactggcttttatttgtgattctagaatcagacaaaacctcactgtataaaaaagaatgagtgttccaatgagctgagcagaggaggtttcctttacagctggaaaagggatgaagaaagcagaaacaaagaaccaaaagcaaattggttgtttccaagttactttccttgtaaaggttaaagcagagggacatccttatcatattggctacaactggtctagttgaggatttggctactagttctcccccctgatttcttagaaggtcagatgaaaaacttggttttggcttggtggccaaaacttcagcatgagtaattctattttggtttggactgttgagcttggttcagtagttcagtccaaaccaatggacttctataaattttattcaacatacacgaaacagtttttgtatgtgagatctgtgaaaaatatttttatacttttgcatttaaaattatttgcttatgtataatttggttaatttaattttttaaattgcctaaaatttcccagtaatcaacatgcagtttcaggaattcttaagaactgagaaaagctaactcataaaatgtctctaagagtagacattttaataactattacatttagtaattaatcacaatagcataaaatttcatttattgacatatcattaaatatgacattgttcagattgtgcaatttctgcatacactgaaatcaaagtagtttttctctctctgttagttctgaatattttcataggcccttgaaaaatacattggccctagtcattagttcctggtacctaaagattaaagaggcaatagaatatgtgtgtattcccaggtcttacatggcactagatagtgggggtcttttccccctaaataaagtggatgctattataaccatgcatgactccagttagacccagatgaatgtaccaaaatcactaccatttaaaaagcataaaaaaccttgccctcaatttactgtgatttgcaaactctcctctgaagtttcactgaaccccacttataaatatcatcttgcttctttagcaaattctcaaaccttagtacataagaatcacccagagctcttattaaaaacagattcctgggccctgaccccaaagaatcttatttaatagatctaagtggagcccagaaatcagagtttttaaccttctgaaaccttaaaggttgtataagcctttagaaaacattagttgatgtgagcagggttgatgataacagctggtaagattagtcttgacttgagctactgaacaactcaagtccatttaggctagtctctctcaaccctggctcatactagaatcccctggggcttttaaagcactttacccccaaggattctgatttcttctgtatgggcattggtattttttaaagctaccatataaacaaattgagaaaccctaccagcctaagggcatttctgtcagaaaggattaacccacacactgcggtgatgataaggcctaacactcctacaaaatgcaaacactgaagcagagatttcgcaagactaaaatccatctggagctcttgattcccagtttgtgtcagcctcaacacacccaagttggccttaacagttatggcacaagaaaatgagcccttccctttagttttcatcagctggcagaatgatttagtagctctattataaaagcaactccattataattacagtgtttgaattataaacaaaacaagaaaaatacagaaggaatagtcctttagtcaaaactgtaaaacagaacaatttctggctgcagttaaaagcaaactgaaatattaagagtaagctctccagccctttgattcttgcctctttcccataggagcgacactacacattttttcaattaagcagtttgacaacctgaagaaacccacagtgcatgatttaatgagcatatactgtgtgcatggtaatcggcaagctgacagtttgctcatttcaaactgacaagagagcactacacattagtagaaaggtttcttgggtctcttttcattaaataagctttacagttgaggaacattccaactgtattggcaaagctgtcactaatggtccccaggcaaccttaactctctgtcactctccaagtcctcaagtcttgatgaagaaattgcttcttaaaaaacaaagcacaaaaacaaaatatagatatttaaagttctctggatgttgtcaggggcaaggtggagctttctgagccatgaatccactggtgatttcacagtacatgaattctaacccagtatgtgctggttcttcatgcagatcactttataaactggaattgtttttagaaataatgcccaaactgttaaattattcaatagtttagaaatgattcagtgtactggaaaaaacataggccttggtgacagagagataggggttcgaattctgactaaaatacttctctgtggccttggtcaaattacatcatttctcaggggctcagtttcctaatttatgaaacatggacaataacatctgctttgtatgaacaagatcgtaaaagtctttcgcacagttactgacaacacaggcatacttaaatagagactagtttacccacagaaattcagagtatggggttttaacaaagctaactatagtctgactgtcctgagatttctaccatgagcctttattggagttctataagaagaaaaacagtaagctaacattcactcacaaatgggattttatttaatcctactaagattctgaattttgggtgttattacacctgtttttataaaatctcgaaataagaagggttcttagaggtcatatgaggaatttctgacattttaacttttctgattacaagaatatgaaactactgtttccctctttgctctgcttgtcagaaaactcgagtgaattctcatgctaaatgtatgtttgcaactctgttagcagtagcggttagcagatttgtttcctgattttctatacatatgttagtaaccttacttaaaatagtttataagctaccctgaaggaagttgagatttcttagctaactagtaagatccataacaagaatccatgtcacctgactccaggctaggacacctcacatataacatggaaatgacatagaaaaccccagaagcaagtacagtgaagccatagcttattgcttgggtcctatgccatgaagatgatcaaacatattagccttctagttacgaggaaaaaatatggaagcttcagggtccttatttctaaaatagggataatatatatttctaagatcattgtaaagatttagagagaatattttcaaaatcagccagtgtggcattcgatacatagtaacattttaaaagtctgaaatgttgactctaagaaataattgtagttctactaattacaagtaaaacacaaatgcatagacccttaaacatgatttagaaatcatttatccctccaaacttcacgcactgatgtaaaattctgccccaggctaggtgaagatccatacttgctgtctttctctcatgtcacagagtacatggagatctggaaaagttgtccataaattccaaattcttaatataaacatgtctattggaaatacagactcttttttttttttttttgagacagagtctggctgttgttgctcagtggagtcatcttggctcactgcaacctctgcttcctggagtccagtgattcttttgcctcagcctcccaagcagctcagattcccaagcagcatcatgcctggctaatttttgtatttttagtagagatggagtttcatcgtgttgcccaagctggtctcgaactcctggcctcaagaaatccacccactttggcctcccaaagtgggattacaggcatgagccactgtgcccaaccagaagtacagaactttatcaagaatacacacatgtgacattttcaggtttaataatttatacttcagggtactcacaaaactgggccaaaatcatggtctacctctatgtgaaataccaagtttccctatgtctcacagccatgactccactggtgacttcacagtacacgaattctaacccataaattgactatatccagaatgtagccagacataccataaagatgttcatttatcttcaagggagtccacaaaaatagcactgtagttcctcatatgcataccctaacaaaaatgagtcagtggtgtttccccagagaaaaacgatgctgtgcagtggaagcagctttggaaacagacagattcagatttgaaggctggctctgctatccattagttgtatgacattggacaacatagtatgaacctcttagagccatagattcttccactggcaaatggaggaaacactttgaacttatataactattgtaagcaggggttatgttatgatttaaatgtcccctccaaaaattatgttaaaatttaactgccattgtcatggtatggagaagagggaccatcaagaggtgggaccactgagagatgattaggtcttgagagctctaccttcataaatggattaacatcattatgaagaaagtaggtttgttatcatgagtgagttattataaaaatgagtttggccctctcattggctcattttcattttctcctgcccttctgcttgcctccatgggatgacaagcacaaaggccctcaccagatgccagcaccttgctgttgtacttcccaacttccagaaccatgaaccaaataaatttattttcttttaataaattgcccaatctcgggtattctgttatagcagaaacaaaatggactaagacaaatgatatttaaaatatttaaccattagtatggtaaaggcaccaaccagcataggcttaatgcctgttctggtgcatactaattaaatatgaactccatttgaagaattttgaaggcatccaacttgatcctagatcatgggaggtgcttaaacatatacaacgcattaaatgaagcaaacacgtgttgtaaaacattacaataaaaaacttagcagcagttatactgagatctctatactctccaattacattttttcacctgtgttgtttttattccatgattttattaaatgattgttagcttaaagtgatgagccacttgcgtcttttgactcatgattgagacagtcgtcaaaaaattctagatttgaaaagacataaagtgatctcacttggaattttatcaagtctatattcatgtataatccttatgtcttcttaatttaatgactcctttattatgacacactcttcttctttatctctgataatattttttgtcttaaagttgagtttgtctgatattattatagccactctagacttcctatgctgtttccatggtgtatttatttccatcaatttattttaaacctatctgtgtttttttatttaaaggctatctcttaacagaacatagctgttcttgcttttttatacattctaatcatctcagcatttttttgaatatttatttatttttgtttgtttggtttctttgcccacaaaacttattcattttgtcaatcatttgaaagtagcttgcattcataaagcccttgggcttaggtctttttaaaaaaaattcattcatctgtttttatgtgtttattttttcaagtttcattttagattcagggggtatatttgcatgtttcttacctgggtatattgcatcatgctgaggtttgggatatgaatggtagcattacccaggtactgagcatagtactcaccatttggtttttcaaccttttcccctctcccttcttccctgctctagtagtccccagtgtctattgttaccatcttcacgtccacacgtacccaaagtttagttcctacttacaagtgagaacatgtggcatttagttttctgttcctgcattaaattgctaggataatggtgtctggctgcatccacgtggctgcaaaggacatgattcgattcttttttattactgcataatatcccatgatatacatgtaccaaattttctttatctgatccaccattgatgggcacctaggttgagtccatatctttgctattgtgaatagtgctgtgacaatgaacatgcaagtacatgtgtctttggtagaatgatttgttttcttttggatctatacacagtaatggaatcgctggatcgaatggtagttctgttttaagttctttgggaaatcaccaaactgctttccacagtggccgaactaatttacattcccaccaacagtgtataagcattcctgtttctcagcagcctcaccaacatgtggtttttttttgtttgtttagttttgttttgtttttgttgttttttttttttttactttagccattctgactggtgtgagatggtatctcatggtggttttgatttgtatttctctgatgattagggacaatgagcattttttcatgtttgttggccacttgtatgtctgtctccctttgagaagtttctgttcatgtcttttgcccactttttaatggggttggtttttgcttgttcaatcatttaagttccttatagactccagatattagacctttagtggttgtgtaatttgtgaatattttctgtcatcctgtaggttgtttactctgttgacagtttcttttgctgtgcagaagctctctggtttgattagtctcacttgtcaatttttggttttgttgcaattgcttttgaggacttagtcataaattctttcccaaggctgatgtccagaatggtgtttcctaggttttcctctaggattctcatactttgagttcttacatttaaatctttactccatatggagttagctttgtatatggtgaaatgtaggggtccagtttcattcttctgtatatggctagccagttatcccagcgccatttattaaataaggaaacctttctccattgcttttgttaactttgttgaagatcagatggttgtaagtgtgcagctttatttctgggttctctagtctgttccattggtttctgtgtctgtcttgtaccagtactatactggtttggttactgtagccttgtagtatagcttggagttggaaaatgtgtgcctccagctttgttctttttgtttaagtttgctttggctattcagtctcttttttgattccacatgtactttataatagttttttccagttctgtgaaatatggtagagtagttttataaactacctgtataaaacctgtagattattttgggcagtatggccacattaatgaaattgattcttccaatccatgagcatggaatgtttttccatctgtttgtgtcttctatgatttcttttagcagtgttttgtggttccccttgtagatatatttcatctccttggttagatgtattcctaagtattttatatacttctattttttcaggctattgtaaatgagatttccttcttgatttggctcgcaagttgaacattattggtgtacagaaatgctactgatttctatacattgatttaatgacctgaaactttactgaagttgtttctgagttctaggaggcttttggtggcgtctttgagttttttaggaatagaatcatattgtctgcaaagagagatagtttgatttcttcttttcctattaagatgcattttatttctttctcttgcctgattgctgtggctagcacttccagtactatgttgaataggagtagtaagagtgggcatctttgtcttgttccagttcgcaagggtaatgctttcagtttttgcccattcagtatgatattggctgtggttttatcatagatggctcttattatttagaggtatgttcttcagtgcctactttcttgaagttttttatcatgaagggatgttggattatagcaaaagctttttctacatctagtgagatgattctaaggctttttaaaaatcctatttatgtggtgaatcacatttgtatttgctcatgttggaccaaatttgcatgccagaatgaagcctacttgatcatagtaaattaaccttttgatgtgctgttgaatttggtttgctggtattatgttcaggatttttgcctctatgttcatcagggatattggcctgttgatttctttttttttattgtgtgtttgtcaggtttggtatcagggtgatgcacagaatgagtttgggaggagttgctcctcttcaattttttggaatagttcagtagaattgtaccagctcttctttgtacatcaggtagaattttgctatgacactgctacattttaattagtgattagtccactgacatttagtctgattactgatatgattgcatttagagctgcaagtttattatatgttttctgtttgctcctccacttcttgtttttctttttcttccctctgcaacttttggatcatttttttcttaatttaggattctattttatctttggattttcggtggtttttctaggaattaaaacgtatattcttgatctttcacagtctacttagatttaattttatactatctcatataaaattggaaaaccttgcaactgtataaatccatttgccactgcctccattctttatgctataaagtcatatggattacatctgtacatattacattataaacaccacaagacaatgttataatttttgctttaacaggtcctgtgtagttaaagatcttatcatgaaaaactagtcttttatatttacaatttccaaaattttttcattccttcttgaagacttaagattccatctggtgttatctcactttatagcctgaacaatctttcctttagcatttctgtggggcaggtctgctgataataaatgctcttagtttccttttatctgaaaatgtactaatttgcctttactcacaaaggatatttttgctacacatagaattccggattaacagtgttttgcttttttttttacccctcgtttgtactttaaaaacatcatttcactttttctggcctttataaattctgatgagaagtcatcgttcatttaaagcattgttccaccaaagataccgtgccatttttctctggctactatcaagattctctctttattgctggtcctcaccagttggaatatgatgtacctatgcacagttttcttcaaatgtatcccatttggggttcactgcatttcttgatctatgcatttatgtatttcaccaaatttgaaaatttgggcccattatttcttcaaatattttgttctgtttcattctctttctcttctccttctgagactccaattacatgtaagctagacattttaatttctgttacacaggtccctgagtctctgtttattttttttattcagtcattttaagtctttttttctgtctgttcttccaaaagaaaatttctatggatctatctttaagttcactaacactttcctttgtttcctccagttgctgtaagtatactcaatgagtttttatttcaaatactgtatttttcagtttcaggatttctatttggttctttttgcagtttctgtttactaccttcttattcattatgagtttattttcctattatttgtggagcatggttaaaatagccactttaaaatctttgttaattcccacatttggctcatcttggaattggtctcagataattgctttttgtcttcagaatgagtcacattttattgggtttccatatagcgtgtaatttggggttgtatgatatgcaagtattgatgttattgtatgaagagcttcaatcctgttatagttttctgaagggtattgatttatttgttttagcaggcaattagttatactcaaatttaaaactatcccctgggtagcagctcgaatctcagttcagttcttttatctttgtgataatttgtgtctgctccatcaagaatatacacatgacatatacctcagaattacatgacgtgatctcacttggaattttatcaagtgcatattcatctacaattcttacttcttcttaatataatgatttactatcatgaaatgttctccttcatctctggtaactctttttgtctgaaagtttagtttgtctcatattaataaattcaagggtcaaccagaaatttgggtagtgtttatatacagatttgggagcttcccctctctgcctctcttctttccaagattctgaattcattttcctgtggctatgattgccctgaaccctgttctttgggtcttcaaaccaaaaacactgtgagttttctattggaggatggccacccgaagtgacattaattttagcctgttctcactctaaaagttgtaaaatgggaaactcactctggaccgacctgtgcttccaagttttgaatttcagctcccctccagaatctgtctgcttaattttattctctaatgcttccaggtaatttcttttttcttttcttttttttttttttgtttttggtcttttggtactttatagttgatatctgtgagaatttcggatccagtagaacttacttagccatattggaaatggaaacaagtaaaaacatttaggaaacattcctttgcatttcctaacacctctcctcaaaatacttaacctccgtccattccctcatttagtgacatttgagtttggttttaagtagaaatagaagccaggctcagggcttccttgatcatcttgccaagtacatgagaagacttggaatgaaaacacagcataaagttaaatgatagaatgatagaacatcaatcaattctagctcttagactggtggcatttaatctcaaagcaatgaggcttatacagaatcatgactaccagtgattatctacatggtactttgccacgttattttaccttatttctttggtctcagatatctctaaatcctgcctcattgaaaactgcaatagataatatgccacgagaaacagaatactgaaaatcctaaaatgccaacccagagttggtaattgcacaattccttctaatcataatcattatggcttccacttcttgaaagcttctgtataccagccaccttgctaaccactttacattaattgtcagttaatccttcacaactattctttgagcagttcccataactagcttcattttacggaggaagtaaccagagttccgagaggttgagttcactaagagcacacagcaaacagtagaactctgagtcagtctttgtaaagagaagaaatagcaaaggggttttggagacatcaggcacatactctttactattaggagagaagatagaagtctttctaggagtaagtagggtttctaaaacttaaatagtctacagtcctttttgtcagtaattattgatattaaaatgccacccttccagaaacaatatattttatattgacagcttttatgtttaaaaagaaccttctagccgggagtgatggctcacacctgtaatccctgcactttgggtggctgaggtgggtggatcacttgaggtcaggggttcaagaccagcctggccaacacggtaaaaccccatctctactaaaaatacaaaaattaggtgggcctggtggcgggcacttgtaatcccagctacttgggaggctgaggcacaaaaattgcttaaacccaggaggtagaggttgcggttagctgagatcacaccattgtactccagcctgggcgacagcgagactccatttcaaaaaagaaagccctccttcagggcttaaaacactaacccaaacaataacaaaaggatcaaataattatatgtaaaggctcatatgaaaaggcacataacaccagtgctccattttacctcatttcatttactgcctttaaactttgttttccaggtaaaccatctaaacaggcaggtgacctgccagagaaaaatctggcacattaggaagtaaagatgcctgcctcatcccacaacaagatgcagcaatgtctcacagttctacaactctaggggcaatcctgcccaactttgcaaattttgcataaaccatgggtttcaagtgactttggaatgagagggaaagggaaggcagcacgaaggataagctggctgacattgtaaagtggatacaggaaactgggacttaaccggaagcaggaaaaggaatatagtatctttgtgttctggtacataggattattcaatatacatatttattatacatgttaaattgtctgagacccggaaatgagagatactgttaaaggagtaaagatgagatgaggtaacagaaaaggagaggagtaaatatgagtcctaaggaggggttacatgagcacagtcccctgacgacatgctagagattaccagattagtgcattgctcctactttcttgctattattattattattattatgggttttttttggcagggtctcactctgtcgcctaggctggagtgcaatggcatgatcttagctcactgcaacctccacctcccgggttcaagtgattctcctgcctcagcctcctgagtagctgggattacagacacctgctaccacatccggctaatttttgtatttttggtagagatgaggtttcaccatgttggccaggctggtctcaaactcctgacctcaagtgatccacctacctcggcctcccaaagtactgggattacaggccctttcctgctgtttttaaaaatacatattcaacatatccggtgaaatcattcaaagatgcatacagataagtgattattttactctaacgtaaagcctctttgtaagacctacccttcactgtctgtcccagcatatgccctaggacttcctctgaccatgaacagtaccatgccactgaaggagatctgtttcaacagagcctcctcctgctgctcctaactttatttccattccactagcttctcaaagtcatgcaaaacataacaacctgactttgtaactgtttaaccttactttttacacgtaaaaattattaaatatgtgtaactgctggggggaggataatataatggcatgtcagtcaggtaacaggtaagctacatttcatggaaaagaaggggaatgctttcttcagaaagtgaagtcatcattcttttatttaactgacataatatttataccccaatttttaaaatggcagctacaaatagaagtcgaaagagggtaaattctccaagggaatctagccctgaaattttaccattttaaaagttctattttacaagtacataggaacattactactattataaggatactcacagcaggtcaattatttcaaactctttgaaaaaaaaatcaaaattaagtaaacctacctttcagaagactgctacctcttcggagtcctcagtggcaggatgcacagagcttttatagagggtctaagcaggcaggtattcctaggatacctacaccaaggacaagaaattcagatgattatttcagcagtgatccagatggctctaggtacaatttcattaggaacgttcaccatgaatactgagcattgccacacaggtactgttaaaagcgcagaatgaaggtacatatgtgatttttgcaggcattgtcattaatctgtacattggagactgtggctcaaaagggtgtaagtggttcatacatgatcacacaagaaaaggggcagaaccatgccttaattattcatttctgattcctagtccagggttgtttcagccacatcatctgatcctcctcaagaactggaaagtcctggcactggggctttccattttgcaaaaagatgaggctgacccgtgagtctggtgggaagagtctttctctggttttctggtggtctatgccaagtcacctgtctgaagtgtcctgtgtggccagtttactcactttcccttgaaactctggtgtccacagaatctgaaggaatctgacaagcaaagaaacatgggtttttttggtcccactggcctgagtttgaatcctagtaatgtgtttactacttctgtgtcctatgtagctgctcaacatcactgaggctcactttctatctctatcaaacgggtataataatatttgaagggtacatttatgaagaggattttttttttctaaatgagaataaagtatcaagtacagtttctggcacatgttagatgctagggcaaagtgaaagccccatgacccaccttacttgcagggataaccccaaagtggacaagtgacagggaggctattgagaccttgctgctcataaatcactcaatgacaatgcactaatcccctaactggctggttcctcactgctctgacctctacctctgggtttccttcatgtacacttctttgaaataaaaatatcataaacaccaattcattccctaggatctcatttagaggtaatcgtttccttttttaatctaataatcttggtctacatcatgttacatggtcagctcaatgtagtaattgaaagcagatgatcattcatttaacaagtatttattgagactctactaaggtgtcaggcactattctctatagcagtggacataatagtccaagatcaggccatcatgctgcctaccttctggtagaggagacaaacaaacaaaatacatatgtaaaatacatgagtggttaaatagttctaaggactctggagaaacacaaagtaggaagggagatggtgagtactatgggttgaattctgttcccccaacccctccccatcaggaaaaaagatatgttgaagtcctaaccctcagtacttagaatgtgaccttatttggtaataggattgatacagatataattatttaagttaagatgaagtcatactggagatcggtgggcaggcctctcatccaatatgattggatataagaggatgaccacgtgaagacacagagacacaggggagaaggaacgccatgtgagaataaaggcagagattggagttacatagctgcaagccaaggattgccagcaaatcactagaagttaggaaaaggcaaagaaagattcccctgcagatttcagagggagcatggccctggtgacactttgatttcagacttgtagcctccagaactatgagacaataaatttcggttgttttaagccactcagtatatggtacttagttactgccaccctaggaaatcaatacagtgtgtttggggagattgttgcatttttgagcaaggagatcaggaaagatctcactgaaaaggtaatgtctcagggaagatttgaggtgcaggggacaaccatgatgatggctctggatgaagaaattctaggcagagggaacagaaagtacaaacctcccaggcaggtgcatgtttgtatgttagaacagcagggaggccagtatggctggaatagccaggggagagtggcaggaaaccaggtcagagtgatgacaaggagctggagggtgctagaccttatgggccactctaagaacttaggcttttacttggagcaaggtgggaagccattgcctacttctgagcagaggtgaaccaagatctgacttacattttaataagctctctctggctattcggtaagaataaactgaagaacaaggccacttaggaggctcctgcagttatcctggtgaataaaggtgctagccaggtagcacacaggagagtgaaaactggtcagtcctatgcgaaatattttgaaagcagatccaaaaggatttgcaatagattgcaggtagagatacgcctgacttcttgatagtacatagaattaaattagaaaccgtaacaacttaactgtactgatcatctgaataaattatcttctcaaatgccagaccagccaaagatattagcaacaggtttaacagacagggaataagtaaccagaatatataaggaactcctaaaatcaacaaaaagaaaaaggtaaacaaataaatattttttaaaatcatgattcaaagaaggaacaatggaccatggacataagaaaagcagctcaacctcactgatatggtttggctgtgtccccacccaagtctcaccttgaattgtaactcccacaattcccatgtgtcatgggaggaacctggtgggaggtaattgaatcatgggggtgggtctctcccatgctgttctcatgagagtgaataagtctcgagagatctgatggtttaaaacatgggagtctctctgcacaagctctctatttgtctgctgccatccctgtaagatgtgacttgctcctccttgccttccaccatgattgtgaggccaccccagctacacggaactgtaagtccattaaacttctttctgttgtaaattgcccaatctccagtatgtctttatcagcagcatgaaaactgactaatactctcactaaacatgaggaaaatgcaaatgaaaataatgggattctactttatttctatcagactagttaacatgaaaaagactgacacaattcagtgttgtccaagatatgagaaaaaatagcatattattctagtttacttccagcggaatcatgaattggtatattattctattgagcaattttactgtattatcaaaagtgacagtacacatatgccacggcatagtaactcttcttggggggtataccagggctaagaaacatacacataaggggacatatattaaatcagtataacaaaacttggaaatgacctaaaagtcacccttaaaggcaaatcagtaaataaaatatgctatatttatatgattaaaggacatatggctgttaaaaagaatagattggttttataggcatcagtgtggatgtttcataaatgtcatgggcagaaaagcaacacaaaggaaaatgttaacatacaaacacaatagtatgtattcattgtaggtcggggtccccaaccgccaggcggcagaccagtaccagtctgtggcctgttagggaccaggccacacagcaggaggtgagtggtgggcaagcgagcattaccgcctgagctccacctcctgtcagatcagcggggacattaggttctcataggagcaggaaccctagtgtgaactgtgcatgcgagggatctaggctgcctgctccttatgatgagaccctaacgcctgatgatctgaggtggaacagtttcatcccaaaaccataccccccacctccccatccatggaaaaattatcttccacaaaaccagtccctggtgccaaaaagttggggactgctgctgtggatacacatatatgtatgtaaaagtataaacaacggactagtcaaatacatcccaaatttatggtagggaattttaggcaggggtacaggcagcaaagaaagtggagggtggagggaaggacaggacattattggtgaaaatgatttggttttatcaataacttctttaaaaaggaaaaaaacaacactggaagcaaatctgaccaaacaaaaacagatactcgttttgggatagtgagagtacagatgatcattacactagtttttgtgctcatctgtgcttttttgttttctgcgagtaaagaaaggaggaaagggagggagggatgaatggatggaaggaaggaaggaaggaaggaaggaaggaaggaaggaaggaaggaaggaaagaaggaaggaagggagttaccagttctggactgcacttaagctaatcgctaatcatagatggggatagatgaggttagtttttttgttttgttttgttttgttttgttttgttttgagatggactttcacacttgttgcccaggctgaagtgcaatggcacaatctcggctcactgcaatctctgcctcccaggttcaagcgattctcctgcctcagcctcccaagtagctgggattataggcacgcgccactacgcctggctaattttgtatttttagtagagacggggtttctccatgttggtcaggctggtcgaggttagttttttaaggatgaaactcaaaactatgttttaataatcagcgtgaccattggtgattcctagcagactgtctcagcgtggagggctgaatttcagttcagcccgcagagggaaccatctgtcatttggaatgacaaggagctctctgccaggggaacaccagaacaccggaagcagccatggtcttcactgcatccccactggccctggaaccaccaacactacaggacacaggaacacacaaagtaaaccaagggtacaccatggacatcttttcaacctttttaaaagcacattgcaattttctagaatcaagggaacaatatgcttgattagttcttcagcagatttggcaattttgcttgtcatatttctctctttaaagcaagttggtcattaaccttccatgttctaggacttgagattaggttttccccccacaaaatgaaaactttgcttaaaaaaaaaagagtttgctttaggataattcatttttgctgctaataactgcaagatcctctttgagccaaggaggtcattcttgaaaggggctagaattgtgaagaatgttccttctcttcctggagagagagtctgtgaaggcaaaaaagtttgcaggaaagttcagtaatcatgaagtgaaagcccaaagtgacctgaatacttcctcctgggtcaatattgtatgtttaaaaagaaacaaccaaaccttcaaagaaaaatctggccatccccaaatcccaatacatgaaactagaaggcaggaggcaccagtagaatgctggctttgctctcattgcttggcctccatcacagttacaatagttgcatatcatccttttgtacgtgtcatcctaaaaatgggatttggattggtttctaacaataaaacgagcaaggtagaaaaggaatattatgaataagttaccaatgtaaatatgctattttgcgcctttgaatttgagtgttgataaacatgattccacacatggaaattagacttttcagagctactacactgaatcatttaatttgtctgagtaagtacttataataatgtggctgctctgcactgcaataaacatcgggttttcaaatgaacaaatgaagtatgtgatactccttataaatggaactgcagcaaagggcgttcagctagggagctgtgcactaaaatgggatgggtgataagaacatctctctccagctccactgatagtgaaaggaaagaatcatatggcctctgctgctacattttctgttcctggacagaagcaaggctgaagcctcactgtgaaatgatgggggactgttgctattttgggttgtcacagggtaacttgtcacactactcaggacacatgaggacagataattctgttcctccagattgtggacttgagaatgctttagtaaaatagcacagggatatattttggatagtggttaaggacatgggtttgaatcctgggctctaccaaccaaataggtgcatgattgtacccaagtaatcatcagtcttctccatgctcattttcctatttggtaaaataaggataataactttggcttcctcattaagttattagggggattcagtgagataatttatgtaaagaacctggcacatgattagaattcaccttttttaacattatcattttaacattatcatcacatttttaacattatcattcaccttttttaacattaacataaccattttaacattatcattatatatgtcatcattattattatatttaaccttactttcattttaatccattattcaattttccttcaacgctcattaaaagcacaactcactacattgtttagtaattaattacttttgttcatttaacaaagtatttatactttgttatatgtgccaggcacatatgctaggggctagggtacataggtgatctaatcctcctggaagctattagaggagatgggcatgagtcaaaggctcccataggaagtgaaacctttgaaactcagggaacaggtctaaaagaaaggagcaggctaggcatggtggctcatgcctgtaatcccagcacgttgggaggtgaggtgagttgatcacctgaggtcaggagtttgagaccagcctgaccaacatggcaaaaacccatctctactaaaaatacaaaaattagccaggcatggtggcgggtgcctgtaatcccagccacttgggagactgaggcaggagattcagttcaacccgggaggcagaggttgcagtgagccgagatggtgccactgaactccagcctgggcaacaaaagtgaaatgctgtctcaaaacaaacaaataaacaaacaaaaacaaaggagcagatcactctaagagatactaaaacaaaggaacttaaattaaacctgagacctgaaggatgagaaggagaacaagggatggaatgatggctttcttgagagaaacacaacaatattcaaaggcatggagtatacagcactttatcattgttatcaaaagtcattgcaaaatgatctactgaatagctcaattaaatctaacaactatgtgacaagcacctactatgagccaagcgcagtgccaaactctagaaacaccatagtaaagacagatatgatccatgcctgcatccttacctcccaacacctactactatgtttgaaaaccacaccaaagtcaatatttactttgtaaccaataaattacccctctgggtttgatcacagagagatttcacctgcatggaaaaactggaatgctttctctggtcagacaaggaatgttacatatgccaaataattccctttcttcttagttgctggatatctacaaccaaatttagtttattccatgggcctaccaacttatactactaaagatggccatgtttctctttcatgattaattgttctattatttgtagactacctttaatttagtaaacagcctcagcctcaaattatttggaaagttattagaagaggagaaaaaagtaaaagaaaacaaggaaaagagatctcaagtttcttgagatctgggaattgtccaatgtgctttctgtagtattcgtggtacctaacatggtgctggatggaaagcatttaataacttctgattgtcagatggatgaagaatataaagctttcctggttcaacttgggctccattagaaggagggaagaactgaaactcggtagatcagaatatgcctccccacaacatccttctttagcataaggattattttgagctgattattttgagagactgcagctacaggagaagatctgaaaacagaagagaagttacctttttgtaaaaggattttacatctataaaggaaatttctactcataagggtgtctccctttctataccaggaagagaaggatgaccaaatcactagagactcttaccaatggagaagacaccaacttaaatctgcataacaaaccttactcatgtttaccatacttttcctgggcatccctccacaactgactatcccccatacccttcttttttttctttcagtggacaatggtatttgagcctgatctcaaagccacctctttgagatttattcatatctctgggtatcttccacgtgtacatgagatacacatatttttaacttctgtttgtttttctcttgtttctgggtctatcccaacctaaggaccataaagggtaaagagaaaattatttttccttccctacacttacttttctctagtctccaggttcagaggaaagaactcaaaaaagtggctgaaaagtttagcatgattttcattgtaaagcagcccaataaccaaacagaagcaccacataaaccaaaagaagagagtggtaagtgaaatataaggtaccattagagatttctctcagggaataagattcttgtaacaaaatatttacctttcttattctggtgctagtaaaaataagagaaatgtcacaattttaattaatgtctaagcaacagggaaaaatattaagctactttatgacaaaatggaaatatatttgtaattctatatcctaatgttctctcagttattttggaaaaactattagtcctttggtctcttctacattaggagagcaaaaagctataatatggcctatctggctaactatcgggaatcggagaaatcaatttaaaagaaatttggaagacacctacattatcgatattagagcaaagtagagatctgccttgttcacagcaaagcaatccaattcacacacacacacacaaaacaaatgttgcatttatggaagtattaaaacatctcatccttgtccttagcttaacatattaatgagaatttctgaattaatctccaatcgtgaactgtgtctaggtgtgatataagggcagtaaatactgtgcagcttgcttcaggcatgttttatgacagattctctgacagatagaaaatctttaagattaaattatttctgtattttcctaagaaactcatcagtactaacaagcataccacttccccaactagttgataaacagaaaagaaaatattattaagtgatggcacttgaggaaatagttaaaaggagaaactcagaacataagattgtgattatatataatgaggagattctcaaaatggcacagaaaggaaaggaacgagttgaagctgaaaaacgtatgtttttaggaggtaagttattccataaagcaattactaaaatgtgagagttcttctcatggttctcaaccttatactctgaaagagaacttcttataatgcaagactaagagagccaattacttcagcaccaaggtacatcctaaatctctggacttggcagttcaaaaaaactcttggaaaatgttcttctaaaatcttcactaacagccctgactttagaaatgtagactctaaaaggatgaataaaaactaaccaattagatagcaaaatggagaagagagagcactgaataaaaagacctgccagagttcgggttgtacctctgccaccagcctcagacttagttcatatttacaataaaaccataatcataaaaattaataattatggaacacttagtatgccaagaacttttcatatattatctaatttaatcatcctaacaacctatgagggagacaccacataagagaaaagcagttgaagagtttgtccaagaccacccagctgctctgagtgatgggttaggattcaaacacgatttttttggaccccagagcccaacccttaaccactcactctgcagaatagttcagaaacctcctaggatgatctaaaaggcttctttcaacaatagggcgctaagatttatgagacatgattgtataatggaaaaaaatctcaggtttttgaagtgactttgtagcccagttgagcagcttcttctctaagcctcagaatcttagataacaacactacttaccttacaagctggcctaaggatcagagataatactagagcccttagccccaagtaataataataataataggcagcatttatataatgctcattatgtgctgggcaccatctaaacatttttttccccacattaaagtatgcaatcttcacaatgaccttaaaagtactattattttgtactttttatctaattgtataagaatacaattagataaaaagaaaaaaaaagagttctattgttttgattcctgttttaccaatgaggaaacagaggcaaagagagttaaattacttgacctaaatcacagttactaagttgcagatcttggattctgatccagacagaatgactcactggacaacccaaaacatattggaggcactcctactgatacataaagaacctccttgccatgcccaatgtctgtgtcactctcacccaaagtaacaaatttaacataaacttgggaggatgaaatacatagggatgcccagataacctgcctactgtcattccgcagattgtgcctttaaaaaaaccaatttcaatagaaaccagcaagaaagagatacatcaggtatgtcagacatacgtggtcacaactattttttctccttcctggctaatcactccctttgtgttgataatgtgctgctttaaatcaattcataaaaaaaaaaaaaagcacagaggcaccataaaagtcgtttttcctgttttcaatctggaagaaattcagtctcttattcattttaaaaactattttaataatagcttttacttaacccaatatatcaaaaatattatttcaacatgttaataaaagttaataagagattttacgctaagcattcaaaattcagagtttactttacatttaaggcccatctcaaatcagactaacctgattagtctgaatgctcagtagccatatatgttgctagtggctaccatattagacaacacagttctagaaagattggcttagaaaagccctggttgttgatatttataggtctctttccttgggctggtcaaattccccagaaagatatctttcaatctcctgccttaggggtataagcctgggtgccattgttctgagatttaagtatgggaaagagcagaagccccatcatattgtctttcacttaagccccgattttcatcattatacccatcctcagctatgcatggtgactccaatcacgagccctgtagttggtccaacccctccagtcttcctcctggggaagtagggagggaggcagttgggagaggcagttcccaggctatgcgggttgggcaagaactctggggactggttagcagttatttgtcattctttcaatgttcttttaatattccttcattcccactttcatacatttacagtgccatgaattcctgacacgttctagaatctcagtttagattttaccgtttctctccccttttaaatcagtccctggccttttaaggcagcttctacaattgtattctgtgaccttctcctctatgatttttgttcatattcccctccccttttttaactaacattttttatttgaaataattgtagactcacatgaaggttgtaagaaaaaatacagagaaggtccatatgccctttatccaattcccttcaatggtaacatcttggaaagctattacacagtaacacaaccaagatattgacaatgacacattcaaaacacagaatgtgtccatcccagggatcctcttgttgctctttaatagccacacccacttccctcccactccaccccttcttaacttttaaccacaaatctgtactccatttatataattttttcatttgaaaaatgttatacaagtggagtcgtacagtgtgtaatcttttggttttgtgtttttttcccctttaatctattccctgaagattcagtcaagtagtttcatgtattaataattcattgctgagtagtattcgatggtatggatggaccacagtttgcttaaccattcacccaataaaggacatctgagttgtgtccagtttggggctattacagataaagctctatgaaaattcatgtatgggctttggtgtgaacataagcttttgtttacttgggataaatgcccaggagtatgataagtgcatgtttaattttgtaagaaactgccaaaccattttctagagtggctataacattttacattctcaccagtaacacaatttctctgcatcctcaccagaatttgttgttatcattatcttttattttagttatttcaatatgttcatagtgataactcattgtggttttgatttgcatttccctgatggttaataatgttgaacatcttttcatgtgcttatttgccatctgcataacctcttcagtaaaatgtctggccatgtattttctaattgagttgcttggatttttttactgttgagtttgaaaattctttatatattctaaatactagtcctttgtcagatatgtagtttgcaaatattttcttccagcctgtagttattcttttcattctcttaaaagggtcttaggccgggcgtggtggctcacacctgtaataccagcatttgggaggccgaggagggtggatcttttgaggtcaggagtttgagacctggccaacacggcaaaagccagtctcaactaaaaagaaaaaaaaaatacaaaacttagccagccacagtggcatgcacctgtagtcccagctattccagagcctcaggcaggagaattgcttgaacctgggaggcagaagttgcagtgagccgagatcgtgccactgccctccagcttggggaactgagtgagacactgtctcaaaaaagaaaagaaaagaaaaaaaaaaaaaaaaaaactctttcacggtgcaaaagcaaaagttttaattctgatatagtccaatatatcaccaatatatcatttgtttcctgttatggattgtgtttatgtgaaatctaagaactctttccctagccagagattccaaagatttttctctaatgccttctccttctaaaagaagggttctttattctgttccgttgatctatgtttctgtcactccatggatagccacatagtaactatgcaatacttcttgaaactgggtagactgattgctcccactttattatttctttttcaaaattgttttagctactctagttcctttgtttctgtataaattttagaataatgtcatctatatatgaaaaaaatcatactgagatttttgataggaactgctttaaacctgtatatcaatttgggaagtatcggtatctttactacgctgtgactttcaaatcatgaacacaacatttttctccatttatttacatttttaaaatttatttcatcaacattatatagttttcaacaaacaagttttataaatgttttattggattcacataagtatttcatatttttgagctaaggcaaattgtactatatttttaaaatttgtgtccacagattcattgctagtataaagaaatacaattgataatttaaatgtctatctcatatcctgccaccttaatgaactcaattattagtttttcatttgtttgcttgagatagggtctcactctgccacccaggttggagtgcagtggcacacaggtattggcacaaacacaaccttctatagcctcaacctcctgagctccagccatcctcctgcctcagcctcctaagtagctgggatgacaggcatacaccaccaggcctggttcatttgttgttgttgaggagagatgaggtctctccatatttcccaggctggtcttgaactaggctccagcaatccacctgcctcggcctcccatcgtgttgggatgacagtcatcagtcactacacccagccacttactagttttaagagttggttttgtgttttttcgtctttgtagatcacttagtgttttctgtgtagaaaatcatgacatcagcaaatattaacagttttctttctttccatctgtatgcctttcatttccctttcttgccttattgcactgattagaacttcctgcactatgttgaataggagtggtggaaccagccttgcactgctggactagactccatttcgtcgtggtatattattcttttagcctgaatcctgtttgttaatattttgttcaggattgttgtgtctctatttatgacagttattggtatatatttctcttttttgcactgttttttctgtttttcatatctgagtaataccagcttcctaaaatgaattgcgaagtgttctctcctattttctggaagagactgtataaaactcctattaattattctttaaatgtttggtaaaattctccagtgaggccatctgggcctaaatatttattttcagggagtttttaaatgattaattcaatttttaatagttatgggcttttaaatattatctatttcatgataggtgaatggtaggaatttgtgtttttgaggaagtggcccatttcatctaagttatcaaatttatgtgtgtagagttgttcatggcatttctttattatccttttgatgtctacagggtcaatagtgatatctcctctttcattcctgatattgtaaccaaatgcaggtccagatgcccactgtttacagagtccagttaacaagagtgaggtctagtagaaagaaagtcattttactaaaaccagtaaaggggaaatggtcagattcccgcccaaagcaatcactttgattttgggggaaggcaggggtttaaaaagggaaaacttgataaggaaggcatgcaagaattgtactaagtataatatctgtgtgtcttgttctggtagctatcttgggtctcagtctacctggatggtgagtcaagacatctgggaatatctttacttcccctttattcctgaggatattttcacgggctgtaggacactgctttgattgttgattattatttcattcaggactttgaatgctttaagttcctgagcagccatggccaggtttttaactagccactttgaagtaatctctggaattttgcagctgggtctccaagcttattccgcctgtctcaagattagcccctggaacttctaagaaggcacagtaattagatactagtatatacttagacaaatgtgaagggagtatatatggtgaaaaagggagggacgtggagcctatttctaggctgaggaaaaggcttctgcagtttttcaaggttgtatcttgaaaaccaagagaagagaaaaaaatgttttaaaatgcatttggaagttaagttgcctagttacaatattggtaattggtgtcttttctcttttctttgtcagtcttgctagactgtcagttttattaaccttttcaaagaaccagctactcttgttttcctttgattaaagtttgcatgatacatcttttcccattattttactttcgtctattgttatattgaaagtgagcttctcatagacagaatatagttgggtcatattttttaaacaattctgctaatctcttccctgtattataagtggtatatttagaccatttaactttaatgtaattattgatattttagaatttacactgccattttattttttgtttattttctgtttgttctctttgtggttttctgttttctttgcccagacttcttataagctatttgaacactttttggaattctgttttgatttatctaaagtgtctttcagtgcatttctgtatataattttttaaaggtttctctaggtattactttatatatttataactaaacagtttactggtgtcatcattttaccagtttgagtaacatatagaaaccctatctccgcactttgcatccctttatcttccccatttataatataattattttaaatacttcctttacatgcatttacatccacatcagaatattgcaatttttgcttcaaacttcaaacacaattagagctctcaagagtacaaatgtttttgctatgtttttttcttcctttctgatgttgaagagatccatttttaattgtcttctttccaattagataactcttttcttttctttcgaggcagagtctcaccgtgtcatccaggctggagagtgcagtgatgcaattatgcaaattcttttagttttccggctgggcgtggtggctcacgcctgtaatcccagcactttgggaagccgaggcaggcggattgcctgagctcaggagttcgcgacgaacctgggcaacacggtgaaacccgtctctactaaaatacaaaaaattagccgggcgtggtggtgggcgcctgtagtcccagcgactcaggaggctgaggcaggagaatcgcttgaacccgggaggcagagcttgcagtgagtcgagatcgcgccaccgcactccagcctgggcgacagagcaagactccgtctcaaaaacaaaaacaaaaacaaacaaacaaacaaacaaaaaacacaaattctcttagttttccttcatctgataatatttttacttcccctttattcctgaggatattttcacaggcaataggatactggcttgactgttgattgttatctgcattcaggactttgaaagctttaagttcctgagtctcagcagaaactcaaaaataatacatgtaggaagagctaaaaaaatatacaataaaccggatcctatcgaatttaaatgtcaccaggctacaagaaactgattctggcagaaaaaataaacatgtgaaaaataattacaataatgtgtgataagtgcaaaaatgcaggtatgtacttgtcacgatgctgacacacagagagaatcagcactgcttgagagaatcagtgaaaacttctcagagatgtgtgaaccaggttctgaaagttaggtagtaaaaggacttcctgggtgaaggggaacccagcacgaaagccctgagaaaagcggaaaagatggtacatttgagaatctgtgagactgaatgcctggctgaggtatagaacacccattggaacaagcaagagatgcagtagaaaagacagctaagggaaggatgctgggctagagggcctcatcctctactaaggagtaaactttatcctgtgtaccacgaggagctaccgaacagacgaaaatggtgagtgtaatatttaaagcaatgattgctactataacactctttttaaagtagcttttccatgaattattaacattatctttagtctaatacgtatcaaaatttagtttatggactggtaggatgtgttaatggccaataaaagtaaaagactcagccgattccctgccttctacactccattttacacacactccatcctgcctgccgaatgacttcagtgtctctgtgaccagtgagtgaagcagcatgcaatgagatcatggctagatggcagcacattcagtgaagtgcttcagctttcctgttgcttctgattccctggcatttgtcagtgtctgtcaaaacattaacatttcttaatgtatattttgcattatttactaaatgaaaattttccaatgacagtggctgagaaaaaaaaatcagatttacatacagtatgtcaagttcacattcgatgccccagaaatgcccagtccccaaagacctctagggactgcagctcatttgttgtccctctccctctcccgtttattatgctgaccctctgcccagccacatagctcaccccacccccttagaagcatctagagttggctctagacatgaaatggaatagatttctgcatttacataactgctatcgcacttctggtgaaaagtagtttcagaaaaacacagaaaaaaataaacagaagaataaaaagtgtctatgtgataacataagggcttatttaactacgtctttatttcctttacagtccaactattttttttttaaaactgcatgccaccttcatgctgcctctcggaggggacttgatcttatttagacccggtggcgagggtccttcagctccgtgaggagctctctagcactcagtcctctttagaggaaagatatcttcagagcctaaaggccttgaaagaaatgacacatttttaaaaacagaaaaacaagcatgaaagtggcccatcagaaatgaaggtgtgaactagaatacaatagacagcgaggaaggagccaaaaatcctcacccaggcaggccaggatatatgcagatagggaggaaattgggaggcattcctttgctaataaagatgatttttcttctaattttcacatctttcatgatgtatcttttgttttttgttttctctctatgactgctgttctaaaataagtgggctttaagaatatgaactacagtccgcatgtttgccagccccatattctgcgatgaacttgacatgtgaatgaatcaattctgcagaggtgaaaagttattcctacaaagtccccagttttccttgtgagaaagatccctacttacctgtaaacttgttaattaaatgtcaaaggtttttatatcaaggacaataacacaagccaacctgggaatctgcttgtctgaaataggtaaagagtgtctgtgtttatttagaattgattgtacactttccttcattctctacatagattttattttctccccacattcttctttttctgtattgccttgagggctttctcttataattatgtgacaaattatatctgaattatgttcaaataagcaaggagactgaggttttctgttaaaaacatatggcctatcagtaatgaatgaagttttgcccatatcatgacatgactttattgaaggcaccatctcatatatgcagttttcaatgtggtgtctaacagatttgtgtaaaatgtctaaaattaagcaaatgcaattatatgagttagtatcatcttatcatgtacattttgcttgataatagaaaagcaaatgaaaagtttattagcttattacaacagtctgtttttgatttttactttagactctattcctctttattttctcctcttctgtttcgggtcattattttatctggagaacccaaaatccaattcttcatctgtatttaccacatagatctttagattctcttaccaatccaacagatttctgaatatttaactaccctattgtaagttgtcttgtttagaagaaatggaatctaagattgtggcagtaaaggacaagctgtcaatgtgttaaataaattcctgttgaaaagtaacggcatgcactgtgtgttaacataatttattagaacaattagaacccatccttgttgtcttttaattagattattccctgttctggtaattacactagacaagggagaataatagtcttgggattctaaaatcatctgtagactatgtggaaagagaataaataatcaataatgctaatgtaccggaaaacttaaattcccagaaagagatcttttatcatgagcaatcctttgtataaacagcattatttctcaatgtctatgcttatcttgcccaaagttgaaaagtgaagacactggacaaataacagatatttattttactgtcagaaacctggttgggctgggccacctctggcctctagtggctcagacattgcttcagtcccttgcaaaatgccaacaagaaaccgcaaatgaaggatttaaaattccatgcagagcagcatatctagcagtctgaatgcctaagggaaaggatgcagggcttttaagttctggtcctaggtgaggaatcataaagttcctcaatttaaaaaaatatatacaaatggacaaaaatgtcttagaactgagaaggctactaaatattaaaaaaaaatttctgatatttccatacatgaagatgttatttgcagaaattaataggcaggctgtatgtcaggaaagtttctggctctcagggatgggctgaggcctttagatgtgaatcgaactacatctctggttttatgtttggaagaccacagggaattccagtgctccaaggacgctccgagggcctacacaactgtcatcaagcatgttaggacatcctagagagtagttcccaaaacttctaggcttcagaatcttgacaaagtcatgggtgggcatatcctgccctcacggataaccctacagttgagtagaaggatgctggaatgcacagaattgacaccagtgaatctggagttctctgtagtaatgagcaacacaaatatctcaccaacagtcccactgttatccgagtctgccttagtcaatgtaaactcctaatgagaccatgtctagacagtattgatctcccaccagaaaaaaaaaaagaactcagagtgtgacttcttttctagcttagcccaaatgacaccctaaaacatgctctttcattcactcattgctaacacttttcataacctgagatattttatcaactaggcagccaaggacccataggcttcttcgcaaggtatatgtgatattttttatatttaaaacatctttgatattcaaatagcagataagaaagttacttaagcttattaaagaacctagagaaattaaatgagtgtatatatatatatatatatatatatatatatatattttttttttttttttttttttttttttcccttgctaggcaaaggagacaggcctttaaaaaatgaaagtccacataagattaaggtgtgatcattcaagttaatgtgggcaagatatctaaaggagaaatcattagcttaagctatccaaaggattttacacacagtcctgtggtttaggagcagaggatcacccgtactactgtgctatccatcccagctgggaagacatggttctttatagaagtaccccttaaaattgtcaggggtgctattaagtacttagggttccccactattcttatctccagactggtcaaatctaccaggcatctttctgatatatcagatagatacaatctatcatagatataccaaagatttatttgcatctgagtgtcctgtggtgaggcattccacagcaggctgtgcatcaggtctgtctgcagaaagtaagaaagaaaggaatacagtttaaaattcacgtaggaatggagtttaaaaactccccaggcaatgtgaaggtgagttaggactgggaaccacaagctaaaaaggagaaccacagagaattctttctgactttggggctgaaatgaagctgaccgaggcattcaggtggttccagaggctggaaagtctcatacgacaggtttttttctcacaaaagagaagtgaaataagtaccttattatgttccaacaatatcaagatacaaatctatcttttagaaaaatgctaaataaaaacacagtcagagagagacttccaccactataaatagtttcttataaatgccacctagagacaaaattatcatttctatgatcctaaccaaaagagccttgcatgtcttggaaatactttgccctctaaagcaaccagaagaacattccttcagtctatgtgttcttgtgctggattttgaaacttttgagcatttgctcccaaagtgaaatttaaaaggctaacagcagggacacctggataactagaaaacttacctattgatatcacaggctgcttctccaaatggactgtatataatttcttgcaagcatagtaaaaatcctatacttgcttgaaatgaaatgaaggaaagcctatcatgaatttctttttctctgtgttaatgaaagacacgagcacaccatgataagcaggagagaatgacctagtgttcatccttctcttcttgtccaacgcaggtaactataggtgggctctgggtagagtatatgattgctgcatatttctaagaaataaagttaatttacaggctacctcaatcctgacactctaggggtaaggcaagcatgcatgtatgtatttctggtaatcaagagggagaaatagcagtgaaaaatagagcttggatatatatcttaaagacatgccactgatttcaaaatagggcaagagcacttatgatttaatataattttgttggaaaaagttaactctctccaaggaaatacagagcttagcaaataccttataaataatacaaaggcatactatagtgtttagtagaatcttattcacccattctgatttggacaaatgttaaatgagacaaacaggagaaaagtttattgattaggtaaccgattaaaattttggtgaaaagcagaagtagtaagttccagaaacaagaaataaatcatgtatatcaacaagaggaatgaaggcattttgtgcaatcctggggaatagattttcttaggtatttcataaaatcattgactctagggcaggaaaaaaccctacacacataaacccacagcattctttttcctgcctccacagttgtaaaggcccgatgataaaacctgtttcctaagacttccccagaatgtgattcaacacattttctatttttttaaaaaaaaatttctgccacttaatttcatgtgataattttccccaatgactaaccaaatatgcttcactattatataaatcaattctttcttaatgccacaagtgaaagtgcaaaggtagctaatggttttcttctcataaaaatcacactttggctttttcctttcatatgtaattaatcatatttgtgacaatcttccaaacttacttgaaatttttctgaatccctttcaaatcaggacaagaactagaaatgtctatacaggtttaatatgaagtaaagaaaatgtttttcattttcttgatttatttctgaattcagcttgctcttcattagcgctacatagctgmcttattattcgtggtcccctatgaccccctgatcattttccctgagggtgcatatttattcactaactatgttacaatcatgtgatctgctggattttttctgatagtctactctagatttgttctaaattaataaatcccattatttttggcttctactacttctatttattaaattcattctgaatatgaagtttattttcaaaggaattcataattctttactccrrgcttggttctaacaatgaatttaataagaattgtatttaatcaatgtttaaatatattaagggcaaattttgtaaaaatgttagtgttccaagctttccatttccccacaaattaatttttttagcctttccccttaatccactttcttaaaaaataaaattttttttgtgatgcagaattatgtgaacaataagaaaaaaataattagaaaggtaggagtaaactaaaaacaaacaaacaaacaaaaaaaaaaaccaaaaaactaaggctgcagacttaatagaactaccatagctacttaagggtaaatgattaagagagagacaacgtctggcttctgagcagagcacagagagaaagatcaccaggaagaaaaaagataacagggaattttaaggacagttgccatgtgtaatgcataaaatagttttcaaaattcttggagaggtaaaaataaaatttagatttattttttaattatttcacttgcgatgctatcttaagattgaaccacatggggccccagaatttatttaggttatacaaatatcctccaattctgatgctgattatttcatatgcagacttcagttacctttacatgtcataaacacacataccccagaaataaacttgatcatcccataaattttcaagagctctcagcctgctgtaaatgaaatttcaccattaactcacaggtcgatgtctgggacaacctcaaagactgcttgagtaattaataaatttatatgaaaacattggagtgaaaatgtctgtcagtgtcaaatacataagaggtaatggctgatacatagtaatgcagttttaaaccattggcaacatatctaaacaaaggtatcagagaaaaataaaagaaaaccttgtaacttgtatgataagcctcttgcataagattattaagaaagtcataagcacttacggctttattccttttctatatagatagattgcccagaaaaacgtggactgaacctcagctggaatctgagggctctgcttgtctttaacagcttagctacattgttagagagcaacactacataatacagcatgccctattcttaaggcaatacataaaattttaaaacctgaagctaaattaaaaggttatcacccttctgcctaatgtattatatatttgtaaatgatatctgtctctaaaaaagatgtaccacaaagcaagagcatatgtgaaacaataagagagaatgtaggagttagaaacacatttaggtatgtaggaaacacaaacttcaagacattcccaaggatctaaataacctatacacaaatatagcaaagtcatatcctaagggagaggatttgagttctaaagccggagcctaaggtaaatgttgcatatagtcaaacttaccattgaagatcactttaatcacctgtagggtgcaagttacattgctttgtgtattcaagactgacagtgaatatttgagaaaatcagttgagttagaataaagaaggaagcaaagaaaagtccacctacagatattagggtattcaaacaacctcttctttaagaaactagcaaatctccacctctgagtttttatcaggtaggtgatgaagtgcaaagctgtaaaccctccaacagggcttattccactgttttaatattcacatttcataacttggacatatgcattaatggatgtatttgtcattgttaagattaagtaacataatctttctttttttttttctttgagatggagtcttgctctgtcgcccagcctggagtgcagtggcatgatctcagctcactgcaacctccgcctcccaggttcaagcaattctcctgcctcaggctcccgagtagctgggattacaggtatgcaccacaaagcccagctaatttttgtatttttagtagaaacaaggtttcaccatattggccaggctggtcttgaactcctgacctcaggtgatccacccaccttggcctcccaaagtgccaggattaaaggcatgagccaatgagcctggctgataaccttatttcataagcaaaagcatcatccacagggtctggtccagagcagatactcaatagggtgctacattttaatctaactcttgtttcatcagacccacaaacacattgctctttaaaatcctgtagagaagaatatgacaacctgcaccttttctttccaagatggcatttccagttagggtacctctgaacagctgttgcttgcacattttaggcatggtgaagatctacacctgatgctgggttcctaagtgggcatatggtgaatccactgcacacagaagcacttctttatgcttggatcacattgcagaagattggacccctgactggggctacctttcccaagccttaacagcacatcaggctcaaatcacagggctatcaaatgaggagatccccttttccaaaaaaagcatccctatcaactctcccaggaaagcacatgaactcatgttatccattcattcttatcttggaaaatacacccacaagccccttttactgccacttacagtaggatgccacaaaaattcagaaactggaatccttttccgtcccttctcctttccttcctccctttcttcttttcttcttccttaccttgaaatttctgcctgtggtaaaaccacaggaagaaggaaagtcaaatgaattttcctattagtcgacatttctgtgatacactcattttttttggtccccgtatgaactccctccagggtatttctttatgggaataaagtatgccaaatgaaataaagaacttgaagcacaattttatccttgacatatgtagagagaatatgttactcctgaatttatggtgcaatgcaactcagtcacttccttttcctctttcccctagtttgcacttcctacttattgctgcataccatcacaaatttatggagtgccaatggctgtggcctctaggcagctcccaaatgactgaatccagacatcattgtcttcagttcccctttggcattagtctattttccatccctcttcctttattgaaatctgcttccaattatttttcataagatggtttagctttcttttatttcctttaagttgaaactcttttatttctacctttcatttctatgccctcctgggccttaagcacagttcttctacatttacaggggttttcatttagaaactattgagaactttactatcaaattgtactttttaagataatttttttgcaattttaactaaaaggagatttttagacttttggaaagtcatggctccaggtctcagatctcagctgtaggttttatcactttgcaagatgatgactagagttacagcacattctttcaacccatgcccaaaacttcaaagatggccacccttcaacccctgaagatttcaactcagtgttttcagaaaattggaggtccaggctttggagtcagacagatatgggttcaaatccagcctctggcacttaatttgaatacaacctagagtaagtcatttaactttcctgagctttgatttccttatctgaaaaataagaatatagatacttacctcaccatattgttataaagatgaaatgaggtaatctttgtaaaatatacacaatgtctagcaggtggtaagcattcaaactggtagctattttttattgttatgagttaaaattttgtatataatggattttttttccaagaaagctcatcaagctgaccttaagtagatgttactcccaaataccacccaattccatgtctacatacttgagaagttactaaacactttaaaattgaaattgaaaactagggacaaacatagatttgaaaccaaaggaataggtaatcagttataaatttggatataacattatgagcctctatttcagaaaatacattccttttaaagtatatttactatagttatccatgcagactgaatatttttatcaatagttgcaaaaccatttcctgaaagggaaaaccatgtaattataactagattttcacatgttaaccttttatataagggaagaacaagaagtagatatttgctaagagactgggaagaaagggaagagaagggagagagggagagacagagagaatgagaatgaaagcaaagaaatttgacaaggaatactatttggcttttggcccttccgtgtaccaacgtagatgtgtgattataccatttaggattgttgtcaattctttccataggaacagactgaacaatgagacatctacctctcaacccaaagagaataaaattgtcatttccctacaggacttttgttaatacaaaaatgaaatatatatatatatatatatataaaattattatgatttcaaaaataaagccaaatatctaaatgaaaccatgaaaataattagctccgatccaacagagtaagtgaggtttttactttggaagataagtaaattctttcagagcatgagaatgaaaaattgattgattccgatctgatctctaaaaagagcagtctgatttactttggtatcaaacagacctgcttctaaatgccatttctgccatttacctgttgggcaaatttcttacctatgcacttggagtcttcacccttaaaataggtatgaaaataggtagaaaataggcttgccatgctttctctctctctccctatatcccatgtctctccaaggagcaattcctaatgtaattgatcaaattcaagcatatggagtcttatttactaagtggcatggtcactatacaataaacgtgacttcccccacttctacttcttctcttctaagttgaaaaaactctaatctctcaggtcaggctaactatttccttccctctttcctgccttctttctaatttgaggcaatagcatccatgagcccaggcgatgtcagggattcttgtttttatctcaacactttcattcttccccatcccctcacaggcccccattcagaattcttaagcatgctatttgcttgagggggcatttaggaagtcccatttaagacctctgccagctctaatcttatctcttcagagaggccttcgctgactatccaatctaaagtacctacctttatcagtgttctacactggaaggtattgggcacaggtgcaactaataataaagtgggtggtactttgttgccatttccatgttagggcctttgtgtctgcacttctctctctctctctctctctctctctctctctctctctctctcatgctctgcatctttaaatcactaaggtctcagctctaatgttatctcttcagagaggccttccctgactatccagtctaaagcagactcctcattcccaccaactcactccattacattaatcttttattttgttaatagctctcattgcatcccattactttcttctttatttgcttgttgcccatccctacctccttcccaaacacacttattaaaacaccatgaagacaaaaaggtattgtgctcaccacttgtttatccagagccaggtgcctgtccaaagtagatgcacacctgccatgtcctatggccaaccaggtccaatgaattcctttataaagctcctctcctcagctgacccagaacaccagctgctatactgaaggctttcacactttcagatgaggtgtctttatcttataaatttcttttctctaagcagaatttatataacctactcattactttgaatagcatcttattcagtataccttattggtatttttcagtaaaccctggtataaggcacacagctaagtgaatgtccccacatacctataagagagtggctagatgcctttcttacccacagggatggtttcaaagaaaccttttacactcactcccatatacacacatacacaaaggaaagctcacatttgcattccagatcatctccaggaggagggaggagaaatactcttttaaaagagcaaacctaaaattataatgctcttgaaaacattagtagttaacatttactgttaagaaagccacaatcccagaccaaagatagctgagtggcatcttaaattgaagatagtttttaagtcagagcttagaaagtctcttggaaatctctttaattcccccacagaataaaatatggtacagattctcaggaggtccaatagaggctttcctctagcattagaacagatccttctttgatcaaggatcagatgaagtcattggtgtgaatttactaggcatatattttttcatatataacagaaaatgtcaacactggaatctcactcagcactaagatgctcacactaagaggttcaggaaaatgagaatgactcccagaacccatctcacattttctaagaggcatatattcattgaggggaacgtctaacagaatgacctatattatttacatcagtacttcctactctcacttttttggccaattctgtgtgattaaattggcaaaagttcaatgcacacaaggtgcaactcaattatatttaagatcactcatttatgtcataaagtctttctcaaaaaacaaaagatgccagccccacagaactttatcatgtcacatagaccccattaatgcagtctatcaacaatatagacagattattatattcagggaagttccctcaagaattgccttacaagttcaatttaaaaaatcaaaataaaacaagccagtactgagtctttctatggtatagttaaacttgtaatattttatacatattttttgaaagtagccttgatataaatcctgaaaaaagaaaaaaagcaaagtccacatttctataagtgtcacgatgataaattttatgtatcaacttgactgggccatgaggtgcccagatatttggtcgaactttattccgagtatggctgtgagggtgctttggacacacttttaatatttaaatcaacagatgcagtaaagcaattgccctccctaatgtgtgtggacttcatccaatcagctgaaggcttgattaggacaaaaaaaagctgaccctcatgcaagaaagaggaaactcctcttacctgatagtcttcagctgggacactgattgtgtcctgcctttggactctaactgaaacactggctcttcctgggtctcaagcctgttgatcattggacagaaactacaccattgggtctcctgggtccctagcttgccaatgccagatctggggacttgccagcctccatagtcacaagagccaacttctcataataaatctctttctatacatatggatacacacatcctactgattctgtttctctggagaaccctgactaatacaaatattaaacccaaataaaaacccaaatgcaagtattaaacccaaacccaaatccaaagatgaacaactttcttcatcagtctggcacctaactgcatgtctctttatgaagtatgtaatattttttcatgagctgccatatgtcattccatcactcgctctagaactcttttaggcacttaaaactttgtatattatattaaaatttaatgtatcaagaaaggatatagtgagaataaactgaaaagagtagttactaatgccaaatataaggcagtcttgaaaaaaagaaatattcctctgtaatctcagtactttgggaggccaaagtgggaaggctgcttgaaaccaggagtttgagacaagcctaagcagcatagtgagaccctatcccctaaaaatcaagattttttcaaaaaaagaaatattccattttttcagtaaaaatattaaacaaatttcaaaaggcagaatggacagcttatacatataaacatatagggatatgaaacacatagttaaatatctacctatactttttatttcattaatttaattggatacttaaaaacatgtactttactcaaattcttatgtgagcatctcaacacatggtttattcaaattctgatgtgagcatctccaccatataagagcctcctttttagccctccaactgagttttccagagttttccacaaaactccaactgagttttcttcccttggttcaaaacaggacactccttgaatcatgtatgatggtgtttctgaaagttgtctctgaaggcacaagtacctatttatataatattagcagctttttcttctaaataaaaatatttctttgaacaggtatatattttgatgtctatgatgtatttgtctcttgtattgctttttaaatagacttttcaaaatcgctgtttggaacaacatccaacagttggaattgtgaagtcatagcccctggaatcatgactaactgtgttcaatttccctgctcctcttttatggatcctagcagatgaccttcacgagcacccaaaacaaaccttgggtgaagccacttcagcccactgtgacttcctaaagcagtatttgaaaggacccaaatataaagcaaggtcgtctcttctgagggataataaattcagggggaagcaaacctcacctttgtatttgaggatatctggtgtattttagtgcaattctgcctttaagataaagtgccagctgacttaatggcagttgtgatctctgcttcatttcatcttttatctaatgatccgctagttagtaaacctgcaaatcctgaaagaaacataagtactctttttctttgcagtgtaatcaccaacaataaagctttatttttttgcattaacattcaactgcaatgtatttaaatgttccacatacacaaaaacacctgatttttcccaagatttgttaaacatagtccctttggtgtccttagtaacactgcaaagatgtcttcatgtaaaacttaatttgagtcctgattaccttactgtgaaaaaccgtaaacaccaaacaaaagtaagcataatatccaaatgcctaaaacataatacccaggttgaaggaagtgtaaatgttcagattcaccagtgggactagaatgtaaacttcttgggttgtggttcctccaaatcatctggccacctgggtatcatatcccacaagcatatggtaacactgatagagtaagctcaaagtgttccaacaccaggacatttcatggccacatcagaccaattgtatttttcacttcctctctttccctaacttttctcatacaaagcttcctacatttcctttggcacttagtaatacttaaatgcatcttcactgtcttattcagtgtttttagctttggaaggtgtatcacttgggattgctttcagatgcattaattgcaatctagctaaccaacagcccaacagtgatttaaacacagaaagctttcttttccggatatgcatgtgtgcatattttgttttgtttttcatgcaacaagatgtctgaaggtataatctgacactgagctggtatctcatggtgtcatgaatgccccagcctacttctattttttttttttttttcctctgctgtccttcagtgaggctttcactttcattgtcatagacggctgctggatctccaagtttgacacattctccctaggcaagaagagggggaaaggcaaaggggaaagaggatgccagccaagtcagtctctttctaaaagctttccagaaagttccatccagtgacttccacatacatctgcccagccacaaatgggtcatacagtctttcctaactgtaagagagtgtgggaagctggatatgagctgagcattgctgctccaaacaaaatcagatttctgttaggaaagaatggatgtaaagtggatcttaggaagggaacaaccaatgcctaccatacacaagtatttgtggtgagcagacatggctaagtgcctcttcctatctagggaggttcagggaattactcaagatctcttttgtgccagggaactagggagtcagtcatctcatttgctttcatttcctcatctctgaaatttcctactatggtattcctcttagaacaccatttagaagtgttatggttttctgttcttaatccaaatgtgacaaaatgtattctccttcttctctgataacaaaacccaaattctgacgggcagcatgtgcttagccttagataatgaataatgactggtctaacccaatcatggcgatactatgttcttttgccattgattggtattcagtagtaggcatgtgacctagatctaaccaatgagtggacatacactggggggactcatgaaagatttttcacctttggtaaaaagtcatagttgcaagaggagaaagccttttcttcatatgcctcttctttcctgttttagatgctgtcatgttaacgctttgtgcttagagctgtagaagccgtcttgtgaccatgaggcaatagccaaaagaggaaagagcctgagtatgaaagacactgggtcctttatgatattactgagttgccaaactaaccctgggatcctctacctcctgttttctcatagtaataaatatccctgtgatttcagcactatcactttaattttctgttacaggcagctgaaagcattcagaactcacatactatcttaacatcatcttccatgtgttatgggccaagagtatattcaagagtgactacaaaactacattcattgtcgtatccctgtgggactcccttaaagttctagtgttctgtagtgtactttccacagcctagaaggatatatgtttccctctctccagccctaaggaactcttaatttaagactgacaagatgaatgagttacaatgagggtgaatccaattcaaaagacgtaacaacaagcaagaaaagcaaagaaccttgtaaacacccatgttatggagtgtgagagtgtaagcttaaggaggcttttattttggggagaagatgcatcacctctgtttgaatgagagaaattaagttgtaattatgatggtgtttcagttaaattatttgatgtggaagacaaggagaccattcccaacatgttatttagcaaagaatatggaggagaggcagaagactgtgatggaaaacgttcagaggccatcaaccaaaatggtaatgcattcgaggcagataaagttgcttcttgctagacagaggtggggtgagccctgacatacgtcttcaaaattgcaaaaggcacagatctgggggggaaagggggttgattcaccaaatctcagaatagcagaatggcaataaccctactccaaggcttccagttttcctcagtttaactccttttgcatactgcagccaaagagattttttttaaaatgaagatcactcagactgtgtcctcttcctcttaatctccccaaaggaagaaaaaaacaatgatcaatggcaaatggcagttgcaatgaagcaacaccaagaacgagcttcgtgctcgggagagaacattgcatatcttcctgtggtttccagtgctctacacacttggggaaactcctttaagtaatgaaccacagaaatgacccctggaaatataatcttcaaagtgatcttttaaagatccaaatatttcctgttcccactctgcccagagatcttcagtggctcactactgcttccatgataagatcctaaaaccttgtcacaatccacaaggccttcattgtccatccctgcctgcctcactgtctttatctcccaccacactctgccttctctatgctcccacctgacaacttcttcagtgcgtggaccctattgtactctctcaggcctcaaaaccatgtaacatcctggacttcctcttcactggtctaatgcctactcatacttggcttctgagattgtacttcactccacatggagattatccacaaccatgccccactccaaaaccaggttaccttcccaatgtgatatacttgccatagcactcagcttccttttttataatactcatcacacttgtgattgattgactctcttctcctttacattgtaagatccataaaggcaaggatcatgtctgtctctttctgatgtgtaacaagcctgaacatacatacaataaatggccaggtgtaatttaccattgtgtggatgccatcttgggaggggggattctaatagttcaagggcatgtatgaaaaacagactcatggtaaaataataagaatagaaaaaagttactcagagtggtttaatggctggggtataccttttactattttacttagacatcaaaggaaaatcagtgtcctccctatcatgttccatgattttgtacaactgagtttagagcacaagctaaggtatcagacagcatttgacagcccagcttcactacttatcagctgtgtgaggtgatataatccctctaatccctataaaccttagtttcctcatctttaaaatggggataatgacaaaagcttttcaataagggtttgtgaggattaaattagataatacatggaaagctttcatcccagtgcttgccacagagttagcatgcaataaatgttataaagagttctttattgttctgcccatcaacatctgagacagaatataaacacaactgctcctgggcctggtggctcatgcctgtaatcccaactttgggatgccaaagtgggaggatcacttcaggccaggagttcaagaccagcctgggcaacaaagcaagactccatctctacaaaaaatgaaaaaataggtggatatggtgatgtatgcctgtagttctagttacttgggaggctgaggcaggaggatcaactgagcccaggagttcaaggctgcagtgagccataatcatgcctctacactccagcctgggctttttaagattccatctcttaaaaggaaaaataaatcaactggatcactagcctataagagcttaacaattgttaggtagtattactatgggtgttattgttttgttatttgtggcaaaaagtactagtgctcacctgagcacatgacttccttatgatcaggtaggtccatgtttgtcttggtcactactccagcccagtgcctagcacagtgcttgacacatggtgtgtatgcaatgaacacttaatgagtacttaaagatctaaccagtatgatagtgcagattctcttgtaagcaaatgaatagagaaaggcagtattccacagagaaggagacaggaaaaaagaacaggcttgattttactaaaaagaaaaacacacttttaagcagtaaaattagaagttcccatttcaatggcacaaaatagagaactcactgagaattgtgtgctataacatggtcaaagcagaggccgataatgaagggagcagcattcagaaccatcacatgtatggtcagctttcagaccctgaaaactcgattaaaacattccaggaaaccgctgcactttcattctaaaggaagattgtgaactctgttcacatattacaccccttcatattgctttgtctaccagtgtggccttttatgaagtgagggcttctttcttctaccttgctccatgacaatcaaacccaaaatgccttccacccttaaaaggaagttttggtaagtgccttattataactatcacatatgacacaaggctcaccactaatcggagacagatgagaatgaattacttaaataggacagaaatagccattcacttcaagaaggtcccagtttcttgaaagtctgtggcattgagaccatttacagtttgctgtcaagattcctagcagtgctcattaccttggctagcaatccctctggactacagaaaacttatctgaaatatatataatcacaggctgcaatgcctaagtgcaacaggatgatttaaaaagcaccatgatagtgttcccccaggacattcatctctccctgtctattcatctttgatccagacaaaaacttggaatgcaatctgtatattgatattccctaaaaaggatttcaccagctctttaggaagaattgttttagcggctctggaagtctagaacattctgcatttgtggtatttacagcttttgtttctatttcataaaaataaagccccactaagagcagtattcaattcctatcccaataggagtatcgaatagtggttaagcacatgttttttggaacgaagcagacctgtgttcatctctgggctcctcatagacctcttcataaacttaggcaaggtattcaacctttttgagtctcagctatatcaggtaaattactatgcgtgcacagaagagcttaataaatgttagatgttaatggtattaatattgttttgctgctgttttcagtttttctagcagagattattagtattcacccatgtgcacaggtagaccgcatttccacccatgcacacaggtagaccgcatttccaagcttcagtggagttacgtgggtccaaatgactgagttccgatcaatggaatgtggcagaagtgatgtacaccctttcctggatgggcctacagaaatcctctagactctactcctcactctccttttcccttctcaggcaccctgaaggctacttgttaaagaatttagagctacaggatggaaagaacctggatcctacctaagaacctcctaggagagccacccttcagaaacatttgcagtggattctgaatacgatttttttttttttttttttttttttttttttttttttttgccgagcacggtggctcatgcctgtaatcccagccctttgggaagctgaggtgggtggatcacttgaggtcaggagctcaagaccagcctggccaacatggtgaaaccctgtctctactaaaactacaaaaattagccaggtgtggtggcacgtgcctgtaatcccagctactggggagactgaggtaggagaattgcttgaacctgggaggcggaggttccagtgagccgagattgtgccattgcactccagcctggtgaagaagtgggactacatctcaaaaaaacaaaaagatacatatatatgatatatctgatatatgatatatatatgatatatctgatatatgatatataaatgatatatctgatatatatacatatggtatatatgatatacatcatatgtatatatggtatacatgagatacatcatatgtatatatggtatacatgagatacatcatatgtatatatggtatacatgagatacatcatatgtatacatgagatacatcatatgtatacatgagatacatcatatgtatacatgagatacatcatatgtatacatgagatacatcatatgtatacatgacatacatcatatgtatacatgacatacatcatatgtatatatgacatacatcatatgtatatatgatacatatatatcatgtatatatgatacatatgtacatatatatgtatatatgatacatatgtatcatatatatcaggtatatatgatacatatgtatcatatatatcaggtatatatgatacatatgtatcatatatcaggtatatatgatacatatgtatcatatatcaggtatatatgatacatatgtacatatatatcaggtatatatgatacatatgtacatatatcaggtatatatgtacatatgtacatatatatcaggtatatatgtacatatgtacatatatatcaggtatatatgtacatatgttcatatatatcaggtatatatgatacatatgtatcatatatcaggtatatatgatacatatgtacatatatatcaggtatatatgatacatatgtacatatatcaggtatatatgaacatatgtacatatatatcatgtatatatgaacatatatacgtatatatcatgtatatatgatacatatatacgtatatatcatgtatatatgatacatatatacgtatatatcatgtatatatgatacatatatacgtatatatccatatatatgatacatatatacgtatatcatgtatatatgacgtacgtcatatatatcatgtgtatatatgatgtacgtcatatatatcagatatcatatatacacatatatcctatatgtgtatatatgatatatgtatatatgatctatatacatatatatcatatgttctatgatatatatgatatatatcatatatgatatatatgatatatatgatatatatgatatatcatatcatatatgatacatatgatatatcatatcatatatctttcttttttttttcagttaagctactgggttttgacgaagctcattacagcagttagcctacttcagggtttctcagcctgggcactactgatattttggactacagaattctttgttatggagggctgtcctatgcattgtagggtgttgagcagcatccctggcctctatcctgctagatgccagtagtaacctctccagtagccatgacaaccaaaaatgtctcctgacattgccaaatgtcacctgcaaaatcgcctccgattgagaaccagcagcccacactggccaaaacatcaccatcattgctatcatcatcatcataggatattgatagtctagtctctcatgttccccttgaaatcactgcaaaaggactcaaagttccaaaagaggtccagcccagtttttttaggagaaaaaagtgaaatgacactaaaatttaagaaaaggtaagggatcaagcagtaaactcaaagttataggagaccaaaaaacaaagtaagaaccaaaataaatataatccttttttaaaaaagctagtttgtgtagtcccagctactagggaggctgaggcaggagaatggcgtgaacccgtgaggtggagcttgcagtgagctgagatcgcgccactgcactgggcaacagaccaagactcggtctcaaaaaaaaaaaaaaaaaggccggtttgatcactttggtaacctagaataaaatgattaaaacaaaaacaaacccaaatatctgggtctaggaatttcaatgtgtctaacaaatgcttatagaatatctaccatgagataagcattgggctgaatataacttggtaaataaaacagatataatccctgccctcatagagatgaaaggtaaataaaaatatggagttttttgtttttgtttttgtttttgttttttaagacagtgtcttgttctattgcccaggctggagtgcggcagtgagatcatagttcactgcagccttgaactcctgggctcaagtgatcatccgtactagctaggactataggtttgcaccaccatgcccagctaatttttgtattttttttatagagacgcggtctcactttgttgcccaggctggtctcaaactcctggcctcaaggaattctcttgcctaggcctcccaaagtgcttgggattacagtcatgggccattgcacccagccaaaatatgatggatttttcaaacagcttaaacacagtcatgaattgaccactgcaataggcagacttctaaagatgtccctgcaggattcccatccctgggccgggcatggtggctcacgcctgtaataccagcactttgggaggctgaggcaggtgggtcacttgaggtcagaagttgaagaccagcctggccaatatggtgaaaccccctgtctctactaaaaatacaaaacttagccaggcatggtggtgagtgcctgtaatcccagctacttgggaggctaaggcagcagaattgcttgaacccgggaggcagaggttgcagtgagccaagactgcaccattgcactccagcttgggcgacagagtgaaactccctctcaaaaaaaaaaaaaaaaagattcctgtccctggttatccaattaaacactagattaggtgctgccatgaagagacttagcagatgtatcaaggttactagtcaaccgactttaacataggaaggttatcttgaattatctgggtatgcctaccctagtcacatgaggttgtaaaaacataagtggaaggtggaagaatcagtcagagtgagaaagcagaagaggatgcaggagctatgctgcagagggaaagtcagattccaaacacaagaaagaaaaagataagatgaatcattgatggttctaaaatgtaggaggctctgtgtgaggaccagaaagaggcctgagggagctaagggtggagccctgcctaacagacataaagaaaatagggacttcagtcctacaaccacaaagaaccaaattctgtcaataacctgaacgagtttggaagttggtttttctgcagtctccagtaagaaacacagcgctgctgatacctcgattttagcccagtgagacatgtattgggcttctgactgccagataataaatgtgtgttgttttaagtcactaaattcatcatagtttgttatgacagtaatagaagactaataaaccattatgcattaaatatcacagaaaagaaagggtttaagaaaataggtattaaagtatgccttatcaccttatcattcatcaatctgaggtttactaaacacttgatgggtgctcattagtggaataaattaatgcactcatattttcattcatttgttaaaaatatgcatacagtgcctcctctttgatggtccctgggtgaggtattgaggttacagtagtgaaataggtattatcctctgtttataacagctcataatggaagtggaggacagaaacatgtacattcaacaataatgcaaagaacataataaagatattaacatcatcattataaaactatcagtaaaagtgtgaataagggagtacagaataataattacagctgacatctattgagtacttgtctcatttcccttcacaacaagcctatgagactgtattagtccattttcatactgctatgaagaaatacccgagatgggataatttataaagaaaaagaagtttaatggactcacagttccacatggctgagaagacctcataatcatggcagaaggtgaaggaggagcaaaggtacatctcatatggtggcaggcaagagagcatgtgaagaagaattgccctttataaaaccatcagatctcatgagacttaatcacgagaacagcatgggaaaaacctgcccccatgattcaattacctcctacccactgggtccctcccatgacatgtggggattatggtaggtacaattcaagatgagatttgggtggggacacagccaaaccatagcagagacagacccatgattcataccatcttgcagattaagaagctgaggtacaggcaggtgaagaaaccagcctaaagttactatcggtaagtggtggagctggaattttaacacaggaggtccaactttagagcccatggttttaaacacttcattgtgctgtctctcattgcagaagggtgaggaggcctcacagaagggctgagatttgggatgaataccttcatcaagaaaaggaggagccagtagaagaaactgcattggtaaagccagagattcaggaagaaggtggatggtgtggcatattctggaacagggctctgtattggcaaggaggggtggcagatgaggttggagcctaagttgtcctgacttgaaagacttgaacctctcagcagtttgaatttcgttctaaagctatcaaaagaacctattcaagagcatgatacggtaaatcatcttcagcaactcacatatcatttttaacattgtttcaggggatattagtggacactcttaggaacgcagtgtatagcccacaagtataatgacacttattaatacaacttagaaaacaccctttgaaaatgcatcaaaaccctaaaagattcgattaactctatggaaatgaggataaagggtagatgcatgtaagaatccagctgtcttctatctacaaagctcttcatatccacaaccacagagacactgctcagcttctgaatcgccttagttcacaataaaatagaaataaatcataataaaataaaatagggaataaatctatctgttggctttgagaaaatttctcagtagcaacaaaccaactgctcaaatcagaatcccccaaaataaataaataaggtacctaagagggaatgcatgtgttgaccaaaaaactaaaaaattctcccatttctgtctgacgttgaaaaaaatcataggtatttggcattttagcctatgctgttgaatgtggtagccactaattatatgtggctatttaaatttaaataaggtaaaattaaataaaatttattttctcagtcccattagccccatttcaagtcctcaacagccatatgaggccactggccactgtactggtcagcacatgtatcagacatgtccattgttgcaggaatatctgttgggaaaaaaatgaactacttatttagataaaagtagtgatttgttagacatgcctaataaaattcagtttattttaagattatgtaattaaattcagacttacttataagagtctgaattttcattttaatcgtttgtatgtatttcattcctcttagtatgaagagagtctatatcaagagactctctatggagacaggagccagtttgtattaggccccagctctgtcttgggctctgtgctaggcatttcatatctgttatgctacttaaggctcatgactccctgtgagataggcatgcttattctcatttttccctaaatggggggctgtgacaaggctgaagcaaagagagggcacaacatcttttcagggttaacacttgagaaacatctatttcttcttaagtagctctactgctgcttagagaagtagagtatgtagacaagacagttaaattttccacagatggggtttacttagagggagataagatttcttttgcacacaattgtagatttttttttaaatggtcaaaatcctcctgttctagcagtagctaagaagtgactcggggaagcattcaacaagtaggaaagaagtctgctcagatggaggccctgaatcagagatgcctgtcatctgttcccaaaggctccaaactcctgccacaaatacactgagggttcctctctctataacttcttctctttattttctctggaaggaatgtacttgatacttatttttaatctgagtctccttccacaaaaagtgtagaggatgtgctacccagcccctaaagttttgcctcttggtattcacacttgtgaagtcattttccatgtggaagagggctgacctgtgtaagcaataagatgctgcagaaatgtatgacttctgtggctaggttagaagagccatgagtccttaaagctttcccccttttctctctcttgagtggctgtctctggaggaagccagtcaccattctatgaagttactcaagcagccagtggagaggcccacatggggaggaactgaggcctcccaccaatactctccatcaagctgccaggcatgtggtaccttagaagtggatcttacagccccagtcaagccttcagatgactatagagccagaaccactctactaagcctgtcccaaattcctaactcaccaaaataacatgagatagtaaatgtttactgcagttttaagcagttgagttttggcataatttgttatgcagcaataggtacctaacccagagggtttttccagctttgcctatgggcaagtctacagatgaaacaagctgcttttcatatttagtgctctctctcacaattatcaggagatataattatcttaccatccaggctgtgattcttgcacacaagcaccaagtcatccattattgcagtctcccttcccatgcttgatgaataactgggttcctgtgatttttcctcttttctttccccattgactgttgaaattgtttgcctcaactattgagtcccttctcttcagtttgcctccttttcttttcctcctacatgagcagaagccaggaaattgaatgtattcgatcacaaagtatgcatgaccctcagcaacatgagcctacaatagtctttttaatgaccagaggaaggttgtgaggactcttagttaatttgttatgaacacccactcccataaggaagctgctatgtatttgtggaataaattaaataaaatcagcaaatttgcttattatctatttcctgccctttgaacacaggtttacccataaactacatttgttacacactaactgaatatggaaagcactatgggtaatgcaaaaaatatagcttgtctgttttcagtgtactcataagcaaatataggagacatcacaaagatgcaaatatgtattcatattcacatacatgcttaagtagacatttacatatcaaagacagtgaaggctaagggccaaatgaatggtacacacaagtgttaacagatcttcaaaagaagatgttatggctgtgagctgaattgatcagggcagcctttatgcaggaacaaagtcttcagaaggtttaactatggcagatactattacagatactacttgtttcatccagttctcctttagccccaagcatagagactcctgcacatctcagcctcttatgagtgggcaggatcatgtgactagctctacttagtggggcacgagaaaaagtaacatgtttcatttcttaagtcaaagaaaaaactatgtttaattctccaatctttctcccccaaaagttcacatgctctggggtaactagaggatgttagtggctccctcagcctgggtctatctgaatgactacaataagcagagccccctgacaactttttttgggcatgtaccattagcaagaactaaacctttctttgtgataggccactgtgatctggggactcatttgttactgcagcataacttagtctctcctaactaaaacagagattcccaaagatggagaaaagcagagcacagtagaggtagcttataagtcatgtcttatatgacctttctcaatgacaaacctgtgtgctcaccaagacatagcttgttatgacatatctgaatagaattgaaggtttttaaataaaaacataagaaggttggaaaggcagcagaatgagctactgcctgtgggtgatctttacacatctcagaataacaggattattgatgccttggccagaagcattcctttccctctgttttctttttctttgagattgcaagccatatatttccatttggaaaacagtatttcataacctctaaacctaacatgagtcctgtgaaaccctagtctacagttgaatggccaaaaataaagacttgaaattccttcaaagctatcccattttacaaggcaatgctttctctctctaccaagaaagtgttcctgcttgatagattcccctctcttgctgtatattacacttactgctctcctgtcactccctattctcttcctagttgtttgtgccttattaaattccacattttgaaacaaccaataagaatcagaaagcctgaagaagccctttctcatacaatcagagctccctttttatctaggaataaattatattttccaatcaattcatgagtgggattcattgacaatatactctctttgtaacatatttctgaatgagtagtaaatggtcttcaataaggatatggcgatacattttagctaaactgtttcataccgacattaactcccctgttaacttacttaggagtctaaagacacaatcaaatagctgtttctgactattattctcaaagcgaagctccaggccgtaatctcaggacatgcatgaaaatatcaagtaacaactcaaaggcccatttcagcttcaaatacctttgaaaattcgtgagtttgaggagcagagtgggatagcaggcgagtggaagaggaggcttctgagaaacttaattatctacattttagaatgtttcagtctttggccttttaatactgtagtatagcctggcttctgtcattctgaagggatttcccagcttaacaaaatcccaaggaaccaacctcagattggtctcttacctaaggaaagattctggcaacacaacaggaaggatttggaaaatttaatgaagattttgaaatacccctaacacacttaaattaaagataatacctatttcacccaaatctcctaaccccctgtggaagatcaattctaatttttgaggacaattattcatgtgttattggcttgaagtacagaatgtattagtaagtctcttcagttctaagtaacagaaaccaaatcaggctaggttaaaattgaaggggcatcattagaaggacccaagagtgtctcaaggactcagaggcaaagatgcagccagttccccccagtgccgggaaccagaaggtgggcaggaactcagggaatacagcccccttctatctctgcttctcaattctcatagggaaatatggttgtccacagatctcaggtttacctgtcatagttctagccacatgcaaggaatgactgcatatctctgaattccaaatttcagaaagtgagaccttggggtgggagatggggcacgcttggattcggtgtctaactctaattcaaacaacttttgccacggagccatgtagtagccaaatatgtttctaaggcccaagggaccactcttacaaagatggaagatagttcactaaaaagaagacatgctttctagactccacagccaccccagaagtgccaagataaataatagggagccagagtttaagcaagggccaccatcactgcaagttgtctcatccaacttctccctttataggaattgacatgacttcaaatattcatgtctgacaccaacgaagaggaatgtctgttcttgagctctttttctcggttcccaaggggccctcagtaccctgctttaccatttagtgtggattctgacaaaagaacaaattaagtactttgatttgattcttaatttttccttataaagacttgcaataaatattgtgggtacctagaaataatccaccatagtgcacaacacaatctgttgacttaccttagcttccattttccttcttggtctgacatataaattcaccttgctgctcaattctgtcacctactattttcagcatgtatgagcaacagtaaagtgcatgcccacagaactcagaaatgagaaaactaatattgctctgttatatgcataatggatcaatacagaggtatttaaacacacaaagaaaaaaaaaaacaggtcagcaagacttgactttcaactgatagagaatattaacatgtttatgggtagaaaaagtggtcagttgtagaaaaatatacaaagaaaagctacaaagagatgttggcagtggccatttaagctctgtctagggaaaggaagcctttagttaatggccttcaagtattctaatgtagggacacggcacccctactgtggaaagagatgcaggaggtggaaggtagctaaggccttggagtttcagttccacaggcaaggctatccttatcatgagaactgagcagcatgaagctatctgtagtctgacagtcatattgtatgttgtgtcaaatgaaaacatagcatcactcaattccttttgttctcttctcttgctaaacacacaactatctgatgctctggcttcccatggacctcaggcctgcttagaggatggaatgcaatagtcccactagtctgtgcagtgggccaactgctggttgtaaaatcacaaaggggccttctaggttaccgcgtctcacaaacttgggtaatgtaattccgtcttgaagagagagtcccccatgggtaagaccatggaccatggtaaatgagtgtaccccaggagaactgcttgggaaatagtcacttagcctattctcctggtgatgccccagacattgtcaacatggaccccttggagcatttcctcgttgatgtctacatttgttaccttactcttaattaaattttctaaaaagatggcacaataggagcactgagaacatgatttttaggaagaaaaggaatcccatgtaaacccgtttccatctgtggttcttgcctttctgtccttatccatagggcagctcattcttgcatatctgcagctcttgcatgcctgccattttgtatcttcctttttctcgttatatcagaagcattataataagttacattagaacccgttttgcatattttaacattgccttcacagtgaaactatagagagctttatggtggcactctagtgaatattctgttctgcttctgttacatgactaccttaggaaaagtctccgagaactcctgtctcccatgattatctctcctaatcaggctttctactatcaaactactcagcaaaaggaactcaccaacctatagtgctaccagaagtctaataacataacactgtcaccacaactttttcagcactaaacatgatcatttttaaaaatagtaagtttattaggtatataatgatactttccaagttccagcctgtttataaaggactctgtataaataaggaaggggcccaggaatggtgacatatttaacgtgtaagtcaggatgctaaatgtctgactgtatttgtttatttttttctgaaatggagtcttgctctgtcacttaagctagagtgcaatggcacaatcatggctcaatgtagccttgacctcccatgctcaagtgatcctcccacctcagcctcctgagtagctagaactataggcacacaccaccatacccagattttttattttttgaatgtatttatttatttatttatttattttttgtagagacgaggtcttgctttgttgcccaggttggtcttgaacttctggactcaaatgatcctcctgcctcagtctcccaaaggattgaaattacaagtgtgagccactgtgcccagctcctattatatttttaaaaggaatatactgaggaaaatacaaatggagttcaactgataaaaagaaacctctgtaatatgagcaggtgaatacaatttacaagatcatacttcagtatgaattcagtaggaattgcatgttttgcctgctgtgtgtccctaagggtgacacactcctgaatgggactttagtttgccataagcctgctttgttttgtttgtggtagaaattccatgctatgaggaaatgctttcatttcttttgatatctcatgagcgcttgttgcaaaaaacatttgtaggcaaacagcttcacacatattaaaaacttgtagcagaaagttaattccctaacataagttgtccagctcagggctctataatcctgtaattcattttggttccaataaatacgtactttctgtgagaccctttggggaaagggtaattagatatttcacatcagtgggatatctttccttcttttgctccccctccttctttccttctccttttcttctctttaattcttctacccagaaaaattctcaaggagcaaaaatacattactctctgcatttttataagctggccagttttgcttcctggcttttgaacagaaaattatgcctcaaaaataatcccacattattctctaaattcattttcctcagtcattagcccataacggcaattttccttttgaaaataaagaataatgatcatttattgagacaaatcctcaatcagaatgattcaaagagaatacaaatttaatgatcaccctgagaacccaagtaatacatctcaggaaataataataaaatttatgatggccttaaaattgcttaactcctttcaggaaaccctgaattatagggtagtaacataaccaaggactggcaacaactcacaaaagtctagaagagttttgcctttgagttcatagacaaagatgcttaaattgttccccgttcaaaaaataaagattatttattatttactttcctgtgcaccggacactcctgcaacatgactataactcttgcgttcttagatttgatcttcaaggtctctgaatgatgaaaaaacttgtagggtagcatgccaaccaacttgggttttttgtctgtttttgtttttggaggaggggaacaaggcagggagagagggagagggagagagagagagagagagagagtgagagatcacactaccaggagcttcataaagaaacctgcaatgcagaaccaaagtggatgaaagcaaaaggatacaacttttccctccagatgattttactgggaggaagaaagatttgaaactattgagtgctttttctgataaccacctatggctctctccaaagacacacatgtaaagttgggcaagttgttttctgtcatgtcaggaaaatatttagtagcagtcttacaaaagtaagcactcagcgccgtcccagggagctgtggatttgctgtgcagccttgtttccttcaacaggttcctttgttgctttgtgtgttctcccgacaaagggcctgcccttcttctacagatgggtttaccattctctctgaatgaagactattcagaagtacacaaaccaacaaaccatccaagctgcctctatctgatggtcctggtatatccagagtactaaatagtggcctacaggatgggaaattcacactgactgactccacaggagactgagaaagcttaactggctgatagctgtaaagtcctttgaaggaacaagcactgtttaaaattctaagtagtaatcttataatttgctaatggaaagaaatataacccagctaatgtgtgcctcccatttcagagagtatgtttcaacagcaaagccctttacaatatttagataaacttcgatgtatagaaagtgcaacagcaaggtaaacagcagggcttcccgctatggcattttaaaatgtggtgggtgaaatttgtcactcctaagcaagtgcctatagtaaaaataaaatatcactatttatatggtatgtgttaaaaattgtccactctccccaactacaccagatcaaaacctcttgttttttaaattatgaaattattgaactgtattgagcacacccctacttatgagttgtgtaacctggggcatgatattgaacccctctgagtcatttcctcatctatctagacaaggctaatggtaatacctacattgtagggctgtcgttagaattttaaaataatttaataaaataaaggctagtatttattaaactctaaatacatgtttgctgctatcagcagcagcagcatcggtcggcaatcacgccaacactcctcaaagaaaacagttctgaaaaggctgtgtgcatcctaggtctgaagattttcttggtctaaagagtctcttgggctagtgaccaaatccttcattaatttcaagagctctgggaactctctgaaactgaatgtggaatggtataactactggtctgtgcacatttttctagaaaacctcacatctttcatcacattaagaggttaagaatcattgccatatgtagtcattagcttacctttatctactttctacttctaacggagaactagagtcctgtttagaacaagtaaccaggacagggacagaagaaggagactatgcatctgtcactcttgctgattagtctccaccctctcccagcttctgcgggcctcctctcccaagagttgcgatcctagacccacctcccatctgcagtctcaacctatcctcttctaaggactaatcatggcatatggcaggagagatttaagactagctaggtcaatgctctaagctcaacatcaagtcacctctgaggcagggtgttgtcatggaatgatcatgacctctgaaataggaaggtctgtgtttgatttggcttgaccacttactggacgtgtgaccttggaaacgtttacttaatcatgtcttttgtcacctataaaataaatacaataagatttacattgtgagtctatgagagagaaatgagataatatagagaatatttttaaaatgggagcatatgtcaggcaacagtagatgctcagcaatgttcttttcttacctgggcttcaacctggcacccttggtcaccttcccaggacccaaatccctctaggaataaactctggcccttgctggcttctttattcttcctcccacctacatacttgaacccatccaaagaaataggtctgactaccttggaaaccttttctgatgcttactacttgtccaacattcatttttctgtaccatgtgtgtagatactggattccccatcctagaattctacccacctcttgggctaccctgttacaatgtgtgactgactatcctactcccactttccaagttaaccacttaattgaatggctgcccatcaacatactccttaaatgccaagttagttctgtcaaacccaatccacagacaagccttatcctcaaaccttttctgccctctgccacagtgctaactggttcattgtgcttgttcagcatgcagggacctttaatttaatgggcctctcccatttttcacatatcatgaaagttatcaaatttaggttaattaagtttaagacatccatagttattcgagtgaaaacttgaaggcagcataatggataataatggtaaaatgataatttttgagctcttagtagatgccaggcatagtcctaagcagtttaaatatatttttttcatatgattttcataacaatcctacatagtagattatgatcattatctctactttataggtgaggaaactgagacttagagaagttaagcaaatggccaaaagttatgcaggtagtaagtagcagacatagaattgagaagacagcccccattctaaataagtatgaaaaatttcagggtgtcaatttttagctaaggaaaacttattcatgtgtgtgtgtgtgtgtgtgtgtgtgtgtgtgtgtgtgtgtaaatgaatagatattcatttacttatatatctatttcccaggcctcaatgcaatcagagatctctgaagaagtgaccatattatgaacataaatttttgacttcataactttacagtgataaataacctcaggttatcaggatcctaaccttaaaccacctgagattttatcactgttcctttagtaagcaagggatttttcaaccctgagacagataaaaaatagattgtatggtcaatgaaatccattatattcatactttttggttgagtttaggtaatggaacaatctgagaattttgtatcaagtatttgtgatgtttaagaggatttatcatatttaagaatctgacagattgcccctgcaattagaagtacaattgattactgacttctaattttaggttaaaaagtttaacagaatttgatgtttttaagtagtactgagatgtttaaataactgaatttattctttatgagtctagtatatttgattcaaaacatggcttcaaagcttagaaaggttttgcttgttaaggttgtgagcttgtactgccaagtattcgaagtgtttacaaagaaagtaaaattgttaaatgtgtaaagttattttaaaatattgatgaatacatttaacaagtaaatacaaaagtgtatttaagtagacattattcttttatggcattcataaattcataaattgcacaagataacctgagttgctctaaatgcttttcaaacttaagtttaggggagcaacatcagcaagatggctcactagaaactccagcactcatcccttccacagtgacagccaaaacaatgaataaacaactacactttaatgtacataactgaaggagagtgctagaatacatcaaaggagtaacagaaaccctggtgagcacagaaactcaggacagccacaaagagaatggaaggaaacatcacaactccaccaccctatccccagctgagatgagccagaaacccagaggaaactttccctataggaaaaaggcaagcaagaggattccagtagcctccaccaacaccttggacacccacagtcctcactactggagtccttgtagtcttcactggcactaagtccagctgagggagctgcctacaggccacacagccacactcacctcagagaaggaactaatactgtgctctattccctgtagcccacatggcaactgtgctatatcatcttagaactggaactactgctgaagtgtgattttctctgagggtgagcaggcttgacacccctgcctccataaggctaagctgcctccaaaccaccccaaaccagtggccacagccaagctgccagcagctgttaatgcctttccccatggagccaaacagtgaaaactgctctacctgccctccctcaccttcacctgccctctcccttcacctgccctcttgtgctagagatgaagcaatacattccctcctggggaaacagtgctttggcagaacagctccatctgcttctctccgctgcaactgtacactgcttctaggggtctgagccaaaatggcacagtatctcccaaggaaatagtgctttggtaggaccctgtatcccaggtaaatggtgcctgggccacacagaacagtcatgcctgagttaaagtgtcacattgccccttggggaatcattgccttggtcaagttaaacaactgtgcatcccagggctgagctgatgtagtatcttgtgtcccaaggaaacagagtagaacatgacctaagacagtctaccctactggacaatctagtaccctgctttcctgaagctggactagcccactagagtctgaactgctaagacctgctgtttcctggggagtggactcatcactgtgctactccctgccctccaggacccaaacaatacccatgctcagtcattctagggtacttgctgccactgcgcctggccacatggagtctgggatacagatatgccccaccattccaaggtctaaatttaccactacatagttcttcattctcagggacctaagctgccactgaaccctattggcttaggctcctaaattatagctgtaccatgcatgctgtgctcaaacccctaaaactctgcttctttcccagagctgagccagggctgtatcctattccccaggggtagaatcacagctacaacctgacccactgaatcaaagctggtaggggctgcctaacagtcatagattctggctctgtgggaaacctatatttgacccagctacagagagtgaacctgtaccccaggacccaagagccacaataggcttgtgaaactctgatattagcaccctgactccatagccacttcaagtaccaatccctggaactcaaagcaatggaactgcttgtaggccatgtaagagggatcctcttgtttaattatccccattgtgaggaaaatcagaataggaggaccccaaaagccctgccactgaggacattaacaacctatgttgtcactgccactaccatacccctttttttttaattatactttaagttttagggtacatgtgcacaatgtgcaggtttattacatatgtatacatgtgccatgttactgtgcggcacccattaactcgtcatttacattaggtatatctcctaatgctatccctccccctgcccccaccccacaacaggccccggtgtgtgatgttccccttcctgtgtccatgtgttctcattgttcaattcccacctatgagtgagaacacgcggtgtttggttttttgtccttgcaataatttgctgagaatgatggtttccagcttcatccatgcccctacaaaggacatgaactcatccttttttatggctgcatagtattccatggtgtatatgtgtcacattttcttaatccagtctatcattgttggatatatgggttggttccaagtctttgatattgtgaatagtgccgcaataaacatacatgtgcatgtgtctttatagcagcatgatttataatcctttgagtatatacccagtaatgggatggctgggtcaaatggtatttctaactctagatccctgaggaattgccacactgacttccacaatggttgaactagtttacattcccaccaacagtgtaaaagtgttcctatttctccacatcctctccagcacctgttgtttcctgactttttaatgatcgccattctaactggtgtaagatggtatctcattgtggttttgatttgcatttctctgatggccagtgatgatgagcaccaccatacacttttacagcctaagtcattcaggcatccacagttactgttgacactgaatgcagctgaagaaactgcatagatactataccactgaacctacctggaaacaaagtcaccacacttttcctaattagcacactaagatccaactacaggtgaaagtctttctctgcaaaagccactctagaaagtctggaagaggcaatttttccaccaaatgcatagacattgatgtagaaacacaagaaatatgaaaaagcaaagaaatatgtcaatgccaaaggaacaaaataactccctagtaacaaaccctaatgacaagaaaatcaatgaattgccagaaaaggaatacaaactagtactcttaagaaactcaacaagatacaagaaaatacagatagacaattcaacaaaatcagaaaaagaatttattatataaattagaaattcaacagagatagatattataaaaaataattcaattaataaaataaaaaatacaataggcagcttcaagaacagacttaagtatagaaaacaatctctgaacctaaaaataggttatttaaaattacttagctagagagaaaaaaaaataagaaagaaaaagagtttttaaaaaagactacaagacttataggacaccattaagtgaacaaattttcatattatggcagttccagaaggaaaagatgtattaaaaaaaaaacctaatttaattatctaatagctgaaaatttcacaagtctggatagagatgtgtatatacagatccaggaaactcaaaggttcccgaatagattcaagccctgatgcacattatagttcaattgtcaaagtcaaagacaaagcaagaattctaaaaacaacaagagaaatgtgtcacagtacatttaagggaatccccattagactaacagaagactttcagcagaaccttatagaccaggaaagaacagaaagctacattcaaagtactgaaggaaaaaaactgtcagtcaaggatactatatccagcaaatatatcctttagaaatgaggaagaaataaaacgtttctcagagaagtaaaaacagggaattcatcaccactagaacagttttacaagaaattctaaagggactcctgcatctggaagcaaaaaatgattatcactactaagaaaacacacaaaagtataaaactcactggtagaggctgagcatggtggcttacgcctataatcccagaattttgggagtccaaggtgggcagatcacctgaggttgggagttcaagaccagcctgactaacatggagaaatcctgtctctactcaacacacaaaattagctgggtgtggtggcacatgcctgtaatcccagctacttgggaggctgaggcaggagaatcacttgtacccaggaggtggaggttgcagtgagctgagatcgtgccattgcattccagcctgggcaacaagagtgaaactcatctcaaaaacaaacaacaacaacaacaacaacaacaaactcactagtagagcagatacacagaaaaaaagagaaaagaagcaaaacttatcactacagaaaatcactaaaccacaatgataaataataagagaagaaagaacaaaggatatgcaaaataaccagaaaatagttaacaaaacgacagaagcaagtcatgacttatcaataataaccttgaatgttaacagaataaattccccacttaaagacatagactgacttaattgatttaaaacaaaagaaaacaaaaacatgatccaactatatgctttctataagaaattcacttcactactaaggatacatacagattaagagcaaaggaatagaaaaagatactccatgcaaataaaaataaaaagcgagcaggagtagctttacttgtatcagataaaacagactttaagtgaaaaaactgtaaaaagagacaaagaggatcatcatataatgataaaggaatcaattcagcaagaagctacaacagttatatatgcatccaacactggaacacattgatatataaattaaatagtattcaatccaaagggagagatagaccccaatgccataatagttggggaccccactctcatcactggataggccatctagaaagaaaatcaacaacgaaacattgagtttatactgcattttagctcaaatggacctagcagacatttacagaacatttcaactgacagtggcagaatacatattattttcatcagcacatggaacatcctcaaggacagatcacaaaggccacaaaataagtctcgacaaatttaaaagaagtgaaatcatatcaagtatcttttctgaacacaatggaataaaactagaaatcaataacaagagggacttttggaagctctatgaatacaacatgctcctgtataaccaaagactcaatacagaaattaagaagaaaatttaaaaatttatgaaaatggaagcacaacatatcaaaacttatgagatacagcaaaaacagtgctaagagaaaagtttataacaataaacacatcaaaagagtagaaagactttaaataaataatctaacagtgcaagaacaaaaatgaaaacaagaacaaaccaaacccaaaattagtacaaggaaagaaataacaaagatcagaggagaaataaatgaaattgagactaaaacttacaaaagatcaatttttaaaactttttttgaaaagataacaaaattaacaaaccacgagctaaactaaccaagaaaaatgtcccaaataaataaaattagaaacaaaaagagagaccttacaactgataacccacatatacaaaagatcattagagactagtacaaacaactgtacacccacaaattggaaaaccaaacagaaacaaattcctagacaacctaacaagattgaacctagaagaaatagaaaacctaaacacaccaattacaagcaacaagttgaatcaataattttaaaaatgttctatcaaagaaaagcccaggacctgatagcttcactactgaattctaccaaacatttaaagaagaactaatgcccatccttctcaaactcttctagaaaataaaagagaagggaattctttcaagctgattctacaagaccattattaccctgataccaagccagataaggacacaacaaaaaaaggccaaaatccctgatgaacatcgatgcaaacatcctcaacaaaatactagcaagttgaatccagcatcacattaaaaagaacattcaccatgatcaagtgggatttatcccagcgatgcaaggacggttcaacatatgctaatcaataaatgtgatacttcacattaacaaaatgaaagacaaacaccatatgatcatctcaatagatgcagaaaaagaaaagaaaattcaacatcccttcctgataaaaaccctgaacaaactaagtatagaataagtgcacctcaacatagtgaaggccatatatgacaaatccatacctaacattatactgaacagggaatagctaaaagcttttcttctaagaactagaacaagaccatgatgcccactcccaccactgttattcaacataacattggaagtcctagccagagcaattaggcaagagaaagaaataaagggcattcaaaatggaaaggaagaagtcaaattgtccctgtttacagatgacataatcttaaatacagaaacccatataagctgtaccaaaacattcttagaatgagacaacaaaatcagtaaagttgcaggatacaaattaacatacaaaaatcagtaccatttctatacaccaacaatgaactagtgaaaaaataaagcaagaaagcaaccttacttacaatagctacagaaagaaaatataaaatacctaggaataaatctaaccaaggaagcaaaagatctctacaattaaatgacaggacactgataaaagaaattgaagatctggttacaaaaaaaggaaaatatcccatattcatgaattggaagaacttatattgttaaaatgacaatgctaccaaaaacaatttacagatttgatgtaaaccttttcaaaataccaatatcattcttcacaggattagaaaaaatcctaaaatttatgtggaaccactgaagaccccaaatagccaaagcaatccccagcaaaaagaacaaagctggaggtagcacattatctgactttaaaatatacaagaaagtgataataactaaatcatcatgttactggagtaaaaacaaacacatagaccagtggaacagaacagataaatcagaagtaaatcctttaattatagcaaactgatttttgacaaaatgccaaaaacattgagtgtgcaaaggacagtctattcataaatgatgctgggaaaactggatatccatatgcagaaaaaatgaaactagacctctgtctctcacatatacaagaatcaaatcaaaatggactaaataattaaatgtaaggcctcgaactataaaactaagaggaaaacattggggaaaatgcttctgggcattggtctgggcaaagattttttggataagacctcaaatataaaggcaacaaaggttaaaatagacaaatgggattatatcaagctaaaaagcatctgtacagcaaaggagacaatcaacagaatgaagagacagcccacagaatgggagaaaatatttgcaaactatccatttgacaagggattaataaccaaaatatataaggaactcaaacaactcaatagcagaaatgctaataattcagttttaaactgggcaaaagacctgaatagacatttcttaaaaggagacatacaaatggacaagaggcatatgaaaaaatgctcagcatccgtaatcctcagggaaatgcaaatcacaaccacagtgagataccatctcaccacagttataatggctactatgaaaaagacaaacaataacagatgctggagaggatacagtaaaagaggaatgctagtgtactgatagtgggaatataaattagtacagccattatggaaaacggtatggaggttcttcaaaaaaactaaaaatatctacaatgtgacccagcaatcctgctgctgggtatatatctgaaagaaaggaaatcaggatattgaagagatatctgcatacccatgtttactgcagcactattcataatagccaagatatggaatcaacctaagtgtccatcagctatggatgaaaagataaagaaaatgtggtatatacacacaatgaaatactattccgcttattttatacaattaagcctaaaatatattttaaaaaataataaaatcctatttgcagcaacatggaactggaggtcattatttttatgtgaaataagcccaacacagacaaatattggctgggctaagtggctcatatctggaatcccagcaatttgggaggctgagggaggattatttgagcccaggagtttgagaccagcctgggtaatatggcaagattctatctctataaaaaaattaactggctgtcctagctacttggaagaccaaagtgggaagatcgcttgagcccagaaaattgaggctgcagagggccgtgtctgtgccattttaactttactccagcctaggtgacagactgagaccctttctcaaaaaaaaaaaaaagaagaagaagaaaaataataagaatgacagacaaatattacattctctcactcctatgtggaagcttaaaagtgtggatctcatggaggtagaaagttgatgggtgctactagagcctggaaagggtggcaagaggggtgaagagaggttggttaatagatataaaaagacagctagatagaaggaataagttctagtgtttgatagcacagcagggtgattatagttaacaataatttgttacatatttcaaaatagctgcaagagagaatttgaaatgttcctaacacaaagaaatgataaatgttcaaggtgctggatatcctaattaccttgatttgatcattgcacgttgtatgcatgtactaaagtatcacatgagcctataaatatgtataattattatgtatcaataataaaaaacattaagtttaaaatatatctttaataaattaaacttttgttaaaagcccaaattatagtaaataaacccttctgcatacaaaaagtgatctattagccactgaaaatcttataagagagtttttatgacagacttatgagcaataataagtattttaaaatataaatcagatcatgtcatgccttggcctaaaactcttcattgtttaacagttactcttatgagaaattccagtctcccagccaaggtctatgaaactcttcaaaattgactcttgtccacttctacctcctcaccaattatcaacctcactaccccagtcactttggccttttttcctctttctgatacatcatgagcttattatggcaacaagtcttttatatttgttaacttctctacctggagtacttttcccaaaatattttgcaaggtgggctcttgcttgacatttaactctcagctcaaatatcacctcctccagatgcctcctctaattgtcctttacaccaataacctctgacacattcatatgttttacagtcttaggaatatcctcaatgcctgacttaccatattcatttattggctcccatatttatttccccctctcccaaataaaataaaagctcaatgagagcaatatcttgtctttcctaaaccattgcttggcacatattaaatgctcaataaatatctgttgcacaaatgaataaacttaaataaataaaacacatctttgccttaataccaagttatttttaaatcatatccttatgtaatatcgaatccataagactcaattatctggggtttatttgacaaatttgattatcttatttgggggttaataccatgaatggctaaaaataggccaattgccaagcagagcacacaagcaaatatgatccctccccaggatgcttgccatccaaattacaagcattgaaaaatcttggcaaggcgcctatgctaataagaaagtgatccaatattcatgagaagaacttgaaaaactattatttttgcctgcaatcttcttggcttttccataattaatatgtcattatcatcagaaggctaagagatcaagagtggtaaaagcaacctttcatgtaatactcatagggacaatggtatttagcaaatatcacattgacttctggtaagagaaataatccagaatctgtggttgctagaaacctagtatatggaaaaaatagaggggcagttggcatcaagacagaaaggtagggttttaaagctgatctagaggtagaaaaaaacacattctagagattcctgaagaaacaaattccaagtactcattgtcatgaaaaacggtatgatggagtcctaccctctgtctgtattgttcttttttaaatagatcttcctggttaggtcaggaagaagctattcttgaatgccagttaatacattcctccatttactcaacattctatccctacaccaaattagctcagtagaaaggctatctagactatctactacctaggtcataatacattagcaacctgtacaaatgtcttttcagagtttcagtttatagcatgccgtggtttgttatccagggtgaatctaggaaacaattagatctataatctcacagcaaacttcatttgactatatttgcaaatgttatcaactatgttatttttttaccatcatatatataacgattgatataaaaagtttttcttacagttaggaaaaatttgtctctcctgacaaagtggtattcttccttttgcaactaatggcagttatgtaacttgcttctcttagatggccttggccatctaagaagctcagagcagaactaacttgtttaggtcgtctagaatgacttcttccgatccctatttttctctgcttaaacttgttgttcagttctgttaggacttttgttttgttttgttttttacatatatgccttttctcattagttggttaaaatacgcttttaaagtgtataagataaaaatagtagagccagacacggtgccttacgcctgtaatcccagcactttgggaggccaaggtgggcagatcatctgaggtcaggagttcgagaccagcctggccaagatggtgaaaccccatctctactaaaaaatacaaaaattagccaggcgtggtggcacacgcctgtaatcccggctactcaagaggctgaggcaggagagtcgcttgaacccaggaggcagaggttgcagtgagccgagactgtgccactgcactccagcctgggcaacaagagtgaaactccgtcccaaaacaaaaaacaaaaaaaaagagtaaataattttgaaattttaagctcccttttaccaaaaaagggttctgacttctggccagaatgtagtaaatgtcaagaaatcagtcacagctgaggtagtgccaggaatttggtgtgggggacaggaggagacaagcaaagactatttaaaaacaatgaattttagcctgtctataagtactcttttctatgaaaacataaaaggaaatttcccttacaaatgttgattgataaacatgaacgtctatatggaaaataatgcgatatctgagctaaaaggactcttagtgaactctgatccaatctccttgatttgaggatagggaaaagtgtaatccctaaaagattaaatgatatttccaaagaaacaacaagttggtaattaagtccggcctgaaatctggggcttctgcttcccaggttatgagctttctaacactccaagaactgtgaaccctggagggaaggttgtaatctgactttaactcctgaggacatgtggatatgcccttcagggtccagggacatttgggttgcacattaacagttaaaatatgctaaagcaccgcattttctccaactccattcaatgcctaaggtttattgtttgttcagttttagccaactatatttcctgagtgtttcaaaaggcagcaaggtggcgaggatacaagggaaagccgctacacattcaacataggaatacaaagattatagtagaattctacgcatcaaattccaattcaaatttcttctggggtcagtgtcagtatctcccacttcctcctgacacatcctgagctgaagatcccttttaaattttctttctaagaaaaaaaaaaatataggtttattgatctcctttaaatgatagctttagaataacatgtcaaattatttctgtttcttgacttattctaggaaaaaagacaaagaaataagatattcatataaatgaaaagtttcacagccggcaaccaactaattggtatatatttaaacacatttaagatattacttgattacattcaataggcataatgtccatataagaacaatggttttgtttggaacatataaaagtgatagttctgtaacatgtatttatttaactttttattttgagataattatagattcacttgcagtggtaagaaataatatagacagatcttttgtatccatcacccagtttctcccaatggtaaatcaagatattgacattgatacaatccacctcagatttcaccatgttagatataagttctaaatttctcatcaaagaataaatatgccagtatgttcaattctttgccttctacttttaaacttaacttcctcgtaaagtaacctttttcgattacctactccaccccgactcattccaattcctactccaccccaactcattccgatcacctactccaccctgactcattctgattacctgctacctgctctgccctgactcattctccacgctgcataaccattttttttccctccaaagcactcaccccctcactctctttaaattagccaattggaattagtttcgcctgcgtggtctaatcctagccaacaggggaacgacacggcagcaggggccatgtgcctcagggataagaacaccttcccctcccttgtccaagtgtgcgctcaccattgttccatctgtaagggcgtacccttctgtagaagtaacttgccttgctgagaattaaaagaaaattttatattcgatgccgtttcttttgcggcaccgaaactttatatataacaaccactttgacattcatttatataaagatcaatttttaatagctacaatctatagagcacttctatatgccagaccaactgctcactgatgaacaaacattcttctagttcattcctacaaaaaacaatttaccagtggaggcaatagtgaggactgtagcttagaagctttcatgctacaatgtagtatatgctacagtgtagtaccctatagctgtatgggtggttcattttaaaaattgtatatgcagccattcctcaataggctcaaaataaatattgacagaaataggtaagtaaatcaaaagagaaaatcaaagccaggaatcaaaagaagaggcaaattgggttaatatgattcaatttacgtctgggcttcttggtagacaggacaaaaaggtaaacagaatgagatatgcaatcctttttgtcaaaaggggaaactcatattgatcctttaagatatagatgtttaaaaatatgtctatgtctgtgcacatacccttatgctagctccagctcagttttttaaaataatcttttcagtcagagtttatgaacatccaaataaaactgtgtcaacacatgcttaatacatcagtaaaactatttttaataatgtactctcctattgaatatgggttggttttctgacttgctatggcccattgagtgcacagatgtcacagtgttctacttccaggtagtccttaacaaggctggcagcttctactttgaaactttccaaaaaattagcttccatgatgtaaaaaaaaaaaaaaaaaaaaaaaaaaaggccaatccagaatactacatgataaacacttgtgaagagactgaggtcatgtgcacagcaccaatgcacagatacgagtgaatccgttgatcttccagggcagcatagccgaaagctgaatgcagcctagtgattgacccagcctacaccaaatggagcggaacaactacccagccaagccacgccccaattcctgacctacagaaccttgaaaaataatgaatcactgttggtttaagcaacagaagttttgaggtagtctattacacagcaatcaataactgaaacaataacccaaactgataacctgaaaattcattttgtaaacctgcatctaaacttggtacaataattaaacattttctgtgcaagtagtccctcttatatgactagaatgtgtggaatgcctaggagcagcttttccaaatgaattcatcaataaacataaaacataaaatgaactgctctagttttcccagagattctgcctagaacagactgccctaggacagatgattaagttagtttgggtccaattcatgactacataacatggagttagttatgtcttaggctacgtcccttcaggcaacttggagcctcccagggttaaagaagctctgccaaaactcaaaatcaatagggccatttaaatgatgacatccccagtgggtaaagatatttgactccacacatcaatggcatgagctactgtcatgggcattcgtcaataggttgaagatctcattaaagctttttaatttctgcttagtggtattaggatttaattgatgccaaagacactgcctgtcactatacagtgatgttgtggcagtcagtagagaatgtcttacacacagtcctagaagaccttcctagaaaggccagggcagttctactggctgcatttcctggcttgacaggctactgctactttatagtagctctctctatgttgttctaccttcccatcatccgtgcacccatcttcttttaccagcaacccaattttctgaaaaactactccatctttattcttagtccatgttgctcagaagggtttgattctacccacagcttcaggcatgggcacaccacccagatcaggttgatcaccctggacatataactcaagacagtgtcaatgagatcaaaactttgaactctcaccaatactattggaaatgagaaactctattgtttcccactgggttgctaaactggtagaatggaatgggtatatataactgacagcctttttgccattccagggagataaaccctaagaacaaacaatgcatagatcacttgatcttctggatccagcagttctagaagtcatacgtgtctatattttttcagtatataagccaataaaatatcattttcatctaggctgttttgagttgtatttgctatctcttgcaatcattctcagaaactgccaaaagatgggctgctgcacaactatgggatgatggaatgccatttattttctgggacagtgcaatttattacaatttattacactccctttctgagccatagatcagaaagtacccgggcgttaagacaacagcacttcaaaaaacaatatcatacttgatcttcataaagttaagtgagcaaacaaggaaactaagacattaatgagacatgtggttcaaaagtcatccatcaaatcaaatatggcaccaagactggaaaccaagtcttcatgaaatgcgaggtttctgttgcttgaatcaatggaccttaaaggtgatttggtcttatggctccccaatgtcagtccatggattgggatctgttgccagagtatgttcaaatcatcaatagtccacagagtaatgagaaaaataaagaaactttgataggttttaatggagcaatttcatttcacttttaaagcctgaaatttcatccttccaggtttgtttggttttttcttttggtgttaacatatcctctttttgaaataatagcaatagtagatgtaaatcatcttttttggctaaatataaagtaagcaagcccatagcctcccctggaaggcactgccattgtttccaatactctcagctttaacactgacagctacccttgctctctttctcactgacacccaccaactcaaccagccctctcccaccacacaccctttctcaggtcacctctgtgctctccacccttggagctttacctctgggtaattcccttgtcttttgtaatgtatattagagtgtatattagagtgtaatgtatattagacgtctataactcctgctattactctgctcagcaccttcttaggacagaagcagctatcctttctcctgagaaggtgggaaaaaggcaaattatgcatacttataaataaatatttgttggtctcaaacaagtaaatttataaacattgatactaacattactggaagcataaaagcattagaaagacattaaatgccctacagtagagtgaaaattaaattctgccatctaggagaatagtatttagtcattaaagttatgattataaatactttgtaataatatgcgtaaatgcatatgatataaggttaagtgaaaagatacataactacaaaatacaactatgttaaaatatccatgcatggattaaaaaaatacagctttaactgcatagtggagttaccggtaatgtctacttttatatttatagaaatctctgttgtccagattttctgcaatgggtacatatgacttttgatggggttcagaacatgctaccacaaaacatggcaccttggcattttgaatattttaagctgaaggagtctgagaaacagcatgtgctggaaggactctctgaagcaggtcagaagccccttgtgtgagaggtccctccctaaacccagagaaaaggagcatccttatctctgaagatggagggacacacggagaagaaactccaggaaccagccttggtaagtttcccctagtttactacacttagttcatatgcttttccacaagtttccactcttcatcaaacctagtataaaagcactcaggtttaactgattcatcagattttccttccttatgaatgctctagtgacacataaaacttgtattaaatacatttgtatgcttttctcttattaatctgtcttttgttatagagccctagccaagaaactaaaatggttaaagggaagatttttcctacactttaaagtgtacaaatatatatttattaaagttagttccaattattatgtagccaatatttactgattactctactctgtagatgccaagaaagccatactctttcctgatagtttcctttgtgtgacaagatttgccacagatgtaggcaatgttggtattatacttttcttgacagctagaataacttctgctaagctaggcaaccacatctctccaagccatccttaatgcctaatgactgccactgcacctgacctagctccagggctgaccctttcatgtttaccccaaggccatgcccatctgggaaaccacctgggcaggtaccttccaaccaaattaaagtcaaggattccatccactatcactaaactagcacaaaccaagagagagaaatcaaggcaccacataggggttaggacaagtaatcaaagtcaggtagaaatcccagaagggtggtatacaatttatatttccctagtgaggcccattctagaataatgggaaaggttcactgttgtcagaatgccaagaatgaattctctgaatctggccttccctgaaatcaacacttaggttctgacaacctctaaattcatcctcactaactacatcaaacatttagcatgctttttattgtggggatgggggttgcttttgtttgatttggtttatctggcatctgaaacaaaagatgggaaaggatgacattcattcttaacctcgtgtatagttaaccacatcaaaaaaggctattgttagatacaaataaacgttaacatacattagttccaaaaggctaaagcctttcaggtgaacattattggacactttctcccctgtgccagacaaaactatgcatggcttattcccagagtcaccccgtcctttccaaggcattctatgctgcctcagggatgcaaacaattatggtacttccaggagagaaggagcacataaattctgtcaccccttgaccccaggatccaatttcacagcaatgggtgaaaggattttttagtcaagagatgatgtgagacgcacagataccccttggagtcatttgggtgacagcattaaagagaatgaaatgagctatcttgaaatggaggccaagtgcagtcactgcatctggaaagttaggctccttgatattcaaagctctggggctcggcaaaaaattcaaagagcttttagtattcaaaacaaaacaaaaaaaaacaaacaaaaaaacaaaaaacactctttaaaaaattaaaatattcaaaactgtggaaaacttgcaagaatcatatcatgaacatcccatactgtcttcccaagattcatccatttgctattattttgccatatttgctttatctcttcctcctcctctgctccccttccctcaaacaaacaaatgaaaagtggtttttgctaaaccatttcggtgtaggtgtgaacattaaaagcttctaggaattacagtagtctctcacacatacaatgatcaaaatcagggactttaacgttgatagaatactatcttacacgtagtccatatttacttttcttcaatcccgagtgtcctgtatggccactttcctccagtctaggatcgcactggcttttagctgtcatgtctctttagcctccttgaagctggaatactttctcagccttcctttgcccatcatgtcattaacattcttgaagaggacaggcctgtggcttttcagagaatctatgctggtctgactgttatatgaggattagattcatagtacatgtttttgaaaggcatactacctaagtgatagcatatccttctcattgcattacatcagttggcacctgatgaaacttggtcccattcttgatgtgttaaccttgattccttaaataaggtgttttctgccagattacctcactgtatgtgtgtgtatgtgcaggtattcctctttttcccttttataattaataatgtatgggaagacttttttctgactgtgtaaacaccctgctaatcaacaagctttcactcaatggtttaacacctattgacaattctactctgaatcaattattactataatagttgtaaaaaagtgatttttctaactctattatttctttcacagcaattagttggttttctagtgcaagaaacagctgccctttctcccttctttccttcctttccctccttccttccttcctttctttctttctttctttctttctttctttctttctttctttctttctttctttctttctttctttcttctttcttttggttatatcttactcatttgattcttaagtgtcccatttcaagctggttcctgtgtcattcagacaggtcctcattttttttttaatcagtttttattttctggcacaacaaaatgttccaggcttttcttgtcctttccctgctctgaaactgcaattagtcattgctctaagcaggggtccccatccccaacctccaggctgcagactggtaccagtctgtggcctgttaggaactggctgcacactaggaggtgagcagcgggcaggggaacctaactgcctgatctccgcctcctgtcaggtcagctgcattagattctcatggcaacattaaccctattgtgaactgcgcatactcattatgagaatctaactaatgcctgatgattttagatggaacagtttcatcctgaaactatccccgctcccctgccaccgatggaaaaattgtcttctatgaaaccggtccctggtgccaaaaaggttggggaccactgttctaagggcccttatttttagtggggaatgctatttagaaagcaagagctgggcactcagtgtgttcactgctgctaggagtgttattgcttgcaggccctttaagaggacaagtaagaattataaatatatattgagtcatgtcttcctattgatacttctaatctccatccaatagctcaggctcttccttgcctttccccaatccacagttgtactgccctccttccacagtgataagcctgactccccacaaaataatacatttacttaatcctacaatggatacaaagtaatttcagaattgtcccacaaataacacaaccaagaacaaatgtataaagttcaagatttctttccagtacttctgttgtttgattgaaggccatgcccatctgggaaaccacctgggcaggtaccttccaaccaaattgaagtcaaggtactgcattcaaaataacttgaatcagtatttttttcctatgtgtaatcatgtcatccatttgatatatagttaggttcatttactctgtactcaatttcccccatcttgttatttaatgttatttcggaatatacaaaccatgaacatggtttcaaactcaaaactatataaaaaggtattcagagaagtactacatcactgtcttccttccctaactcttctaatgctattcccaccctgtagatgaccaatttcatatcttctagtttatccttcctgtgtatccttttgcaaaaataatcagacacatagataaagacatttttatttccccttctttctacctgaaatgcagcatgctatatatagtcttccacattttgctttttgcactaccaatatcttctggtgatcactccaatcccgattcacagggatcttcctcatcctattttacagcacactactgcattaatgtattatggctcattcaaacaatctcctcattacaacataaccacgatgatgctgcacatattattatgagagaagttgaacatattttcatatacttaaggacccttttttatcaatttttgtgaactttctaggtctttgctgcttttctatcggatttatggtctctttagtctcctcaacgtgtagtaactttctatatattagcaatattagcattttatcagaaatacatcttgcaactatttcctcctggtttattacgtgtggtttatggttttttgccatgccaaagaggattttgtttaatttctaactttacacaatcagattttactacatctgaagtttgaattgtgaaaaacctttccttgtgcttttcctttttgttataaagcaatttcttatactggctaatttttaagtatccctcattacactatacatgggaatgtatgtaagaagaaaatcctatttgcctactgaccgctgggcaacttcaaaactgcatgacctttatttctgcaggcccttcatttcctagctgcatccctttcattttccctaaccccaggtttcctcagcaggccagcttcactagagagctgtaaactaaacctaaattactaaagaacacattactcactcatcataaccataggaatctttctctagagcaaataagaattagtagtacaaatctgttttataatcacatactttcacaaagcaagaatcaccaatagtatactttattgtctctcattgatgggtacattttctcttattatttttattatcaaataatccatgtttattttaggataaaattaaaactacagctaggcaaaaacaaatcaagatgttggaactgttaatattttagggcatatatgtaaacacacacctatttaaaaactctcttctttttatacctattaaaaaaaccctctgttctctactatacttgctattttgtaatctgtttccattttcatttaatataaacatctttccatgttactaagttgtctgcaaaggcattttaaaaggctacatggtattatactgtataaagacataaaatattgaaccaaatattgtgctcttaggatttaaaaaaaatatcgtaaacaactctgagaaaatttactcagacacacaccttcatgaatttgttcaaatgcttctttaagataaatacctaaatgtggaattgcaggattaaatagtacacaagattttcagggttttgatatacgtggtcaagttgccaccagcagtgtatggtgggttccctttacccacactgaacccacattagtgttatctttctctgtaatcctttttatctcctgatttagcaagactaaacaacagtgtaaagttctgcaaaagcaccagataagcaaatttagaacaaaacattactgatgtctgcccaaaactctgtaaacctgttcctaggctctaagctgtctattgaaatgtcctaagaaaccatttcactcagagaagaacatttttttcactcttcctgcacagctcagtctttacgatgttaaaatcctgtacaacttcctaacagcccttcacattcttcaggagcccgagtttggttctggttataaatgcataggatagatcccatacgggaagcatagacctaagaaatttatggaaaggaatttatgggaaagcttctctcatcagggctgtaccaattaaaaatccataaataattctcccttgtcagtttctgtataaacacattggccttagaaatttttacttcaggttctagtctaatggcctacacttctaaattatgcttttaattgaaaaacaataacatgcattttttttccagaaccatctgtgctttcccaagaacatgtaactactacagataaatccgctactttgaacaccctaattatccagtttagggttccaaaagcttaggaaaataatgccattcctgaaaaacagtacgtgatcagaaacacttgctttaaaattcgatatttggtgtgtgaagcttcttaacaagtgtttattaaactgcataatttcaaagcctggagtggtatattgcaatgttttcctcggagttgatcacatttgcatatctttttacacttcctgtgaaattaatattgccttttgtatctcgaacttagctaatataacttgccatttttacttttcactgctatgagtaatataaagtgaacccccaaagggacccctgcaacgcctacataagctttattctctcactgttgtattttttcatatgaatatattaaatcaagattaataaacctttgcagaatccactggtcctgcaaaaaggcaagattcataacggtaaaggctgctcagcaaataaaggaaacctgctcctaaaactggagccaaaggccggggttcatggagctcttgtcacatccaacagtgtgccagagactcttcacctcacaagaagtctttcaacagtcactcaataatatgtgcaaaagtggcttaaccaccaggataccaaaacccagccggtgattatcaggctgccttggctcagggatacatctttgtgagatgccaaaaactgaccataatcccaggattttaaaaatttcagctgggcttatggggatggaatgtgataataaagaaacaggatggtaggggctgaggaaaagtggaacatgatgagaggctcctaaaagcaaatcaaacacagaaaagggaaatctctctgaacactgcataccgcactgggcacaggagtcctcagttgagcatcccccactcattgggccccagcagctactttgcctagctaagaatctgctcaaagctcagggaaacctaaatggcaatacaaagaaagagttgggggcagcttcaagatagcaggctactggtacaaatactttgtgaggtcagaaaggctcactatcatgacttgtactgctgtcattgattctcctacttcaagatcatctccaacttggtcaagaggcagagtaatggggattcagggccacagttagggtgcagcaaatgaggtacaaaatttaagtagaactaaaaacaacctcagtagccaggtgtggtggccatgcctgaagtcctagctacatgggaggctgagataggaggatcacttgagcctaggagtttgaggctatagtgcactatgattatacctgtgaatagtcactgtactccagtctgagctacatagtgagatgcccatttcaaaagaaaagaaaaaaaaaagaaaaatcctcagtaatcaagataataatacttcagtgcaatctttttagaaaccaaaaaaatcatggtgaagaaaacacaattttaaataaatattaatgccctgccaaccatatttgagcctgcatggacacttctacctacatttttaatatattttaaaaattaatttttttggagaaccttaaagtcattgaagaaatactgaaaaattggaaagtaggtatattaaaacttacaatattaaatgtaaatattttatttatactaaaatcagaattcattataatttcactttcctgactctaatgggacaaagtaattttatttttatgttttgagatagagtctctctctgtcgcccaggctggagtgcagtcgtgcgatctcagctcaccacaacctccacctcctgggttcaagtgattcccttgcctcagccttccaagtagctgggactacaggtgcatgccaccacgctcggctaatatttgtatttttagtagagacgaagtttcactgtgttggccaggctaggggacaaagtaatttaaacatgttttcaaaacttacttctttgtttgtcttcttttcaatggaagaattaccatgtttgacattctcttatcacctagtgacaatcataaatgatttttaattaaacaatttactttctttaaattaattttattttgtttttccttagctttaggctccaaaatggcttggcactgtactaatccttatttaaaacttcaatgttttgttcatcatggatttttctggcatttatttgatttttgaaaaaaatggaattaaactatttgtcttgatcactaagtatgttgacattctcttaaactgtgcattaccttgttccatccaaatcaaagtcaaggatgtagccatctcagacaaataacataacaatgactttaagtgtggaaagaagcctaagatcttttattaagtgaaagaagtatgtggcagaataatatgtatagtatgggctcacttgcacttaagaaaggccagaaaaacattttaaagaataactctaagtcattacacatcaaataaacattgacggcaaaaggtaaaaagtgtagttactgaagcaagagtttctaaatcatggtgctgcaaaataatacactgggtgtccaagtagcagtaacaactaagtattaccctctgctaacatctgatatctttgaaagattgtctctacaataatgtcattctcattcacttgtagctaggtactttttttttctagagaaagagatgggatttcagcatgtgtactaggatgacaagcaaacactgtaggttcaaggaagttcatgggcatctcaacaatatgtgtggtggtgaaaaatacactgagaaccactcatctagctgctactgatcctattccataagctaggaatacgtcataagtactgttttgtcctcgcgttggggatttttgttttgttttgtttttttgtacctcctcagtatcctcctctgttaagtaatagcatttttgtttgctttttagccaggtttatggaggtataatttaaaaatagtaaaatttacacttttagtatatatttatatgaattctgacaaatgcatatagttatataacaaacaccacaatcaagatacagaacatttctatcatcccaaaaagttcccatgtactttgccatagtcaatctttaccctaattctccagcctctggcaactgctgatttgttttccctataattttgcctgttcaaaaacatcatataaatgcaatcataaaccatttatgtctgacttcttagtgtaaagcatttgagattcatccatttgatgcatatctcagtaatttatgcctttttattgctgaatggcatcctattttatggatataccacagtttatttatccatggtaataggatttggattatgatttcacaaatcacccatacttcctttcaggtcatgtggtttataaagggctgacccgaaagttccagagatgcccatagccaggcctgatcaaataacatattcagtcatcctgataatatggatggtttagagctgggcacatggtttgatgtaacaattttcgattcaagacaactgacagaactattggtaagaagttactgatggtataatggaaactgtttctggtagctattgcaccaccacaagggagccccaacttgaggataataaagccaacaggaagcaaagtgcaactaagtggatgagataccttcctaacctagtttgagcacctggatccagacatgcctaaagatctacctgtagacctgtcagttacatgaacctataaaattccttctagcctaggccaattttgattatatccctcattcctgaaactaaaatctcttgactctacagcatagaaagaaatctttcatcaaggaggttacaagagagtcttggaaacaagacacaaaaaatggttttgacatcagacaccccaactttaccacttactacttcctaagtatacaatgtcaagaattctctttactcctataaacctgtatttcctcatttccaaaatgcagagaataattccttacccattctaaaatattatcttgagaatcaaaaaaactaagttggttcaaatacaaaagaaaaataaaatgtatgattattatacacacaaaataatttgtatatgaaaaggagatattaagtgatgacggtgagagagaatcaagaggcattataaggatcaatgcagaactccagtgcttatataaggatcaatgaacaataattgtaactagaggtatttcttgagtatattcttgtgttaggcattgtgtcaggtattttacctacattatatcatttaacattctaaatatcactaaagtaactttttaaacccatttttgattaggcttagagaacataaaatactttttaagttaaagtactaactggcagaggccaaataaagacctaaatctggaccactgaaactagtgcacacttctaagttagatggaaggcatgaagcaaacactttggaaattaaaattcagttataaaaaccatcacaacacaattaatttagcaactacattcctttatacataattgtgccgagtgcatctaactcattaagatgtagaatgtttatgctgtcatataatattatcacatggtaataaatgaagttgcactatatctctaaacatctggatttcagagccaattttacacatttaattcagctatttggtgtcttaaacacatagcaaaaatacacaaggaaaaaatgattgtacatctggcatcaagatggctccaagaattggactgccaatgaggaagtcaggtttttctagcctatatcctctggaggataaatacccaaaatagtactgtttccaaagtaaccaaaatcaagaaaggagactccacaaaggaaacaagaatgaaaaagacaggcctagcccttttcaaaagctgagccttccctcccaggatccaaggtacttagggtttctcatacctgacaacctataaacgagaaagagtatcacttgtttgtccttccatttctcattttccagctttggtgcttatcaggttctccagaggtagcaaatttgtaagacatttcatctatttagattttcatttattcatccatcctttcagttactcagtgatgacttctatctgctgagccctgcactaatgatccaaaattcccaatcttcctgcctaggagagatagggagaggtagggaatatggcttctccattttctccttttcctttagtaaccaacctctactggaattaatcctttgagttcagctgggccttgagatccaacatgatttgttttaaaaatcaaggcaactattaatgtaaaaacaaaacaatacaagtattaggagaaaacatgagagaatttctgtacaactagatgtggggaaagcctttctaactataactcaaatccaaatgcaaaaaaaaaaagaaaaaaaaaagattgagaatttcaattacctgaaattttttaaaatttgcatagcaaaaaataccataagcaaaaataaaaaattaagtgcatgataggagaaaatatttataaaatatatcacagattaagctccaatcaccctaatatatattttaaaattcttggccaggcgcagtggctcacgcctgtacttcctagcactttgggaggctgaggtgggtggatcacaaggtcaggagttcaagaccagcctggccaagatggtgaaaccccatctctactaaaaatacaaaaatcagccaggcacggtggcaggcgcctgtaatcccagctactcaggaggctgaggcagagaattgcttgaacccgggaggcggaggttgcagtgagctgagatcacaccactgcactccagcctgagcaacagaacgagacttggtctaaaaaaaaaaaaaaaaaaattcttaaaacccatttttagaataagaaaaatagaaaaacaagtagttcacagatgatataggaattgcccttaaacatatgaaaatatgcttaattttacttataataagagaaaagcaaattaaaactacactaagaattataaccatattactctaacataagaggttatcaataggagaacctgggtgtggtgtacacaggaaccctttactatcttcacagcttttctgcaaaccgaaaactcttcttaacaaaaaagttgatccaaaaaaagtacattgagatactatttcttgcctatgagattgtcaaaagttgaaaaacttgacaatatactctattagcaaacagagtgtagagcaacagttcctctcaggcattgctagttagagtgcaaaagggtataacctgtgtaaagggaaatttggcattagttaacaaactatgtgtctatttccttttctatctttctacatacctatctatatatttacttaccagcaatgtcagttacagcattcaccctgaacatacaccttcaactgtatgaaaaaacgtggacataaaattattcactgtagtgttatttccagtaaaaaatactggaaagaatctaaatgccatccatagatacaatcaatagtagtcctttgtgtgaacaaccaatatacacatagaactactattcaactgtaataaggaatgaggaggatctttataaaattatatgaaataattgccaggataaaaaagcaaggtgaaagagtatacatagcatgctaacttctgtataaaaaggaagcgtatgtatatttgcttctttttataatgaagacatgaaggataaaccagaaactaatgaaaatattttcaaagagcgtgagtaaaaatggagctggaagggtagggatggagtgggactttcttgaacaatttttttttctagttttgacttgaaccaggtaagttttgacttgaaccaggtaagttttgacttgaaccatgtaaagttttacatattcgaaataaaaaatttaaaaaggatttataaagcaaaacctaaacttgcatacaggcaggacataaatggatctaatgatatatcacatcaacgtaaataatcacagaggaaaaaaataaattcaaataatttctgaagacagtattctgaatgtatatccttagtggaatattaggaaaaaaagaagtccaaataaatcttgaactttacttaatagattgattgtcaggaggggtattgatatagtaattctgaaactattttccgtgtactataggatagagcaaatgaatcgatacattaggatctcactgtggaataaaggagatacaaatatgaaatgagggaaagtgcggaagaatcctgtgatgttgaatttgaatggttgagttgtacatggtaacatacatgcatctacctatctgtctacttatctacctatctaatctatctaatctacctatcgcctagcggcaatggcaccccagtagcaatgaacccacctagcggccaaaactttctttctaaattccattctccagtaaagggagacagggcttgactgattcttgattggggtagggaaaatgtaaggtaaggttgatacatctttttttactccaggacatactcaaagactgatggagatatgtcaaaacgacataggaactagcatcaggggatcccactggctaaatgacagacaatttgagcctcacaaaagaataaggagctaagtatagttatatcattttgtggaacttcattgagctgtgtgcttataatttgtgtatttttttgtaggtatgctgtatttcaatatgaaatgtagtgtctttttttaagaaagctgtgatacaagcagcaaataagacatataatttactttagcagaaaggaagaccgtgctctatgaataaattgttctgattacactgatggtcatccatcctactatggaaacagaggtggagacctcttttggtaagaaacaacgtcagcccagaaatgtataataatacaaagagaaaaacatcattaggcacaaatcatcgatggacaatagaacccatgagtgaaaggttcttgggacacaaaatagttacccagtctcaaagtatcaccccacagatactaatttcaaggcaaaacaaaacacaaaacaaaaaaaaaccttaaaaatggagtgacctgaagaatatccaagatgaaacagcatcaccaaaactggcacaaacaaattatatgactctgctgtgatccactgtgaagcaggcaacattacctagatagtactttggcctacaatgaggaacaattggacagatccacattgtgtggtattccacaatcactgggtcggaatcttcaaaaatacagactcatgaaagagaaataaaaggcaggagaatattctagattaagagggtccaaagagacaaaataactaagtgaaatgtgtaatccttgattgtattctaaaaagaaaatggaaataaggaaaaagagacattacaaggtatgagggacattaatggaaacatttgaatatattagattacatatcaatgttaaatttcatgtggagagtgataacagtattatgattacatattcatcttaggaggtataaggtgaaatgtcagggggtaatatgatatctatgactgaaatgcaaatgattttttaaagtataataaatgagagaaaaaaagccaatgaacaattacaacaaaatgttaataactggatcctcaagggggaagagtaattgggatagactgtacaaaaattaatcaaagataactagcatattttgaatgctcactgttgtcaggccctatttagagaggtttgcaatactaactcatttaatccttgcaataactctatgtgattgataccacatatatccattttacagacaaaatggaaacctatagaagtaaaataacttgcccaggctagtaagtggagtagctggaatttgaagttaataaatttagagtcaaagtttattatcatatccacaatactactctgcccttcaaataaataagtctgtttagaggagcaaacacattaatcacaccaatcttatgattacatgcaactgatatctcctgtgtgcctaatgcagaattctggagggttcaattggttccaattagttctttttcctgtaccagaaaagaagatcagcaataactggaattctggggtggcatggagtgggggtgttaaattttacaaacacagcatccaaaaatagtatgttcagtcatgagtattatctttaaaatagagaatataaagaaagtctgaagatcaacatttaaatcaaagaaaaaagaacaaaagtacaggtgctttgaggtttagactatgctgaaaatgccattatagagcagtccatttcctcagtaggtagccccaaaagacccctgacacagtagaaattatatcattatacaattaatcagttttctttcacaatggcacaatggggtgccctctttaactcaacagagtaaccagctcaccaacagtatctagaaaagaggaaagtcacagaatggaaaaatagacacaaaaagctatggagaagagagactgaaacagacaaaggcggttgtactataaaagaaagcgagaaatggaaagggaaatgtcagcaatctaaggttaaaagagaaaagatcaggatataaaaagatgtagaagtctcttatgaaaaaaaaaaaaaaaaagggaggggaccagtgaagagatagaaatcatgaccagagtcgaagcttgaaaacgcagggcaacacacaaagagaagctgtaatagcagagccattcactcaatcattcatttcactcattcatttaatgcctaacatatgaagggtactttgtggagctttgagagacacaaaaatgactaagacaggacccctgccctcaaagagcccagctgttccaaatattctcattttggtatgctccaatttttaatgtaattttaattattgttgtcacaccttagctaatattttcatactcaacatgtacttccagaaattgcagcaactataccatctataaaagagggtaatcttggcagggagcggcggctcacacctgtaatcccagcactttgggaggctgagatgggtggatcacgaggtcaggagatcgagaccatcctgcccaacatggtgaaactccgtctctactaaaaatgcaaaaattagccaggcatggtggtgtgcacctgtattcccagttactcaggaggctgaggcaggagaatcgcttgaacccggaaggtggaggttgcagtgagccgagatcatgccactgcactccagtctgggcagcagagcgagactctgtctcgaaaaaaaaaaaaaaaaatgagggtaatcttaaatggatggcagctgccatacagaatgagttcattcgttgtggaacggaaacatgtttacatttctgatatgctgatagtatataatgcagtattgtgatgtggttctctgtatatatagatgctgtctatactttttttggatacagcacactccacatcattctattttatttttatcatcccattccagagaggaggcaaaggacaaggaagtctaaaggatgtggaaagacaaataaggaagttaaaaaacaggttttcattttctttacaatttcccagagggcttctatgacaaaaagctgtactgaacaacggaatgcgtatttgtcatagagtagctgagagtgaattctaggtaaacatacaagggagaggctcctagacagataccattgcctagtacctttcatttaaaagatacctagtgatatatgacttgggaaaaccagaaattgacctcccagcctgcctcagtatatggtctttgctcttaccaaggttggcttgctccctgaaaagacctgaaaattcaagtttgaaaaggtgtttcatatacctaatttagaacacacccctcctagatctataagagtaggtgagaagcatagaaatgaacacctattattttgaatgctcatcttctgattcctttaatgcactgtcccgccctttaccctctccccaaatctttgtggttcttttgggatttcaattgaggtgccccatctctccgccagagataggaatgtgactcaatctaaccaatcaaaatcttctgggggaagtgtatgaatctgcagttagagagaaggctttccgagatcttgggcacttaaattcacataagtctgaagctgcttagagatatttcttcccccaccacaaagactgtgactgaagaaaagatgaagaccacatggagaagaggaggactgtgaggggggtgagagcagaggcgaatttatcctgaagctactacatcttaagcttacaggtctttctctctttttttttttttttttcccagacggagtctcgctttgtcgcctaggctggagtgcagtggcgcaatcttggctcactgcaagctccgcctcccaggttcatgccattcttctgcctcagcctcccgagtagctgggactacaggcgcccaccaccacgcccggctaattttttgtattttttagcagagacggggtttcaccgtgttagccaggatggactccatctcctgacctcatgatccgccggccttggcctcccaaagtgctgggattacaggcatgagccaccatgcccggcccaggtctttctctagcgatgtgttcatatggtcatttataatcttcttatagagaaggctctccaaactgtatgagctttgggccacaaaatcctagattcacccctgggagagacagttgtgaagatacaataaggcacacatagccacccataacagaagccagtgtcaccccactggacctgcaattatgtgagccaatattcaccctttctttttatcttgggataatccaaatttggttttacccacttacaaagggaagaaaccggagattttaaagatagaaataaagtcatggctcgtaacttgctggcaggaaaaaatgagaaccaatgctgtttttgactttcagagtatctatcataagctatcattttgtttttgtccgcatttcagtatgtggtttaaaaggaagttccaacatcatatttgtaactagttataaggaaccggcagggaacagcctccagacatttttcaaatatatttttcctttaactggctataaaggacaataaggattaagttggcaccacaaaaagtcgcatttaatgatacccttttgtgtgttacccatttaccaaacatggatttttatttctgcattctatagaatacttattcgccactgagagttccatttaaattctttgcatgcacacacacacacacacacacacacacccttccaccaccactaccaccaccatcattttcatcatcatgtgatttcagaagagcagtcatgtctacagtaaaggtatttgagagctaaacaaagcctcctggctagagatcctggtatcttcctttaaacccagatcattcatggtatgggttccctgcagagcactggttgtggccccaccaagcactgccatttccagcactgtcagtttctttaaccttcaagagaacacagaagagtcattcaaagccagcaagtgaagagatgtcctggcagtctaatttcaaacaggcctcataccagagtcttttttatggtttttaaaagaagtattttatgctgctctgatgaaaacctctaacagtagtagcttctgtctgacaaataccatagagaatgaaacaataagtctgaagcaaagggagggggtaaaattatttttgtttcaatagccaacacacaatgaaaacaagaaactatagaggtttaaagaataaccgatatttattctggtaaagacttttctcatatcagcactttaccactgtaagatgctgacaataattatgtgaatgttgctataaaaaaattaaatctcccatctcatgggtttaaaggtgtttccgcctctgccttacacacacacacacatacacacacacacacacacgtacacacacatatttcaggtacctctgtcaggatctcccaactcaattatactgcatggaggaaaaatatgtatactactactactagaataagaataaactagtaaacaaacaaatagaatacaatgtaagctgcagtacatgtaatctgaaggcctgaagctcatgtgtgctaggtttttgattgagcagtggtgggggtaaacgtggcacagcagttatcagcctggactgtggaatccgatcataccgggaaatgaatcctggcttactcattgagtaacctggtaactgaacctccctgaggcccaggttattcatcaacaaactgatgacagttatcccatggggttattatagggattaagtgagaaaatgttatataaaggtgaggagtggcagaatatgccaccccaaaatatgccactttggcatgaggattattttgagctgaaggcagttgagaagaagcagatatgagagaagctctctgtcttccccctatttgccacaaaacaggatatagatttataaaggtgccctccccacctatcaggaaagaaaaagttaatcatcagagataactctagatattcactagccagaagagacaccagaggaatctatgtaacaagctttactaactagcccttccattagttcccccatatatttaccttctcacaatttgcagaaactcaaagtcctttcctttgtcttaccatttctctaaaaatttattgctcttttttaaaaagctatataaggtcacattttaatcacccctttgagtcactcatcactgggtacttccatgtgtatgtgcaagtacatgttaataaacttctgttttttcttatgttaatctgtcatttttcactctactttagagggccacagctggagaacctaggagggtagagggaaatagatttagtacaaagagcttagtgcagagcctgtttcacaatgaagcactctgtaggtgaaagcattgccatgattaatgattgccacaaagcatccatgttggttaaacagacaccatgcctaagggcatataatgactctgaggaaagctagacttgaagaaaacacgacttgcccagccaagtaccttggtcaaaacacatatttgtttgactctatagtgttgagacttgagtatctaatatacagatgaatgagccagtacagaatttgaaatttcaacaaaaaggcaagtataatctgcctgataataataagcaacttgtaaatctttgaatggatgggcttgcctgttttcacccatgctactcaaactgtgaaccacagaacagaacatcagtttcacctggggacttcatagaaatgctgagtcttaggtctcaccctagaccttctgtattccagaattataataagatctccagatgatttgtaggcatattaaagtctgaaaagcactgctgtggaccacaaaatttaatgtactgcttatcccactttgggtgtgtttctgtgatctttacaacttaataaaccacccccaaaagttagtgactttaaacaacaatttatttgtcctgcttcttcaatattggcagggctcagtgagacggctcatctctgctccatatggtgttgactggggtagttcaacacagactgcaagatgcaagctggcttcccttcattcacatgcccttggctgacctggctgggacagttgggggctggctgggcctctctccatgtctttgttgttcttcaggacctctttccaaatggagtggtctctctcctgcagcatgatcagacttctttaagtgatggcaccaggctccaagacagtgaagtcagccatcttaaagtctaaatctggaactggcactgtgcatttctgccattttctgttgatcgaattgagtcaaaaggcaaacaaatgtcaaggggagaaaaaagactttatttcttgacgggagaagaggtctgcacagacagtgtggaaggatttgttagcaacagtttttgcagacaagctaccacagagtatctgttacttttcactttcttcatctctctgttctcctgattggtcaaacagccacttcatttcaattacacaactatatgcgaggtcccattgggagcataaggaattttaagacatgatatctcccatcaaggagcttgttataatacaattggtaaaataaggaatacatatcttgaaattttaataacaataaaatactgtaataataaaatatttaagtagcagtgccagataataacagaaatgatgtcctaaggccatgaaccatttatttaattaatcgtgcacacaataaccatcctgagtgttcagaagagagaatggaaggggaggagaatggccatggaaggacggttgtgcagtgagtaagacttgcataggaaaatgagtaaggttttcaaaaaaaaaaaaggtccaatgaaatacacacaaaggatacaacagaatcaaggagccaagggaatggggtcatagggacacaaggccatgaatgagtatctgcatgttcttcaatgatgattatcaattcaatgttcctgaaagaatttcctgcctcataacgtccacctttacttctccctttagatatgttcataagctatttgtggaatccccaccagcaatataaccttgtattaataatgaagggtttttatgaaccttataaattttattataccttgtagagagggtgggggaacaaacaaacagaaatgtaggcattgccaaatggcaacttgtaaacttcactattcattgtgtaggaactaacacttttggtattgttaagtagccttgtaaatttcactctcccttagaaaataaaaatggaatgaaaggtgctgcttagaagaaacgtataaatttcaatctccactgcaggaaaataagctctgattacactacatagttcatacacctcaatgttccgaacacttgtttttttacagattcatgtataatgacttggttttccaacaacagagagtgaaatttacaagttgttatttaacttttttaggagtgtatttttcttccatgtcttttttttcttctttgcccctactcacaccagaaacctaatatgagcaatgggatttctgaatagtaccatacattaattccttcaataacaatgattaaaacattttaaacattgttctcagggcctcctgataccacatataaaagtggggaatgacacagcttttggccacacagttcaaaaaattgctctttaccttgttggggaagaagagggcttattaaaagtttataataagcagtattactagtatttaacttctatttgttgttgaaaagaactgagcctataatttcagaggcttccgagcattttcataaatatacccattagatattcaatagccagtggatttgaatgattttgccatttattcgaacagatagctgtcctggacaggaaggatagaagcattggaagaaagtgttagaactacatttccataaagtcatgacaagaaataaagaaagaaggggagtcaccacctcaatactagaagtgtcagcacaatgatatcctcataaaaggtgttctaaaagaaacttttaggtgttctaaaataaagttataaatgccataccaagaaatactgtcaaaacaaaagtcaagtacaatacagcccagaaagaaccaaatacatctttacatcagggagtaaaaatatacatagatataatatccacaattgtcttaatttatagcttttaaatagataatatacatacaaagtgaaaaattgaaaccacaccaaagtacgttgaaaaatgtcttcccactcatgctgttaatgatctctgtaccctcttcaacatatgcatatgtgaacatatacacacattttaaatttccatgactacaaataatggcatattctaacccatttttcacttaaaaatgtcatagagatggttctgtatagacccatttttgtgatggtctaattttattacaaagattataaagtatagatattccataatttatttacagattctcctattgcttggacacttaagctgtttttaatcatttgttgttaaatgcaatgccatggcgaatatttttgtacatagaattttgtgcacctgcatgactatagttctaaaataaattactagaaatggaactgctaggtcaaaaggtatatatgcattctattttgatagttagagccaaatagctttccaaagacaatataacaattcatgcttctattcatgataccaatacatcttgcattgaaggaattccaaaacaaccaaaagttcatcatttttctgccaactgatcctttctctcttaaaaagagtcggggtaaaaatcacccatttttgcttataaccataggcagttataatcattattgcccaagattcaaggccatttcattacccactgcatcaccatcctcactgtggtataattctaactggtcagagagacctttaatttgcagaccttctcagaagacagattatctgcattctgcagacatctgcagaaagccatccacaagtgcatatttcatggctgaatatttttacataacatcagctggaacccatcgttccagcattctcgccaagtgtcacaacctgctctattatatcaataagcagtttcaattagtcattttcttcccatggtgacgacagctataatagcatgcagtagtctgatgaagtttgtaatataaagtggagatgggagtattaaaaggaagagaatacagaattagaatcgcataaaaaaatccatctcccaaatagtcatttggggaaatgacaacatttttgaaacagtgttcaagaatgaatacaaaaatgcaattacttttgaaaagtcagataaataaatttgccatgggaacacattcttgccccagatagaaccctagtttttactggctaattagtcattaagcaccatctcaaaaacaactgtatatgaaagaatattgggtaaatagaaataaaacttaaggcttaacagaattgtaaaatgaaaataaatgccaacagagaatactactttgaaagcattggatagtagtaaataaattagaaggaatgacacagttgctctgccctcaaaatttatccctaatctgttactacttcctactttgtgtgctaagattaccaggctccaaaccatgcttgccttccctggcacacagccagagccttctgactggccacctgcctctcttcttgtccccttcagcctcttctttacacagcagctgaaatgattttctaaaaaatataaatcagatcgcatcatttccttcttttcagccctctactggttttgctcataattaaaatctaaaatctttgccatggctggcaaggccacatatggaatccatctaccacttctttctcctccctacactggcctctatcaagcacattcccaactcagaccctcaggtcttgctgcttccagctaaaaggttagacccccaaatattcagatgtttttcctccttcactttattcaggtatgtcctcaaatgtcacctcatcacaaaggattatttgaccaccctatctaaaaaataacccaaaactctttatcaaatgcatgcagatttactttccttatatcatttaactccactcgacattatatgatgtagttagatgtatatctgttcattctgtatatcccctactagaatgtaacttcaatgaagatgagaagaagcaaagataaaaaagtgcatcccaaccagacagaaaaacatactatgactgtgaactacacccattgatatggtttggttgtgtgcccacctaaatctcatcttgaattgtaactcttataattcccacatgtcaaaggcagggctaggtggagataattgaatcatgggggcacttccacccatactgttctcgtggtagtaattaagtttcacaatatttgatggttttataaatgggagttcccctgcgcaagctctcttgcctgcagccatgtaaggcatgcctttctcctcctttgccttgcaccatgattgtgaggcttccccagccaggtgaaactgtgagtccattaaacctctttttctttataaattagccagtctttactagcagtgtgagaactgactaatacacccatagttgagaaaacagcatctacctgactttggttaaattcattcaactcagcaaacatttactaaactcttattagataagaaattccagaaacataggtcccagtgtctatctgttatatagtttagagacaaaaacttgcatataatttgggaggcaagacatgaaatataaactactgaaatgacaactaaaaagagttaatgatcaaaagccaacatgagtagggcaggcaataagtgtcagagagttctgaggaggagagatttgtgtaggctgagagggtgaaggaatggttcaaaaagaaggctggagaagatctgggaaaggaaaccaggaggaagaaggcatttggggtgagagcacagcaggggcagacacatagattataccagtgttccccaaacatcaaagcatggaaccttggtgttacatggtccactgacaggacaaaccaaagaataataaagttatatctctttccatttgattttaatctttctaatacatgcaatgaaaaagtattaattcagcattaattgttaaacaccttagtaacacttgccaatctgaatggcattattttactttttattttttgtacttctctttaaacttttactccctatttatgataagggcttttatttatggaataacatataattttattcatatgtaaacttctatgggtaaaaaaaagggagttgctttaatggcagtcaatcatggactaaatatctgggtcactacctacccagacacaaagcagagtcaacctttaaagtaagcaaagggggctcagtggaaaagagaagaaagttaagctcttgtcaagatgatgcagggggcctcatgtcaggctaaggattctggaaaatattctgtaggactgtggtttcccaatttgcaacaaggtcaaattccttgaaaacacacgcgttatatttgagtgtggcatgcttcttattttcaagacagcaagaaatatggcaatcttcaattccattataccatttcattatacaaacttaaacacaaagtggaaagaagtaaatacaactttatactatatgtgaattacaaaagcacaatcacaaccacagtttttttttttttttaaagctgtctatatctattatgatatgggcaagaaacagatgactcacaaaatactcaaatagggtaatctgcagaaatgcttagaaagtgtattcatggtgtggagaaaccaaggattaatgcaatacccagggacaaggcgggagcctacttatagagttcacagagaactgcccaagcaaagagcaaagcagagagtgggtaggaaaggataaattgaagataaccaatatacaaacaaggctattttcacatatttcaaatacttaccaggtcttcgaatactttacctgtctaatcacgagctgtatattttttatagggaataagagtgcataggccaggcgcagtggctcatgcttgtaatcccagcactttgggaggccgagataggtagatcacaaggtcaggagatcgagaccatcctggccaacatggtgaaaccccatctctactaaaaatacaaaacttagctaggtgtggtggcatgtgcctgtagtcccagctactcaggaggctgagggaggagagtcgcttgaaccagggagacagaggttgcagtgagccgagattgcaccactgcactccagcctgggcgacagagcgagactccgtctcaaaaaaaaaaaaaaagagtgcatatagcatggacttaaacctcagcttgccattcacttctatgtgagtttcttaagctcaatgaatttaattttttcaataaaatgggagataataacagtatccactataaggctggtgtgagaagcaaatgaataaatgtatgtaaagcacttagcacagcatttgcctataataaatatgcatgctttgggaaaatgggggagggtcatgtgagctgccaaaatagtgaagagaaatttatgagagaaaagcttaagattgcagaaattatcaatttaaattgcattagcttagtatttcatatgagttgtccaaaacatcccatattattcaactattccatttcattgataaaatacttcaaaggcatacaaagaaggaaaatagtctagatcggtagaggcaggtggggttatagtggtggtgatcagtggtagtggcagggaatagacagtaaaggcctccttcagaaggtaatatttaaaataagaccaactgaaacataaaaggagttaactaagtgaggtgaaaagtgccccaagcagaggaaacccaacatgccaaggacctggggaagaggaaacctcctggattcaacatattccacgatcaacatgtggaagagtaaacaaggcgtggggagaactgcagctggagcggtagaaccttttcagtcatgtttaaagaatttaaattacatttatcccaagggtaatgagaagcctttgaaagactttcaagcaggaaaaaggcatgatcccatgatcggattatcatcattagaaaaccactactaaagagaacagggaggcattagagagttttgagttaaggactgaacaagaaaaataatgtttcaaatttcatttttattattttattgtttacaaaaattgtaaactgccgcagacgatttctctgagggctaactgtataagtataggttcatttggtaactcactcattccgtaagatatttattaagcacctaatgcatacaccggaactgtgcatagataggggacggaggagaaaactcacaaataagcagtctaaaaagtgctaagacttgaaaggcaaacgacacttctgagtggtgggtaaaattccaaaggtggaccaggcagtgtctttgctaaaacatttttcggtatggctgaaccataaaatgcatgggccgtattgaaccactcctttcacaagaatttactgagcactgactatatgctggtattgtatagctttggtgacatggtggtgtatgagaaatcacttaaaatataatagcaataacttttttattgtaaataaggctgggttgattatcaagagtgcatgagaaagaaaaacagagaagtgaagaacagtgccttcacttaaggagggttcgaatggcaataaaatacttttaattaaaacttctctgctgagaatagacagcctttgaaagcttgtgtaaacataaatgaactacatgtaaatatattcatgatattatagctttttaaataacattataacttttaaaatgtcaaatcctttgaatatgaaatgccatcccctctccccaaaaacatgaccaccatgaattatccagttgatcttaaatcaaaagccacttacttaaaagtgaaatgttcattccttacacttactagaaaaactgcttcaaatatgatcagaccttccctttgtcttcagagaattccgctgctgaaacagacccaacaagccagccaaggtccatctggggcagcttagggaaggggcaagacatgttccctgcccaacactatcttttccaacttagcccctgatcatgccaagacatcacagtgtaataatagtaatttaataatgtagtcggccaggctctgcccacagtagaaagcatgagaaaataaatgaggcttgaaagctaaacagagagaaacttctccaggcactgcctgcagcagggagatacctggtaatgaaatacccactgatctccattcattacacaggaggcaaaccttaaaagagagtctagaaaggtggatctctcaaaatagaaataaataaataagctcacctgccatggtggggtctctgaaaatgacttggaaggactgcctatagaatttttgtggggatgcagcaaagttttgtcagatgtcaagggaggtaattattcccgacttgcttgggcacatttgctggataaattggcctctttaccttcatctccccatgcgggcaccagataaagaaaccgtgtttaaactctacagtgttctctctggcttttaccatgaaaaagaaataaaaatgcatcctgggtgcttggcaaatcagcccagtgtcagatggggacccattatctttgaccttcacatttgtgccccttgggactcacagaaaatcctcaaaaactcttttgggtaaagatatatgatgtctaggaggtacccaccttcaggagaaagaaattgcctttgcaatataaaagttgcaaaagttgaagttagtgatttctttattttttatttccatttttgtctatctgctcaaatttttaaaatttacctacaaatgctggaagccttgtttactcaaccatgttatcaacatgttaagctatcagccatttctctcccttccctgctttcctctccaatcaccaagacaacactaacatttctccatcttaccttctttaaagaaaaattcttacagttaactgtctgccatctactaccacttccagaaccagtaatgaaatgtcagaggaggaacagttaattaaaattgtggaatcctactttgcatcctctcacagtcaatacatgtacaattagagatgcctttcagcatgtggtataactagtataagttaaactttgaataacacttgatcattaaaaataaaaaatcattaatgttaagcaaatacgcagtaaacatcttgcttcattggccataaaactcctttagctcagctcaactagtgtggtagatttaatattgggattcacttagatggtgctttttagtaagaaaccaaggaacatgtctacaatctgcaagtggtttatgggaataaaaactgtgcctaattatcccacatgggtttacctaagttgtcatttttttacaaaatttctcaagtttctccacaaacgtttagggaagaaatgacatagaatggtggttaagggttcagactctggagtcaaatgttgtgtgtgtttcatccctgcctctgctacttgctaaacatgacactgccataaccatttttcttcatttctcagagcctccatttccctgtaggtaatatgaagaaaacactattcattcacagggctactgtgaggatgaaatgagataatgtacacaaagcattttaaatagtgaccagaaccttgtaaagattaagtaaatgcaagctggtcctcctaattgataccttattcattcaataattatacttcctaaaagagtctggtaattatgtatttaaaacatattcacgaggtggagccaagatggccgaataggaacagctccagtctacagctcccagagtaagcaatgcagaagacgggtgatttctgcatttccaactgaggtaccaggttcatctcactgaggagtgtcggacagtgggtgcaggatagtgggtgcagcacactgagcatgagccaaagcagggcaaggcatcatctcacccgagaagcacaaggggtcagagaattccctttcctagtcaaagaaaggggtgacagacggcacctggaaaatcgggtcactcccaccctaatactgtgcttttccaatggtcttagcaaacggcacatcaggagattatatcctgcacctggctaggagggtcctacgcccatggagcctccctcattgctaggaaagcagcctgagatcaaagtgtaaggcggcagcgaggcttggggaggggcccctgccattgccgaggcttgagtaggtaaacaaagcggcctggaagctcgaactcggtggagcccaccacagctcaaggaggcctgcctgcctctgtagactccacctctgggggcagggcatagacaaacaaaaggcagcaaaaacctctgcagacttaaatgtccctgtctgacagctttgaagagagtagtgattctcccagcatgcagcttgagatctaagaacggacaaaatgcctcctcaagtgggtccctgacccccgagtagcctaactggcaggcaccccccagtaggggcagactgacacctcacacggccgggtactcttctgagacaaaacttccagaggaacaatcagtcaggaacatttgctgttcaccaatatccgctgttctgcagcctctgctggtgaaacacaggcaaacagggtctagagtgggcctgcagcaaactctaacagacctgcagctgagagtcctgactgttagaaggaaaactaacaaacagaaaggacatccacaccaaaaccccatctgtacgtcaccatcatcaaagaccaaaggtagataaaaccacaaagatggggaaaaaacagagcagaaaaactggaaactctaaaaatcagagcgcctctcctcctcgaaaggaacgcagctcctcacaagcaacggaacaaagctggacggagaatgactttgacgagttgagagaagaaggcttcagacgatcaaactactccgacctaaaggaggaagtttgaacccatggcaaagaagtaaaaaaccttgaaaaaaaaattagacgaatggctaactagaataaccaatgcagagaagtccttaaaggacctgatggagctgaaaaccacggcaccagaactacgtgacgaatacacaagtctcagtagccgattcgatcaactggaagaaagggtatcagtgatggaagatcaaatgaatgaaatgaagcaagaagggaagtttagagaaaaaagaataaaaagaaatgaacaaagcctacaagaaatatgggactatgtgaaaagaccaaatctacatctgactgatgtacctgaaagtgacagggagaatggaaccaacttgcaaaacactctgcaagatattatccaggagaacttccccaatctagcaaggacggccaacattcaaattcaggaaatacagagaacaccacaaagatactcctcgagaagagcaactccaagacacataattgtcagattcaacaaagttgaaatgaaggaaaaaatgttaatggcagccagagagaaaggtcgggttacccacaaagggaagcccattcagactaacagcagatctctcagcagaaaccctagaagccagaagagagtggaggccaatattcaacattcttaaagaaaagaattttcaacccagaatttcatatctagccaaactaagcttcataagtgaaggagaaataaaatacttaacagacaagcaaatgctgagagattttgtcaccaccaggcctgccttacaagagctcctgaaggaagcactaaacatggaaaggaacaactggtaccagccactgcagaaatataccaaattgtaaagcccatcgaggctaggaagaaactgcatcaactaatgagcaaaataaccagctaacatcataatgacaggatcaaattcacacataacaatattaaccttaaatgtaaatgggctaaatgctccagttaaaagacacagactggcaaattggataaagagtcaagacccatcagtgtgctgtattcagacccatctcacatgcagagacacacataggctcaaaataaatggatggaagaagatctaccaagcaaatggaaaacaaaaaaagcaggggttgcaatcctagtctctgataaacagactttaaaccaacaaagatcaaaagagacaaagaaggccattacataatggtaaagggatcaattcaacaagaaaagctaactaccctaaatatatatgcacccaatacaggagcacccagattcataaagcaagtccttagagacctacaaagagacttagactcccacacaataataatgggagactttaacaatccactgtcaacattagacagatcaacgagacagaaagttaacaaggatatccaggaattgaactcagctctgcaccaagtggacctaacagacatctacagaactctccaccccaaatcaacagaatatacattcttttcagcaccacaccacacctattccaaaattgactacatagttggaagtaaagcactcctcagcaaatgtaaaataacagaaattataacaaactatctctcagatcacagtgcaatcaaactagaactcaggattaagaaactcactcgaaaccacacaactacatggaaactgaacaacctgctcctgaatgactactgggtacgtcgcgaaatgaagacagaaataaagacgttctttgaaaccaatgagaacaaagacacaacataccagaatctgtgggacacattcaaagcagtgtgtagagggaaatttatagcactaaatgcccacaagagaaatcaggaaagatctaaaattgacactctaacatcacaattaaaagaactagagaagcaagagcaaacattcaaaagctagcagaaggcaagcaataactaacatcagagcagaactgaaggagatagagacacaaaaaacccttcaaaaaatcaatgaatccaggagctggttttttgaaaagatcaacaaaattgatagactgctagcaagactaataaagaagaagagagagaagaatcaaatagacgcaataaaaaatgataaaggggatatcaccactgatcccacagaaatacaaactaccatcacagaatactaaaaacacctctatgcaaataaactacaaaatctagctccctctccctctccctttcatctccgtctcccgctttccacggtgcccccctccctcgtctccgtctcccactttccacggtctccctctgttgccgaggctggactgtactgccacgatctcggctcactgcaacctccctgcctgattctcctgcctcagcctgccgagtgcctgggattgcaggcgtgcgctgctaagcctgactggtttttgtattttttggtggagacggggtttcgccgtgttggccgggctggtctccagctcctgacctccagtgatctgcccgcctcggcctcccgaggtgccgggattgcagacagagtctcgctcactcagtgctcaatgttgcccaggctggagtgcagtggcgtgaacctccacctcccagccgcctgccttggcctcccaaagtgctgagattgcagcctctgccccgccgccaccctgtctaggaagtgaggagcatctctgcccagccgccaatcatctgggatgtgaggagcccctctgcctggccacccagtctgggaagtgaggagcacctcttcctggccttcaccccgtgtaggaagtgaggagcgtctctgcctggccgcccatcatctgggatgtggggagcgcctctgcccggccgccccgtctgggatgtgaggagcgcctctgcccggccgccctgtctgggaggtgaggagtgtctctgcctggccgccaccccgtctgggaggtggggagcacccccgcccggcagccgccccgtctgtgaggtgggcgtgcccccacccggcagccgccccgcctgggaggtgaggagcccctctgcccggccgccaatccatctgggaggtgtacccaccagctcattgagaacaggccatgacgatgatggcggttttgctgaatagaaaagggggaaatgtggggaaaagaaagagagatcagattgttactgtgtctgtgtagaaagaagtagacataggagactccatttcgttttgtactaagaaaaattcttctgccttgggatgctgttaatctataacattactcccaacccagtgctctctgaaacatgtgctgtgtcaactcagggttaaatggattaagggaagtgcaagatgtgctttattaaacagatgcttgaaggcagtatgctcgttaagagtcatcaccactccctaatctcaagtacccagggacacaaacactgcagaaggccacagggtcctctgcctaggaaaaccagagacctttgttcacatgtttatctgctgaccttctctccactattgtcctatgaccctgcgaaatccccctctctgagaaacacccaagaatgatcaacaaatactaaaaaaattaaaaaaaaaaaaaagaaaagttcaaataaagtgtatgaaagaactttaaaaaaaaaaaagaaaaaaaaagtgcgaaaattagccaggcatggtggagtatgccttggggtcccagctactcaggaggctgaggctagaagatcacttgagcctgggaggcagaggctgcagcaagccatgattgtgctactgcactccagcctaggtgacagatggagactctgtctctaaataaataaataaataaataaataaatcctatttttaaatgctaaaaaaaaaaaagaaaatctagaagaaatggataaattcctcgacacatacaccctcccaagactaaaccaggaagaagttgaatctctgaatagaccaataacaggctctgaaattgaggcaacaattaatagcttaccaaccaaaaaaatccaggaccagatggattcacagccgaattctaccagaagtgcaaggaggagctggtaccattccttctgaaactattccaatcaatagaaaaagagggaatcctccctaactcattttatgaggccagcatcatcctgataccaaagcctggcagagacacaacaaaaaaagacaattttagaccaatatccctgatgaacatcgatgcagaaatcctcaataaaatactggcaaaccgaatccagcagcacatcaaaaagcttatccaccatgatcaagttggcttcattcctgggatgcaaggctggttcaacatacgcaaatcaataaacgtaatccaacatataaacagaaccaacgacaaaaccacatgattatctcaatagatgcagaaaagacctttgacaaaattcaacccttcatgctaaaaactctcaataaatgaggtattgatgggacatatctcaaaataataagagctatctatgacaaacccacagccaatatcatactgaatgggcaaaaactggaagcactccctttgaaaactggcacaagacagggatgccctctctcaccactcctattcaacatagtgttggaagttatggccagggcaattaggcaggagaaggaagtaaagggcattcaattaggaaaagaggaaatccaattgtccctgttcgcagatgacatgattgtgtatctagaaaaccccatcatctcagcccaaaatctccttaagctgataggcaacttcagcaaagtctcaggatacaaaatcaatgtgcaaaaatcacaagcattcttatataccaataaaagacaaacagagcgccaaatcatgagtgaactcccattcacaattgcttcaaagagaataaaatacctaggaatccaacttacaagggatgtgaaggacctcttcaaggagaactacaaaccactacttaatgaaataaaagacgatacaaacaaatggaagaacattccatgctcatgggtaggaagaatcaatattgtgaaaatggccatactgcccaaggcaatttatagattcaacgccatccccatcaagctaccaatgacttccttcacagaattggaaaaaactaccttaaagttcacatggaaccaaaaaagagcctgcattgccaagtcaatcctaagccaaaagaacaaagctggaggcatcatgctacctgacttcaaactatactacacaaggctacagtaatcaaaacagcatggtactggtaccaaaacagagatattgaccaatggaacagaacagagccctcagaaataatgccgcatatctacaactatctgatctttgacaaacctgagaaaaacaagcagtggggaaaggattccctatttaataaatggtgctggggaaacctggctagccatatgtagaaagctgaaactggatcccttccttataccttatacaaaaattaattcaagatggattaaagacttaaatgttagacctaaaaccataaaaaccctagaagaaaacctaggcaataccatttaggacataggcatgggcaaggacttcatgtctaaaacaccaaaagcaatggtaacaaaagacaaaattgacaaatgggatctaattaaaataaagagcttttgcacagcaaaagaaactaccatcagagtgaacaggcaacctacagaatgggagaaaatttttgcaatctactcatctgacaaaggactaatatccagaatctacaaagaatcaaacagatttacaagaaaaaacaaacaaccccatcaaaaagtgggtgaaggatatgaacagacacttctcaaaggaagacatttatgaagccaaaagacacatgaaaaaatgctgatcatcactggccatcagagacatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggtgattcctcaaggatctagaactagaaataccatttgacccagccatcccattactgggtatatacccaaagattatgaatcatgctgctataaagacacatgcacacgtgtgtttattgcggcactatttacaatagcaaagacttggaaccgacccaaatgtccaacaatgatagactggattaagaaaatgtggcacatatacaccatggaatactatgcagccataaaaattgatgagttcatgtcctttgtagggacatggatgaagctggaaaccatcattctcagcaaactatcgcaaggagaaaaaaccaaacactgcatgttgtcactcatagctgggaattgaacaatgagaacacatggacacaggaaggggaacatcaaacaccggggcctgttgtggggtggggggagtggggagggatagcgttaggagatatacctaatgctaaatgatgagttaatgggtgcagcacaccaacatggcacatgtatacatatgtaacaaacctgcacgttgtgcacatgtaccctaaaacttacagtataatttaaaaaaataataaaaataaaacatattcacatatttacgtattcatgtatttaaaatatattcatttattttacactatgtgcaactcatttttctacttaagaattagagagatgacatttcggaggcccctaattccaaatgctgccgcctgtttttagtacagatctgtgttaagcaaaggaaaatgaagcggtcaaatcgcctcagaagcttccggcttccacccctgtttgtaaacgaaactccatattagtcaaactacactccccagggagcacctgtaaaagtccctgatttacagaagtatttactttagggtatggagtttgttttttcaggtttatctctgggagagcttggtgaagctgacagtccagcaattttattaaactgttcaatttcagcattttttaaagagcatatataaagaacaccggcagtagctatttaaatttcccagtggatgctagaaataataaaaggacacttaaatgaccatttttgagcagagccaacagcatgtgtcctaattatccaactatgtgaaaaattctgtggatttttaccagagcacaagggtgtgatatgcacaattcagaacactaacggctacctcactagggtgtagagaacttttcaagtctaaatataaggtcccagtctgccagggtaagtttttctgctactttccctcttgatgaacttgttagacatgataaatggacaacatggtaagaagttgatatggtccactgataagcctctgatgaagaacaagtaaataaaaaaccattgtgctaagtgctctccttcatttattctcacgatcacattctgaggtaggtattactatgcacattttacaggtcaggaaagcaaagctcacacaggataagtgccttatcctacagtttaagtatccaagctggtgttctgattttcctccactcacctcttcctatctcttctccacccacctcttcctatctcttctccacccttctctgccctgctggtggtctcttccttactgatctctacagactcatctcccgtgccctttggtttctatagggctaagacaatggcaggcagcattaagggatcagagaattggaggaaagagtctgggggtatctattccccatttcctctctcctcccctcacactgcacaactgagacttttgacaagtgcccacatttttctagctttgactataatttctgtcagtggccctttttccctaattcctagctagggctctcattggattcttgtaattctgttctctgtctttgctccttcagactttccatagttgcttcaccatcttttttggttcccttaaatctacccacacctctgtcaatcttctgttcattaaactctcttccaacctctcagttttggtgtcatccactttctgctggagaaaggagggtagcccctagcagttggtacctcctcctctctagcttccctttcatctacccacaaccaaccactcacccttcccttgtagccagtcacaccacaagcaagtctgtgactcagcaaactggctcccagaaacaaaccctaggagcataattgaagatgaacccaaagatacagttataagtatgctcgtggagaatttgtaattttttaaaaaatggtagttatctaagaggacttgattaatcaatgaagggacattcataaaatgaaaaattataaatgattaaaaataataccataacttatatttcatgacatgaacatattctcaatatattaacttcaaaagggaagatacaaagttgtgtgtagaataactcagtttttctttgtaaaaattttgtatacatggggagaaaatggtccaaaagagaccatccaatagaaatacagtacaaggcacataagtaattttagtgtcagtagttacgttttaaaaagttaaaagaaaccagtgaaattcatttagtgatatattttagtccaacatatgcaaaataatatttaatcatgtaagcaacagaaattaataatgtgatatattgaattcttcttttgcatatgaagtcttagaactccggtgtgtagttgacactcagagcacatgtcaactcagtcttgctacattttaaaagctcaagagccacatgaggatagtgactaccagattggacagctcaggtaagcctcaaaagcgggtgtgtagagtaggaagttgaatgttcttcactttcttattatttttctccttttttaccattaccatttactactgatgcatgtcacctctgcaattagaaaaacaaattatttttaaacactaagagcaaggcttttttcttctgtctctggaacactttttggctcatgtcctttgcaattcacagactacacacttactagtatagaaaggtgccctcctttcttcccctccctttacattttctttggatagctacctatcttcagccctcaggcataagagtaagaatcaaatgttgattttcttcagagtggctgctgagccagctcccactctccagtggtgtgacccggaatctatcaggcctcacaccactgttttagcagctctgaatggcttgtggaagggcatggaatggggccagaaactgcttaatttgaggttaattaaatagtgatgacaagccttaatctccaacttgtcatcagattgtaaacactgattgcagctgcagcaatctgcaataaacctattgagaggaatcttgaccagaatgaaataagtacgttggttacccagatgaggctgggagaggtgagatcagagaaatctaggcttttgcagtaccaggagaaatggagacctgaaaagagggaaattcatgggcgaatgtgtcaattctgattcctgtacagccctatcaaaaaaaagaaaaaaagaaaagaaaaaataactggatcccatgcacctggaaattggaaagaacaagggcagaaatataaaaccactaaactaaggacctggaaaaagctgaaatagctttacatctattagccattgatgaggtttccatgaaaaaatatgtctgagccactgcatgccctgaggccgctggacagatggttataccaccagagtgagctacagcagtggctttctagagtgcaggcaaggatgacagttacagtgtgttaggtctctactgtgtctcaagcacatcacatgtaacgtatatgataattctcaaaagtactttatgaggtagctattattttctccattttaaagaggagaatgctaaatctcaaaggagtatcctaccttgcttaagtacatgtaacaaatgggttgaacccagactgtctaatgccctaatgcaaattctaaatcacaagaatctctgcctccagctttgaggcaatgttgaagtgggaaaggggaaagaatagtcaagttcctgaagaagatgggaaaaaatgagtcaaaaatctccaaagaatagggaagcacaaagggctgaggtaacaaatgccagatgagtaaacatgttcataacactgcaccccggaaagtgcccctcctggctccattttcatggagaatgctttctcattcttcaagatccagcacaaggccaattttcacctcttctgtgaagccttccccaaacctcctagtgagagaggcactttaaaaaaatatgtgagatgcattgagagacagatggacaccataaaagctgaactcaatattacatgtgaagaaaatttacaaaaaaatcttaatctgagtgtcagaaaaattggagtagtgaaagaaccattacagttattgtcaaatagttaattaactattatgtaggtttaaatccatgtattcttccttaaaaccttttggaacaagataaatcattctcatccattcatttattcattccctagcactgtgataacactagagaaataacaatgaccaaaaacagacacaattccactctcgaggtacacatgtttaaaagggaaaacagagtaatgatacaaaaatcacacaaataaatggacaattatgacatgtgttccaaataagaggtaaatgagatgttattattttatccaggatacaggactggaatcattaaagagaatacacagggaaataagctgcagttcattatttggaaaaagtttcaaacaatccacacagaaatggccccacacatgagcctgctctcttctgggcattggatgtgtcccggctgaggcagggaagacaagggtgcatccgtcgataacttctcaagtctcttctgactctaagaaactgtgaccctatcattccaaacaaaatattttctcagataagaattagaattggctaggttgaatttccaggagacttaggaaatatgtacagagaataatcacttcctaaatagagaggggagtcaagcaaaactgagtcttctaaactgctcggtagcattctccttctcttcgcacatggacacacttctgctttatgcactgccctgacagcttcctgaggacagaggctgatggtcttgctcatcactgaatcatcaatgcgtggcacatattaaatatttgttaagtgagtaaatgaatatggtactaaaatgtgcatactgacagaaacttttttctgttgtggcccttgtaggtgaacttccttgaataattaatgaacatgaaagtcagtcaatcactcacctcctgattaatagtcagggtcccttgtccaaacagccacttagtccattaaaaattaataattttctacagaataaatatatgctgtacatggtacatcaagggttccacttttaatacgcaattaagtaatgcagaaagactaggaatctattaactaagaaagagctccatgaacttgccctccaagtcatcattcatttactatccatttctcttccaattttaaaaaattatttagccagaaaaaaagtagttctgaaaacagagtaaataacaacatgttgtcatattttggctaacatttgcaggccgacacaatgtgtgtttgttaaagatttgagatatgctattccttctgtgaaatgacgaatacattagggcagatcaatacaaaactgaagctctatatgtaaaatgttaagggtctattcattgaaaaattatgagccatgttatagaacttaggtcagagttaaattattgatctacattcatttttcccctttccatgtgactatcttttgattttttataacatacattattgcctatgtagaaaatgaatcctcttcttctagagctagtgtgtctggtgactgacaattttctaaaattaactgttgtgttggtagcatttagatttgtaaattgaactccccttgcataaacatttaaacattgaaaataaaatctgtaaactttggtagcatgaactcaaagggaaaagaggataattttcattttttaatacaaagaaagcaaagaaaaaaaggaaaggttatttttcttaacatcattctactactttatggttcttgatacatttcattgatgaggccaaattgtattcagttgactttttacaaatgactaaactgtattgctaagcaaagggatgtaatcaacactttgtgagctgaagtctcaattttcagacctaaagcttactcaagatgtataacctcaaattctgtaagcaggttagatgtcttgaaatacaaagactctcatcccctatcagcccccaaagtgacaaaggaatgtgtcttcaatgaagattttctctcatctgctgaaaagggaaaatgtgcaaatatttcaaagaaatgtagattccacagacccacattaattcatgaaaaaggaagctaatgtaagagttcttagtaggaatgatctttgatttggggctgtatttggtcagtaacttttgcctactaggagaatattttctctttaacgaagtagtatcagacacagagggctcttcattttctctaatggagatacaatcatttagattcgtgctccaaatgaggcagaaattacccctaatgtgtagtttgaacatttgtatcaaaatacagtgaaatgctgtttcagagtctgatgagaaaaatatgtgagctcacagaatgtctgcctctctcaggtgcagaagtggtctactgctttttttttcttttttcttttcttttcttttttttttttttgagatggagtctcactctgtcacccaggctggagtgcaatggtgaggtctccgctcactgcaacctccacctcctaggttcaagcaattctcctgcctcagcctcctgagtagctgggattacaggtgcacgccatcatgcccagctaatttttgtatttttagtagagatggggtttcaccacattgttcaggctggtcttcaactcctgaccttgtgatccgcctgccttagcctcccaaagtgctgggattacaggggtgagccaccacgcccggccctctgctacttttcttcacattgtcactgcaggaatcacctggctctagggggatatcccacagtctcacataaataccaatccctgtcgctggaacaagggggtcccagcctcacagaaggcctgagggactctgtttctctacaggtcagctccaaagcagagggccctttgcaccataaatcaatgtcatccacagaaaactccaggagaaagttaaataccagcagcaaacaatgtctcttgtgtagcagtctctcaccactgtttctgctaggtgacaaaagcagtgagaaaagcagaggaagcaagggctgaagacagaaaagtcaaagaattgcagaacttgagagttggaaaggggcagagtccaaataggaaaagacttaagcttcctactgtgttgtgctatgtagaatgctgtatgaggaagggcagcaggctttctccccagaagcccagctgaaagtcatccacactttacatggtcccctataccaggcttcagcccccttggccttggttttctcaacacacagtatggaatccatttctcatgagatggacttcattaaacacactcatgagaccaacatataaaaccagaatgtcaaagtagtagtctacgatttgcagtatagctgttgcacagatgtcagaaagaccaatacattcattcccttcctgtaaatgtcttccctgcaaaaccaaatcctaatcaggcagcaatctgacatgtaaggaatctgaacaagaggagttcatctgatgaactgaatgttaaacagcgtcaggggagatggagtcaccaatgggaaagaatacccaatgtcccttggctgcagctctctacatccattgccgtaacagaaatggccttgccaatagaaaaacaattctccaagtttctcacaggaggtcccgtcccctccaaagagagctacatgtgtattctttgtgtatttttatcattgagaaacataatttgaatgggaaagcctttctttcgttctaaaaaccctgcatcatttttctcattgcaggttaaaatatgttcattgtaaataatgaacatacggaaaagggtaaaagttattctatttcttccgcccagaaaactataggtggataatctttcagtctgtttctatgtatacatcttaggttgtccatataaaattatcattttgcagataaaaagcagtcaattaggtgcaattctacatggtccaatctcatatacatacgcacattacattaaagtcaaatgacaccttaacttctactttgttgcttttctttgaattaactagggctcatatacagttttccatgttactcggtaataccataattgattctcttgcacgcacttgtttaccaaaacttctcattatttccttagggaatattcacagacatagaagtgcttggttaaaggatttgcacacacacccattcatgcatatactgtctaaggttgctctcatcattaacagcagagttgagtagttgtgaccatactaccaaaaaacctgcaatatttaccctttagtcctttacagaaaaaggttgccaaccctgacctagaatccataattaactagatacagaatccagacatccattcaacaataggacacagacttcctatttttaaaaaattcaccgtgactacaagcagatctgcatttaaaatattttattcccattagtatttttaattggtccaaatgctctatgtgatataacttcactatcattagaatagtattaaagaatactattagaaaaatgtagctccattatttttactacagaaattattataaccgaagacataaatgcgaaccaaataaaacaaaataagttgtaaaaattcctttcttcaacaattgcataataatctataatacacatagatatacatgttcttaaatatttcatgtaaaaattggttactatttaataattaattttagaaacattaaaagaaatttaacttctgggtctttgatttgaaacagctaagaattttagactggtttccatttttaatcatgatcaagactcagaaacgtagctaagaaaaatcatattgtactttttattgaaaaggaatcacacagaccatgtctgaattattataaaggcttcattaattagattttaatctacatgactataccatatgctaaaaaaccatccaaacaaactctatgaaacggttttactgctattacttaaagagccatttaaaagaatttctacgggataaagactgggtgatttatcatagttttatgctcctttaatctgctccatcttcccattgtaaaataaatattggttttaaaataaatggttctgcccaggttttgatgagaaaaattgccctgtaaatcacaagctcacgtgtgccaaactctaagtccaatgttaactagcctattctgaagaaaaataagtcaattttatagaacaaaatctaaagaagacaattacttaagtgtattttcaaagctgcaatgtaattaatctgagatatgagcttctgtaccccaagttttttaattctcaaaataagaactagtggatatcaaactggtcctccaactggattttttaaaaatgggttctgtactatagtttttattatattctttccgaatccaatatacaagttatgtaactgaaaataaatacaatgagggttatatgataatgtctgagggttatatgatgacatctttatcaatcacttttttcatacacagagagccaaatcaatttaatagtcaggttcttagaatatttcatagtgttctgaaaaattgaccttacagtatacatattttcctataataagcatagtggttaaaatgctctggaagttatgaatggtttaaagcagtgcttcacaaactatttaggatgtaaaactagttgactatatttttcactccaatatgttgtgggttggtgatacttttataaaatacaataaaaattgcacttggatttagtggtagtgtcaaactgctatgacagtctctaaaccagcactgtccaacagaaatatcataggagccacatgtctgattttaagctttctagtagccacattaaaaatgtaaaaagaaacagttgaaattaattttaataatattttatgtagtccaatagatccacaaccttatttcaatatgtaatcagtatacaaatataatggagatatttaactttttaaaaaaattaagtcatcaaaatccagcatgtatattccacttacagcatgtccccattcagactggccacatttcaagtactcaacagtcacatgtagctagtggctgttgtgtgggaaagtgccattttaaaccattactcccaaactctgcacctccctcttcatgaactggtccacatacaacactttgagtagtactgtctaaactactgctcccttaaaaatggcaccttcatttctcttctataattttctactctgtgttttaaattgagggctccattccagataagtccaacacttaaagaaattaacaaactcatgattgcagctaactttatacatcctttcaggaaaggaatttgcatttataagggatggatacggaggtcccctctgctctcccttctctagaagcaatcactattctgaatgatattggtttctttctttcctatccatgtttttatactttttctactgactatgttcttaggatttaaataaagcaaagagaaaatttgtttgcacattgctgagatatatgaatttaatgcgtttagctcatacaaatcctgaccatattccatggcaaccactgaaaccgaatcacacacctttctacgtttgcaccctctgatcccctattcgtccttcataccacactgctttgatatatcattttctttctgctctgtatttagactctgttccaccttctagcctggataatttctacccattgagatcaaagcttaaatatcacttcttcaagtaacctttgttgatctgccctttgccctggtaaaattaggttccctgtcaaacactctcacttttcctatactgcacttaccaaaattgtaaatagtttctgttgttgttgttgtttttgagatggagtcttgcactgtcgcccagggtggtacaatggcacaattggctcgctgcaacctccacctcctggattcaggcaattctcctgcctcagcctcccgagtagctggattataggtgcccacagccatgcctggctaatttttgtattttttagtagagacaaggtttcaccatgttggccaggctgaagtagttattttttttactgatttgtttaatgtctctctcattcataaaaatatgttagcaccagcataattaaaagtatacagtaggtatccacaaatattaattgagtgaatgaatgaattttcattctcagaagccagacttaacctggtcattatgtttctcaatctctagtcatgacactagcttacaatgtgtatatcatggatatatatacatagggtatccctgttaattagaaggtatattttcaagagtatggccataaagaagttattcatggtatattcttttgaccttctattttcaattgtctctatatttagctcccatttttcatttctaatactgtttgtatttctctctctctctctctctttgttcttctctctttgtagttgatcaagtttgacaagtgagaatgtgctgttttagtctttaaaataatcattttttgctcggttgatcttctctactgtttctttgtattctatttcatttttggtaatatttttgtattattccttccctctactgtatttgggtttactctgctattttatttatacctttttaattgaatccttaattccctaacaatgtctccttccgtttctaacgtatacatttatgagtctataaatttccctctatatacctctttgtgtcccacaagacttaaagtatgtactaatttctatcatcatttttctttgactcacaaattattgacaggtacagttttgagtttccaaatgtataaagttttgaaaagtatcagtttctaatctcctgcttttttcctctgaaataaagaattagtaaatataatttttattcatcagcattaagactttctatgtgtgtatattatctgttagtggagtttgaagttctatatatgtctatttgtccaagctaaccggttatgtggtttaaatattctttatcttttctaagcttcttagcttgtttgatttatcagtgtctgagagaaaaatggttaaaactctcagattatgattatatgggttttcaatacttcttggtgactgtgtcaatttttactttctatatttttaaaaggatgctactaggtaatgtaggctcaggattaactcttcctggtgaattgttcttttatcattaaataataactctttatctgtaataatatttttgcttttaaagtatattttgtccgatattaatagtgtcaccagctttcatttgaatgatatttatatgatgtattatgtcaatttcatctattttctcttaatcttcccatgctattatccttaattgggttgttccttgtaaacagttaaagagagtatagctgttctctctatccaacttaagaatctttgcctgcagacagataggtttaatcatttgtatattggctttgattactgattatttggcctcatttcaactaattaatctacagcttcctaaaagtcagtaattatggcctctcactgaaccaagtactgcataccatagcaagcattgctgtatctatcttacactcataatttagctgttctcaataaataatttagacacattggcaaataatattctcttaaagcttcaagctcataagtacttatatatataacacagaaaatccccaactaagatggctaatccactactactcttatttctttacctataacatgaaaataagtgaatccacttgtcatctacctccaatgttgctgtactttcctcttcaacctcctcatttttaaaaatttctatcgggaacagctctcattctgtctcttctacctttcttcttccctatcccagtctctcacctgttaccttgacaattgaattagtatcttttctctccctgccttcatcctaccacctaacaatccaatgtttcctccagttaaatgagggtcgcatagtataagttaagaaatttgaactttaccctacagctcagtgtttctcaaactgaacccaaaggcacagtatcatagctccaaacattctatgagaatatgctttaggtttttatggttttattccaattaatgtcctgaagaatctaaatgacaacctgataattgagctatgctttccaaaagcagtgcctgagtttgtcttttttttttcctccatcaactctgttctgttctcagtatcactggaaccaaacaatcactttaaatgacagcttttaactttcagtgtgtcagtgagcacatctggctgctaggttggcatgtcctaatgctaaaattgtcccatgtctgctattgtgctcttcttgaagataatttgcaatggaaagatagtgtcatggaataagactttaatttattaagttatttaattaatggagactttgatatgacatcataaaaactcatagtgtggcagagtaatggtctattttaattgttatgggctaatgagaaaagaacaaaggcagaattaacatgtaaatgatgcgtttatatcaaatgaaagccaaatgatattatgggacagtgcaaaaggaagtttcccaatttttcaaatagagaaaagtggtgagaaaattgagtcatcatgtggctctgagtagtagaggcatgccaaattaagagtctttgccatagtagtcagcacactttattgatgaaacattaatttatcaaatatatgttaaatacttcatcaataaacagtgagtgttaaacactgttctaggcactaaggatacagaagtcataagatagtcaactctccagtgtcacggaagttatattctgacaataaaaagatgaacatgaatttataatacaacatcagggagtcgtaagtcttgtgaaggaaaacgaagcagggcaaagagatggaggatgatgagggaggaggaaagctacagtaggcaagatgatcaagggaggattctctgagaagatgacatttgagcagacacctaagtgcaacaggaggcaaaggcatacaaatatctcggggagaagatttccaaacaaaagcaagagcaaatacaaagatgttgagaagaacagcaagaaaaccaatgtcaacagactgcagggagaaaggagagtggtatgagactaggtaaaaagaagagggctgaatcttgaagagccttgaggtcatagcaaaaagcctgaatttaattctaaggatgatggggagttactacaggttttttgttttgctttgatagagtctcgctctgtcacccacactggagtgcagtggtacaatcttggctcactgcaacctctgcctcctgggttcgagtgattctccagcctcagccacctgagtagctgggattacaggcatccatcaccatgccccgcttattttttgtatatttagtagaggcagggttttgccatgttggccaagctggtctcaaactcctgacatcaagtgatccacccgcctcagcctccctattacagggtttatacagttcatgcagaataccagaaagggagatggggactgtggggatggatacaggtaggcttgtagatttgctagagaaaataaggtagtttcttctgattgtttctctttctccagtgaaataagaagtgagacaatcaactgattgagagagctggggatggccattggagagttgaggtacaggtgaagatataaaatagttttctcagaaagtagaagtattaggtaaacaatgcaggatcaccgtgtagaacagaggatccactgcagtcagcatagttgtgtgtcctccatccatccacactcaggcccaaagtaggtggaaagctgaatgagggtcatagttttgccagataagaatgacagagaaagatgagcaaaggagttcagtgtgcatgtaaagaagagaagaaccatagcatctgagctgagcaaggaggaaagtgaggatacaggaggatgacggattgtacataaatcctgtaagtcaacagattggaggccccacaggatcaaagaactgttggagtagagatgctaatgtcacctgaggcagcagccctgaaaagataggaagtggtggtcagagagtgggatgctgtgaaacatactttgaaggttagcatggcatttcataacaagggcactattggcatttggggaaaacaattcttcatcgtgcataacagtctcatgtactgaatgacatttagcatccttaacttctgccctctaaataccagtagcactccttacatttgcaattactccctaggagagtggtacttcctagattgtgaaccattggcctggggtatgactatgaggtagggagagatatttgcaagtgagaaactcagggacctgatagaccaggtatgagtattctctgtggatgtttttactgagaatgatgagtataaagacagggcgctggggggaacgtcttcaataaatacagaggagtaggctgtagaagagttttatggcatgtgctttaaaagcctctgcggaggaagagaaaaggaactgtctagaagtgacaatgaacaataccagaagacaccaactccactgtcagacactgagaaaaaaacagacacccctggagagggtgatggggaagcctccttaagagtttgccaagagtatcaagcagctatccaaaagaactttctgtgatgatggcaatgttgatatctacgccatcctataagatagacaataggcacatgtacttcttagcccttgaaacgaggccagtgtgtctgaggatgtgaattttttactttgatttgaacgaatttaaatgtaaacagtcagatgtggctactggctaacaaattggatggggcagaacagtaaaaggtgaaggaagcattcagaagacaaaattcttcttaatctctgagtcttgaggaaaagggcaagggcaggtatgagtctagggaagtttgtacatttgtagcaggaagaggtgaggagcatctaatagcacaatagcatcagcatttccaataagcaggattccaaaaattcattttaatttatttcagcctcctctcagactaaattctataccatattgttgtggaagacccttaaaaaaaaccctcaaatatttaaaatatcaccatcatgtaagaattatttcttctcctaagaagcatctggtattaatagactatgactatcgcgtgttttctaagatctaagtgtcccttccctccaaagactggctatctatatctaacaaaggaaaatgtaacatttgaaaattccctgttaaaagattttgttgtcatttggaaatcatatttcttgctgtttgcatttctattaaaaatataaagaaatttgttctttggtatcccaaatgaagtaaaagtattctaattggttgcattcacaagtctacaatttgcggcttaacaaaattatttttgaaaaggtcataacctgtacccacatgcccacccaaccacacacacagacatccagaatggtcttgtgatcatgtcttcagaagtttggctgcaaagttacaagcaacaactgtccatctgcacccaccaacctagtgaacaatgccagtctgggacccaaggactatttactcaacagaagaattccaacttcaggcaggggataggcgaagtccagataacatctagatatttcttgacattgcatttgattggaaataaaggaaaagtaaagcatttctggttagtttctgtttcttagtgtctctagttcccattttatttcaatcaaaatatcaaaatactctttagcccatagaggggacagagttcctagtttaataaaccctaaaatatataattaagataaagcctctgtagggttactcagcacaacactataattgctcagattccctagtggattctccagtcaatttctctgcatccttgaggcaaaatcttttccttaattgtcctcacttagaccaggtgctaggtgtccttcctagcctgcaggtcttacaggcccattcatccctaagggggtcttatatattaaccttgcttctgaactctaagcactggcaagtcaggcagaaggcccaaaggacctaacagcccataggtaactacaatgttggtaaggtggattctgccagatgccagccttggatccattttgggtccctacagatttatgcttctactataatgaatttcataatttctagtatgtgacccagggttgaactaagaagttattcttgctttcccctttagttttccctaatgggactttgatcaacatgaaaactaaaaatatcctggtgctagaccattaacactagttaactattccagactgtggccactgtcaaagacagccatcttgtaattgaattccactggggacaagaagactcaaaacagagtaggtgaatggattgcttaaagtccatctcagctactaaggagaatgaagagcagcagaaactgaattattaattcccaactctattcacaagccccctctggtggaggaagtattagtaatgaaacagctataacaataaccaaaatttttttaaaagagaaaaggcaatccacaacaaaacaatcagcccctgcagaaatgagagtcaagtgtagtgattagcaaatatgagctgcaacctgaaaaccacttacagatgaagcagtatgatgaatgatttaccaaaaggtcaacaccgctcttttgtcttcatcacccatcagttttccatcgccctcaatttgtctggcacataacagaaagcagggcataaaatattccccataaaaattaaccttactttgcaacattaaaaaaaaaaacttatagttgtatatagttgaagcgtaggggccagcttctcaattagtactcctagcatacagtagaaaaagcgttgacacttaaagccctattacaagaggtaatgttcttagcaagttccggaactctctgccctattcttgccttgctgacccactattctcaagcgaaggaaggggtcagtaatccccctaccaaataccacaccaatggtggcaggaggggagcatgtgacagcatttccccttttactctcctggaggccaaacttctttgcaatctctgcttttagctagcgtggatgccagcctttcaaccttgctatgcctgcaatactttctgacagatgagctatgagatgtaccaccttcccactcccatttgacaacctttgtacaaaaagaaacacaacgccaagggaaagtatatttttaggcatgagggattctgaaaatgaacatatctgcaaacttctagatccccttaaccagacctgaaaaagacattaatctattttaactaaactgattaaattgatttaatcagaaagcgggtcacttccctcctccctatcctgtcgctgaatttactaattgtttctccggctttgcccaatcaataagatattttgcatcttgcagatataatgtaagttatcagttattaaaaattcctcttcccggtctctggttaaagtgggtacctaaatatctgcttatttatttacgtcgttgttatttgcagatttcttttttaaaaaaagcagaattaaaatgaaagaaaaggtcaaaagagtttggaaaaaaagctatctacagggatgttcatcactgcatcatttataatagtaaaacttggaaatcttaaatttccaagcaaaagaagactgttcaaattaattatggtatagccataaagtggaatacagtcatgcatcacataatgaagttttgatcaatgacagaccacatatatgatatcgatcccataagattataatggagctaaaaaattcctactgcttagtgacgttgtagttgtcataaagtcattgtgcatgcattaccttttctatgtttagatatgcaactacttacctttgtgttacagttgcctatagtattcagtaaagtgatgctcacaagagtatgaaattgtctaatgacacagttttcattaagtgaggcatgactacactatgcagacattgaaaattaagtggtggaatatttaataacaaaaaaagatttgtggtactattaaggggggaaacacattgcaaaacagtagatactgtaatatcatatttattgagagctgttatctttgtataccattggtttgacaaacattcattggtcagccatcttccattcataacctcttctctccagcattccttgcacttgggaattgttctataaaataaaatattaaagaagaaggctgctaggtagggcttttttttctttttttttttttgagacggagtcttgctttgtcacccaggctggagtggagatggagtctgactctgtcgcccaggctggactgcagtggcacgatcttggctcattgcaacctccgcctcctgggttcaagtgattctcctgcctcagtctcccaagtagctgggattacaggcacgcaccaccacacctggctaatttttttttttttatttttagtacagatggggtttcaccatgttggccaggctggtctcgaactcctgacctcaagtgatccacccgcctcggccttccaaagtgctgagattacaggcgtgagccaccatgcccggcctaggtagggcttttcttcttgtctgattaaaaggagcggatttatctaacaggtctctttttgtatttatcctttatctttccaatctaaacataacgtctggaggaacagcagcttcattgtgaccatgaagacaaaaaaataacacgctaagaacagtagaagagaaatgccaaaacatcagctctagattatcctctaaagacttggagaaagtcactattggttggattttctttattttgcagctgaacacattcctgatacacaggagattctgtttttgttttttgcttatctgtggcttttatattttctaccatagtatgtactgttttatcataagaaaaaaatactggatacaagaaaaagggtcttttgtattcttcaagagaaatctagaggctgtgagttggagtctcaaatcatccaaggaacaaaagcacaggcaaagaagacatgccaataataaaattcttagagctgcttaacattattaatattttcattcccttcaacagaaactgtttacagctattagtattactgtttttcgagtcatggaacacttaagatctactatggtgtcaggtgctacttaaggcaccaagtatccaaacaataaggcagcccatgaccaaaaggaaccgtaacaagcaaacgaagaggaaaaacctagcagggtaaaacacactgcctaacattgctcagctggttaatggtgaagccaggactggaatgcaggtctcttgacacctaacgaccttcatcaccctatcatatgcttaacccacttaccatttagaagaaagaagtgcagcttgctaccagcacaacgctctcggagcaaacgggaaatgggttaagcattaatatctggctaaaagatgtaagaaaaactctggtgagagtatttaaggagaatgatctagatgggggtcaaaaaacatcagagacagaccttgttcttcattaactagtatttatagttatagcaggattgttttccctaaataaagggaaaggtctctttgagtggggcagaaaggattccactttttggctgggtgcagtggctgatgcctggagtcccagcactttgggaggccaaggcgagtggatcacctgaggtcaggagttcaagaccagcctggttaacatggtgaaaccccatctctactaaaaatacaaaaattagctgggcatggtggcgggcacctgtaatcccagctactcgggaggctgaggcaggagaattgcttaaacctgggaggcagaggttggtgagctgagatcatgccattgcactccagcctgggagacaagagcaaaactccgtcctccccaccccccccccaaaaaaaaaaaagagattccactttttatctatctataccacaccgaatcagtcgatcaatccactgaccacagattgtaatctcggccaaccactatagtggggaaagaaaacatagcagtgcaatcagctgttggataccacaggcaacttgacaagtcagtgacaacttggcctatttattcatcttttaaccgtttgttctggtgtctgtgtagtcacaatcaaagaatagtccctaggaatccatggagtttcattgaaatggagttagggctttggatcatatgcagaatctcagtactattccaggagaagggcagccacattgcctctgaatggccaaaacatagggtagtgaagagtgggagaatatgccagcccgaaatatgccactttagcctaaggattatgtggagctaaaggcacattaaaatacaaaacaaaacccagcaggtgcaagaagtgttctctaaccctcccctttttcttcctgaaaacatgaaacaaaacccccatatagaagacgtccagctataccagaaggaaagtctcattcttatcatcaaggatgggaaaatgagactaggaaaagtctgtacaaacagatcttgttaaaataattcttatcttcctttagcctttccacacagttgagttacttttccacaactgcctctctttgttcaacctaatataaaaccatctaggttttgccacttctttgagtcttcatttccttatgaggtatctcatgtcacataaaacttatattaaataaatgtgtgtgcttttctcccattaatctatcttatattcatttaagtcttaggcccagctgaaaagaaaaccctaaaagagtgtacaattttgcctcctctacagtatccatcttgaaagctgaaagttcactctcaatatgccttaagaataagaacaagtgggggcatgttttttagccatagttattcgtaacccaaacaaacaagtaaaggataatataagtgccaaaaatataaatgttgtctggattcacacatatcttatttgagtgactgtcattttatactgtcgtaatctgtttgcatgtctgtctttccactaaactatatgctccctaaacgcaaggacgatttcctttcatctttgctaagaatgtccaagccttcctccttccaaggctcgaactggattccaactataaaagtctataaaatatgacagctatttggaccgaaatccttcattccaaactatcctacttaaaaaaaaaagtcaactttttaacatttccaaaatatcctgaagggagggaaaaatcacacattaaattctgtcaagtaacatttacctcctcaagccctgactaatcggaaatgactggacttggcagctccttttatcacgtggtctatcagctaaatttagctcctgttgtgccaattgaaaaatgccaacatcccttcccatctcatacaacatcccaacccgccaatgactctagggtctctctggcaatctggtgtgaccactcctcatcagatcaaaatataaattacaaaccaaacttaaagtgtccaagtagccccatccagaagagcaatgatgaagttagaagagacgaagacgagaagggtgccagattcattactattgattccctgctggtctttcaatgtcacggaaagatgtccattatagttctatgaagagcatttggctcagtttaaactcttttgttttcagttcctttaaaaacaaaaatcaaccacgaaggataaacaactagaaattaatggagcccaaagggtttctgcagaatgagaagccttcatcactgcaccctaattatgtaaatctgctcctgcagagtccagtacatttatttattaagtctcaccactgccatcctggtaacccagagaagaagccaatctataatgactcaagccacatttcaaaatagactccaaaggacacatgatgtcatttgctaaaatgactcaatccagatggaaagcattctgacctatacataattgattgacctttgctatgctttccccagttatttatatactatcatatgcatgaatgtatatcagtggtatttacacttggcagctacttttaagaacacattattcaattgggatttgaagctttttacgaccatttcctgaccaaacattcataaatgacgaacaaggaaagatgttatcttaaaaataatgtttaataggctctggagagtttagagaagctttgctactctagttattttaaattacaggggacaagatctatgtacataaagctgagttcaaaccctgaaactgaggataccaaaggacattttatttactttccagtttggagctcaataatgatagtaaaatatgctgtacagaaggcatggaatgttttagatacatgtgagaagagcatcaactgtggtgaaggtagttagagacaataacaaattatcagaatctaaccatggatttcattttccaaaagaggttagctgcaaattggataatacccagataatcaagatagtttcaagatgatcatagaaggggaggcagatagattagggaaggcaaatatgaagcaagcatgtctttactcccattaggaatacccaaggcagacatccataactgattactgaattcttaaccacagagccctcacttggctcaaaatacttttccaatagtactccaggcaaacaccatcaaccaaacagacttgtcctaataacataaacagagaaagttgtatcttatttactgatcaaattaattctatttattgttaccatatactccaagattcaatctaaaactaaacaggtttttaaattcaaaatttaaagtcacatctctgaatcctaagaaaacgttaagtcaaatctagtagttttccatacttcatggtaggctagaatgacccttaatgtaaatgaaaagcaagcaggaaagctaaacaggagaagatgaaaatgcttatatgttcacataggaatattatatagcagtgaaaaggaaggaactacggccacatgcaaccacaggaataaatcttagaaacagaaatccaagtggaaatagcacatggagaagactacatacagcagtgctttccaagtagtgtgcctcagtaagtgggttacaagtgttcccaatccccttagttctggggtgaatagtacctggagtagccaaagtcttgtgtcaagccagagcatttatatcaggaggttctagaatattttcaagttctatgtatgccatgatggaagaagttaggaagcactgacatacaataattctttccagagattaaaccattataaaaccattttataatacttaaaaactaaaatgtatctgcttaggcatatatatacatatatatatatatatatatatatatatatatatatacacacacacacatatatacatgtgacaaatttatttcaaaatgataaaagaaaagcaaggaaaacatgaatggatacttcatccagtacatccattcattcagtataatggttactgttggaaacaataggcaggagatgagttaggtacaaaaacacttcagtagatggtaatgttacagttcttaaggtagatggtggttcatgggtgtttagtttattatactccaagcatattattttataaatacaacatgttatatactacttttctcaaaacatcaaggttaagaaggaaggaaactttttagctgattctgagtcaatttttcacagttgaatctcaatatggcaattcaagaatagatacaactacttttggaagactgaaactcagaggtcaagattttgtcctcatgcaactagaatagtccaaaggtttctaacagtcaactcatgtaccctatttaatgattacaagattttgttctaatccaaatagagtattaatgaaaaattgttgtaaacctaaagttacatttccctactgaaacaaaaacatcacaaaacccatatgtaagcctcttagttaagatccatttagttataaaaaacaaaacccaacctgaagtgttcaagtaaaaggattctggatgaggaattagaggtatcctacagcacataggatagcaagtacagccaggccttatgaagaaccagagccagggtgtaggcagcctttcagatccgaggttgaaacattctctctctcttgggctgcaggttcttgtgtctctacttctttctggaacctttactttattgtccctacctttagctgtgctttttctgctttggcatcgacatgaccaaatatttgtatctcttgtgatttaagtttaaaccaagtagtgccctgaagacaatttcaaaatgcccagaggggaaaaagaatctaattaacccaaccaaggtcaaaatctgtctacaccgggtttaatcagacacagctgtacataaggagttaccaattccaacaactacaggggccaggcaggtaattaaaagtatgatgctgaccaggtgtaaaaccagaagctggaagaaaagggtcttacaacaaagagaactcatgctgcctctccactttggatatgtaataatagaaatccagattttcattgaaatttcttgatttttaaaatacatctgtatacgttaggccacaggcttctactgtcagcgtcctacaaaaaatgaattgtgaatatttcagtttcggggggtcacactgggcaaacctgacttagataccagccctttgggtagaagagcaggtctcacagaagggctcatggtcaggcagtactgcaacaaagcctggattatgcactactttacacaccctccccatgaaatacacacatcagctaaacttctaaaaatatcttgttcaaaatcagatactaagccgggcagagataatcatcatgtagctttgtatgggttcatagtaaaaagcattaaaaaacaaagaaatcacacaaaagcaaactagagccagaaaaacacagcaccatcttcttcttttctttctttcttttttttttttttttttttttgagacagaatctcactttgttgctcaggctggagtgcagtggcgcgatctcagctcactgcaacctccgcctcccgggttcaagcgattctcctgcctcagcctcctgagtagctgggattacaggcacgtgccaccacacctggctaatttattgtagttttagtagagatggggtttcaccgtgttagccacgatggtcttgatctcctgaccttgtgatccacccgccttggcctcccaaagtgctgggattacaggcgtgagccatggcgccgggcccatcttcttttctgtccacagccaaaacatcctgccacaaaaggaccatttgttacaaaacaactgcatattcttttttcagttaactgaaggtaacacaggccctcctgtgtcaatttcttcaccatacaaaactgggagacacagaagtcatagcttaagtaagtgtcacttcctctcggaagcccagcctgagtccctgatcttgtataaggcaaatgtccctttacaaagcacctgtttcccttgctgtggtgcctaaccacagcacaactgatattgtatatgcacaactgtctatttatctcttccacataggtgagcttctggaaagcacagatactgtctaatcctccttctctgttcttaacacctgtttgttaaataaatacattctgtagtcagacatgtcaaaaattttattttttaatttttagcagctaattttaaaaatgctgaatttagactagattcctccttattcttttgtacgcacttaaaaattttcaacaaaacacttaaaatcttttactcagaaaagaactacacatatcactctgaattactacagactcaatatcacattgttgtggggctttcaagaatctgtgcttatatttaagctaaaaatccttcacagcacctcctgtcagtttgtagatacgcatagattttctcaatatacctgtattgatatagatataaatatacctggtatagaataaggcacggtaaaattctctacctagacataaaacccatatatttaaacttatgagaaatctggagaagtacagtatatacatgtccagcaagacttatgttccattttaaagaaatgagccttggcaaatttccctagcactgagaactgtttagcaagaattaatttttaaatgaaataagctaaaaataaaatagatgtagtattatttatacttaagtcttgttctttagcaattattaaaggttacactggtatgttttatcattggtaactggactcaagtttgaccaaatgtttctctttacccatgaaaaatagttgcaatgttccaattttgactgccattccaggtctttggtggcccttcatcaagtgcaatttggtagcctaaatgatatgggagggacagagcataatttcatggcagtaagtatagctgagacagaaaggttaaacaaggtccatgtctttggacacttgaccctaagttatgacagattaactttaaaagacaatgttttatcttgaacagaggggagttttgtcttctccttccagctaggtggaagtatttggcaaatgtcttctttggaaagaattatttagcaatggaattataatcggaattatttagcaatggaattataatcaatgtagtaaggacagaaaaagcaaactaaggacaaaggaataaatgaagaaatgacagccacacttgccaaggtgaattccattcagggaatttgccaaatgaaaaggatattaacattaacttaagcaggtttccttacttcaggaattgtctgtctttaatattcataatggtcctcatgaattttccaaaggatagagtatgcagcatttatgattatttaaaggctttataaatgtaactgctcttgggcatagtggtgctatcaggcagacctaggttgaaattctggctctgtcagcggctgtgatttcatgtgctaatttcttaactcttatgagcctcaattaccttgtctgaaaaatcagccctttcatttatatttcaacagaacttctgcccttgatgtccctttgaagttatttcccataattagtcacagatcatagcatcatcagctgcaatcatcttatctccattctattaacaaatttacatacattcttttgtatgttcaacaaacagcatatgccaagctgagctggcaactggacaaaaacatattatatgtggtttctgaacacccagagctcactatcttgttggggagaaaggcagtgaggaaatagtaatgcagagcagtgacaggtgcccataaggggttcgcctagtttggagaggagaaaacatttgagttgaaatctgaagagagaaaatgaagccactggagatgaagaaaacaaacttccatggggctgagggaacaagaatgtgcaaatgctctgtgggaggcagaaagaaagagattttgaggaggaaaaagggcagtgtagtttgcgtgcaaaaaccaggtgagcaagatgggagaatcaggagaggctttttctttttttttttttttttaatgtcaacactgtttggtgtttatttggtgagcctgagggcaattttcattctcatttctttttcttattgattatttccaaccctttcaacagtgaacatgcgttgcttttgcaattacaacaacaacaagaatccctatagacaaagcaaaaaatatatactttgtaatgtttttaaaaaacaaagattaaactacactaaaatataaggtgattatctctgaatgataagttttggggcagttttttttttaccctcatcactgctttccgaattccaaaggtaaaaagatactacttgaataagaagaaaaataaagagagttgtgtttcaagctttccctcttcccttcttcccaccctatctaacacttggaatatcccatgagggtctccaacgtcagcaggaactaagagccaagagtcgactgagagatgactttctttctctttcttttttgttgtgtggtgaagaaagaaatcataatctgacgtctaaagagcacttcactgttgctcttggttggactctaaatcacattgggaaaattaaaactacaatgagaaacatcttacaccagtcatgatgactattattttttcaattttatttttattacactttaagttctagggtacatgtgcacaacgtgcaggtttgttacatatgtatacatgtgccatgttagtgtgctgcacccattaactcatcatttacattaggtatatttcctaatgctatccgtccctcctccccccaccccacaacaggccccggtgtgtggccccggtgtgtgatgttctccatcctgtgtctatgtgttctcattgttcaattcccacctatgagtgagaacatgcagtgtttggttttctgtccttgcaatagtttgctcagaatggtttccagcttcatccatgtccctacaaaggacatgaactcatccatttttatggctgcatagtattccatgttgtatatgtgccacattttcttaatccagtctatcattgttggacatttgggttggttccaagtctttgctattgtaaatagtgccacaataaacacacgtgtgcatgtgtctttatagcagcatgatttataatccttttggtaaacacccagtaatgggatggctgggtcaaaaggtatttctagttctagatccttgaagaatcgccacactgtcttccacaatggttgaactagtttacagtcccaccaacagtgtaaaagttttcctattactccacatcctctccagcacctgttgtttcctgattttttaatgattgccattctaaatggtgtgagatggtatctcattgtggttttgatttgcatttctctgacggccagtgatgatgagcatgttttcctgtgtctattggctccataaatgtcttcttttgagaagtgtctgttcatatccttcgttcactttttgatggggttgtttgtttttttcttgtaaatttaagttctttgtagattctggatattagccctttgtcagatgcgtacattgtaaaaactttatcccattctgtaggttgcctgttcactctgatggtagtttcttttgctgtgcagaaactctttagtttaattagatcccatttgtcaattttggcttttgttgccattgcttttggtgttttagtcataaagcccttacccatgcctatatcctgaatggtattgcctaggttttcttctagggttttatggttttaggtctaacatttaagtctttaatccaccttgaattaatttttgtatagcgtgtaaggaagggatccagtttcagctttctacatatggctagccagttttcccagcaccacttattaaataggaaatcctttccccatttcttgtgtttgtcaggtttgtcaaagatcagattgttgtcgatgtgtggtattatttctgagggctctgttctgttccattggcctatctctctgtttttgtaccagtaccatgctgttttggttactgtagccttgtagtatagtttgaagtcaagtagcgtgatgcctctagctttgttcttttggcttaggattgacttggcaatgtgggctcttttttgcttccatgtgaactttaaggtagttttttccaattctgtgaaggaagtcattggtagcttgatggggatggcgttgaatctataaattgccttgggcagtatggccattttcacgatattgattcttcctacccatgagcgtggaatgttcttccatttgtttgtatcctcttttatttcattgagcagtggtttgtagttctccttgaagaggtccttcccatctcttgtaaattggattcctaggtattttattctctttgaagcaattgtgaatgggagttcactcatgatttggctctctgtttgtctgttattggtgtataagaatgcttgtgattttttgcacactgattttgtatcctgagactttgctgaagttgcttatcagcttaaggagattttgggctgagatgatggggatttctaaatgtacagtcatgtcatctgcaaacagggacaatttgacttcctcttttcctaattcaatacactttatttctttctcttgcctgattgccctggccagaatttccaacactatgttgaataggagtggtgaaagagggcatctctgtcttgtgccagttttcaaagtgaatgcttccagttttgccaattcagtatgatattggctgtgggtttgtcatagatagcttgcattattttcagacacgtcccatcactacctagtttattgggagtttttagcatgaagcattgttgaattttgtcaaaggccttttctgcatctactgagataatcatgtggtttttgtctttggttctgtttatatgatggattatgtttattgatttgcgtatgtgaaccagccttgcatcccagggatgaagccaacttgatcgtggtggataagctttttgatgtcctgctggatttgttttgccagtattttattgaggatttttgcatcgatgttcatcagggatattggtctaaaattctcttatttggttgtctcactgccaggctttgatatcaggacaatgctggccgcataaaatgagttagggaggatttcctctttttctcttgattggaatggtttcagaaggaatggtacccgctcctctttgtacctccggtagaattcggctgtgaatccatctggtcctggactttttttggttgctaggctattaattattgcctcaatttcagagcctgttattggtctattaagggattcaacttcgtcctggtttagtcttgggagagtgtatgtgtccgggaatttatccatttcttctagattttctagtttatttgcatagaggtgtttatagtattctctggtggtagtttatatttctgtgggatcagtggtgatatcccctttatcattttttattgcatctatttgattcttctctcttttcttctttattagtcttgctagtggtctatcaattttgttgatcttttcaaaaaaccagctcctggattcactgattttttgaagggttttttgtgtctctatctccttcagttctgctctgatcttagttacttcttgccttctgctagcctttgaatgtgtttgctcttgcttgtctagttcttttaattgtgatgttagggtgtcaattttagatctttcctgctttctcctgtgggcatttagtgctataaatttccctctacacactgctttaaatatgtcccagagattctggtatgttgtgtctttgttcttattggtttcaaagaacatctttttttctgccttcatttggttatgtgcccagtagtcattcaggagcaggttgttcagtttccatgcatttgagcggtttttgaatgagtttcttaatcctcagttcttgtttgattgcactgtggtctgagagacagtttattataatttctattcttttacatttgcaaaggagtgctttacttccgactatgtggtcagttttggaataagtgcgatgtggtgctgagaagaatgtatcttctgttgatttggggtggagagttctgtagatgtctattaggtccacctgctgcagagctgagttcaattcctggatatcattgttaactttctgtctcattgatctgtctaatgttgccagtggagtgttaaagtctcccattattatcgtgtgggagtctaagtctctttgtaggtctctaagggcttgctttatgaatctgggtgctcctgtattgggtgcatatatatttaggatagttagctcttcttgttgaattgatccctttaccattatgtaatggccttctttgtctcttttcatctttgttggtttaaagtctgttttgttagagactaggattgcaacccctgcttgtttttttttttccatttgcttggtagatcttcctccatccctttagtttgagcctatgtgtgtctctgcaggtgagatgggtctcctgaatacagcacactgatgggtcttgactctttatccaatttgccagtctgtgtcttttaattggagcatttagtccatttacatttaaggttaatattattatgtgtgaatttgatcctgtcattttgatgttagctggttatttcgcccattagttggtgcagtttcttcctagcatcaatggtgtttacaatttggcatgtttttgcagtggctgttactggttgttcctttccatgtttaatgcttccttcaggagctcttgtaaggcaggcctggtggtgacaaagtctctcagcatttgcttgtctgtaaaggattttatttctccttcacttctgaagcttagtttggctggatatgaaattctgggttgaaaattcttgtctttaagaatgttgaattggcccccattctcttctggcttgtagagtttctgccaagagatctgttgttagtctgatgggcttccctttgtgggtaacctgacctttctctctggctgctcttaacattttttccttcatttcaactttggtgaatctgacaattatgtgtcttggagttgctcttcttgaggagtatctttgtggttgtctctgtatttcctgaatttgaatgttggcctgccttgctaggtttgggaagttctcctggataatatcctgcagagtgttttccaacttggttccattctcctcatcactttcaggtacaccaagcagacgtagatttggtcttttcacatagtcccatatttcctggaggctttgttcatttctttttactcttttttctctaaacgtctcttccggcttcatttcattcatttgttcttcaatcactgatattctttcttccacttgatcgaattggctactgaagcttgtgcatgcatcacgtagttctcatgccatggttttcagctccatcaggtcatttaagttcttctctacactgattattctagttagcgattcgtctaatcttttttcaaggtttttagcttctttgcgatgggttcgaacatcctcctttagcttggagaagtttgttattctgatcttctgaagccttcttcactcaacttgtcaaagtcattctccatccagctttgttcccttgctggcgaggagctaggttcctttgtaggagaagaggcactctgatttttagaattttcagcttttctgctctggtttctccccatctttgtggttttatctatctttggtctttgatgatggtgacgtacacatggggttttggtgtggatgtcctttctgtttgttagttttccttctaacagtcaggaccctgagctgcaggtctgttggagtttgctggaggtccactccagaccctgtttgcctgtgtatcaccagcggaggctgcagaacagcaaatattgcagaatggcaaatgttgctgcctgatccttcctctgaaagctttgtctcagaggggtacctggctgtgtgaggtgtcagtcggcccctactgggaggtatctcccagttaggctacttgggtctcagggacccacttgaggaggcattctgtccgttctcagatctcaaactccgtgctgggagaaccactactctcttcaaagctgtcagatagggacgtttaagtctgcagaagtttctgctgcctttttttcagctatgccctgaccctagaggtggagtctacagaggcaggcaggcctccttgagctgcggtgggctccacccatttcgagcttctaggccgctttgtttacccactcaagcctcagcaattgcggacacccctcccccagcctcactgccaccttgtggttcgaactcagactgctgtgctagcagagagtgaagccccgtgggcatggaaccctccgagccaggcaccagatattatctcctggtgtgccctttgctaagacagttggaaaagcacagtattagtgtgggagtgtcccgattttccaggtaccgtctctcacggcttctcttgactaggaaagggaattccccaaccccttgcacttcccaggtgaggcgatgtcccgccctgctttggctcatgctccgtgggctgcacccactgtccgacaagccccagtgagatgaaccgggtacctcaattggaaatgcagaaatcacccatcttctgcactcctcacgctgggagctgtagaatggcgctgttcctattcagccatcttggaacctcctcccatgatgactataagggaggcttttaaatggtggaaatgaatggtttccaccaggacagtggcaagattcaattatcattttaaaaatctctgtcaagctacagtgtggaaaatggattggaaggagacaataatggctgcaagggtatcaattaagaggctattgtagcaaggatgataatttaaactgcaattggaacagaagatatggtaaaatgtgacaaatctgagagatatttaggttggtaattaattgggtaagagaactgtggtacattttacacataaagtcctaaggtgcagtatttgatttggtctataaattgtactccaaatcagctgatgcttttatagttagagagaattatctcagtagacgtaatacttctctttcaaaaactgtcatggttcttaatcatattccacaatggtcagtatggggatgtttatgcctcatggaatagagaaatcaaaaatttaaatctatatttgatgttaaatataaatagtatcttcttataaaaatacattaccattactcttagcttgatatattgtaaattgctttattcacctcctcagccatttttcatcagcagtagtatatgtgctccctgttcctggcagtgattcactggatgagaacataaatgtatttgtgggaatatgtatgaacgttgctctgggaacaaaagaaacagttctgttataccacattggtggtaatcattctttcccaaaatcattgcttgatcccttaaacaaacaaaacaatgtgaaataacaagcattgcaaatacctaagactttggtgtattgactgcctatctgtcaaatttgacaggaaggattaaccatggtttcaatatttacacttggattttgaaagactagataccaagttgatgactctttgaaaataatatagaaaagtatatataaatacataggtaaaaaggatgggacaaaagtgtcaatggttactgctgaaatatggttttggagtgcaagtataggggatttctgctattcattttatgcttatgcaatgtttaagttttaggagcaggtatcagtttctaagaaaaatcgaaaaaagagcagatatgaaaaacaagatcaataaaatagtttcactgtttaataatgccaggttagtgagaggcaacattcatcatggaaactaaatgcattacactagactttcactatttataattatttttctaggaccatgatcagactggcccacggtatataatctacaaattgactactgatattgtaagagggctcagccatattcaaataccatctattaaaaaaattaaatatgctaattcgccactacaatttaaaattcaactgtaggtaaataaaagtaaattgtgccaatatgcatgtggaattacttgcttctgatcaactaaaaaaaaattagtaagaaatctggtgaacatcgtattggtaaacaaaaacaatttttaaaggaaagtggcaagatccatgtccagtctgatccaaggtgttgccagaatggcagcccgagttgagagcagaaatgtgtttctcctcacacctttccaacttttaggctgtggtcacttcaaactaagaagcaaatcacatcttagcccatgtagtaatgaggttatccacactagaatgcataaacgtcaccttgtggcttgttaaaaacacagattcttgcccatcacaagattatattaaactgactagggtctctaatataatgatgaataaaaatggaaataataaacacatttatgatctcaacaagaaaattgttaatatttcaaattaagtatgaagtctgctgtaggactttttttttttttttcgagatggagtctcactctgtcactcaggctggagtgcagtggcatgatcttggctcactgcaagctcctggggttcaaacaattctcctgcttcagcctcccgtgtagctgggactacaggcacctgccaccacacccagctagtttttgtatttttattagagacaggatttcaccatagtggccaggctggtctcgaactcctgacctcatgatccacccgccttggcctcccaaagtgctgggaatacaggccgccctgcccggcccctgctgtagttttttaaaataaatatttatctgattaaggaagctcagctctattcccattttgctgagattttaccatgaatgaatgtgtttgtcaattttttccccttatctattgagatgatgatatggtttctcagttttactctattaatatggtaagttgcattgactgattttcaaataatcagcttgtattcctggaacaaacccaacttgataatgatatattattctttttatatatcactggatttgatttaccaatgttttggctaggatttttttttcatttatcttcatgaaaaaaattgaactgtggatttattttcatttaatacccctcatctttggggtcaaggttatgctggtctaatgatgtgagtttacatataactgatattgcttcttccttaaatgtttggaagaatttgctggtaaatttaaatgggctcttttttgtgggaagatttctaattatgaagctaatttctgtaatagatataggataattcagattccctaaaaatatatcaaatttagttgtatttttaaggaatttaaccatttcatttaaatgttcaaatttactggcataaaatcttactaatatcttttttagtgcttttttatttctgattattatttcaataatttctgctcttatctttattttcttctactttctttgcatttattctgtttcttttttagattcttgatactgattactagattactaattttcaggctttcttcttttctaagaatttaaggctataaatttccatataaaaactgctttagctgcaacatcaaagcttgatatgttatatcttcattatcagaaatatttttaatttttgttgtgattactttctttgaaacatagggaagaaaatattacctaatttccaaatattggaattctatcattatcattttattactgatttccaccttaatactactgtgaacagaagataaactctatggtttaaagcctttgacatttgttcagaagtgcttatgtctaggtatatattatatttactaaatctttaaaaatgtatatgcttatttggttgttgcagtgttctatacataagattaagtttgttacaagtggtgtttgaatcttctatatgtttactgacttttttgtttgttttgttttcagacagggtctccctctattgcccaggctggagtgcagtggcatgatcacagctcactgcaacctctgcctcccaggctcaagtgatcctcccacctcagccttctgaattttttggttttgtagagatggggtttcgccatgttttccaggctggtcttaaactcctacactgaagcgatctgcctgcctcggcctcccaaagtgttgggattacaggtgtgagctaccaggcccagccgtttactgacattttgtcttcatattctattaactacctgaagaggtatggtaaaatcccaactaaggctgaagatttgtatatttctctttttcagtgctgttatttgctttcaaatattttgagaccatgctatatgtacctatacatatagctatgtctgcttcttttggaatactgtgtgtttgcacaatgtttctctttttacaactttgaatctttatatggatttatatttagactgtacctcacatagttagcttatagttgtcttgttttaataatccagtctaataatctgtttttaaatagaagtatttagtgttttgtattaatataattaaggttatatttatattcttatcactatcttaatatattctttatttgtctcacagttttctgttcctaaattctctttttgtcttcaattaatcaaatatattttatattatccattttccccctctatcagcttggtaactgtacattctttaagtggttaccctggaaatgaaaatatgatttcttgacttattagaatctaccataattgatacttttatcctgtctggataaggatttcacattattttaacttcatttaatccactctcattctacctgttattgtttgttgcctttattttaattccacaaatattttatttttcaagctttttattatggataattcccaacatatacaaaaatagacttaataatctaatgaaacgttcatatttatcatcctgctttagcaatcattagctcatgaccaatcttgttccatctctatccccatccattttctctccaaatatattattttaaaacaaattccaaacatcatattacatttcttatgactatttctgtatgtatatccaaaagatgagtatgctttttataatatataactatgatgtcattatcacacatacgaaaaaataatgataatgggccaggcgcagtggcttacacctgtaatcccagcactttgggaggtcaaggcaggtggatcacttgaggtcaggagttcaagaccagtctgtccaacatggtaaaaccctatctctactaaaaaagtacaaaagttagccgagcatggtggtgtgtgcctgtagtcccagctactcaggagtctgaggcaggagaatcacttgaacccgggaggtttcagtgagcagcctgggtgacaagagtgagactctgtctcaataaataaataatgcataataccatcaaatactctggaaatactcaaatttccaaatgtctcaaatgtgataaccatttttataggtattttgaaatcaagagccaaataaattctgcatactgtgattggtttatttgtcctttaagcttaatttaacctattgattctccctcaatctttttttttttgcccccttgctatctatgcattggagaaaggggcttgttggaactgaagttttccacgctctgatgttttttcccccatgggtattgtattaaataaaatgcttcctagctgtaatttctgtttgtttgcagttagatctagaggcatgcagattcaagttcatttgttttgtttttggtaagattacctcatggctagtggtttatgttcttttctcttttcccataaatattcagggcctggatccgttaattcattaaaataaaaaaataagaatattacacttttaaaacatttattagcaggaatcctattatcaagagaaaattcccccatctatgtttacttagtcatacaagagatgtggaacaaatgcttgattttttacatttgtataccatttttcaaaacaacaaattggttcactaacatctttccatggtaaccaatcggttataattattcttaatgttatgaactcatggatataaaatatttgatgaatttgcatctgctgcagttactgtcaatgagtgcttaaattgttctatctttagttataggacttacactccactaaacattactttgattgttttaaacaatccatattcatagacacttacttatatatttatactttttggtgttcttcatgccctccttcatttacatgatttcaactgggactatttcctctgactgaggagctccttttaatagttttgatatagatatgctgataattaattatcttagttttaattttctaaaaatgtcctttttgaaggatgtgttcggtaggtataaaattctgaattggcaattactttcttttggcactttaaccatggcatcccattgttttcttggttccattgttttggtttaaaaattagctttatgtctcattggtgtgcctttgaaaatatatcttttttcctttggatgcttttaagatgcatttatttgtcttcaatttttaagcagttttactacaatatgcctccatattttatttggctttttttttttcttacacagtttcttgaatccatggcttgatgttattcattaattttggaaaattctttactgctattcttcaaataatacttatgccccatcttccctgaaatctcctcttgggcctccaattgcctgacacagacctttacactaaccaatatgtctcttataaaattttctttatttttgcattctcttttccactctgctttaatctggatattttcccttgatctattttccagatcatgaatcctctcttctgttgtgtcaactctattattaaacctatctacttagttttaaattacacttactgtaattttaactttcatgttgtacatttgattcctttcataggatctagatctctggtgaaattctctgtctcttcttgaacatattaatctcttatctgaaacagattatagctatagatcttatagctccaatttctcagtcacttttggatctgttacttttggttggttttctgtcttgattattggccatttgttcttgtttcctggcatgcctactactttctagtgaatgacagatacactttttatggaaattgtacaagttttgaatgatgttatctttctccaaagatgatttgattttcttctggcaggcagatagagtacaggaaaatcatcttaatccagttgaggctggtatatttccagtttgctcttaccctaggttgtagttcttcaggggcctcaaggaccttgagtatttccatggtcctacttctttgaaagccctgaactctgtgagacactgagactgctacaatatctgctttgccatttactcctgtatcagatattttcagctttatattttgttgtctctccctgggagtgtacaaaaaggcctcaagggaaaattccatgcagtatgttgaacttacatctctgtggctcctttcctctgggatcttgtttcctccagtcctttgttggtagccctgaactccactggtcaggaaagaatttaagctatttccactttagaaactaaaatcttaagttacgctccttgttgatgtattcatgcttttattttccctgatttttaatattttaaaagctggtcacattctcatcattttggtatgatcacaaagaaacatgtagtaatggaaaacaaagaagtattgaccttcactaggcaatcaaccctcagataatgtcaggaaatctgaagctttctcaagtaggagtatggaagagtggagaagggagatgtgttatttatcacagacaatactcagcacaattttattgctccttggggaatccaaagcttttaaagatgatattattatttggaaggcctccagagagcactaagtattaaaaatagcacctgcattctgctaagtcaaatcacctgtttattatccagggtgatgaaaatcatttaataaaatattacagacgcttgttcaaaatcatgcacacaattcataggctcagagacattaatgtctatgcctggctcactacatatttgttaaattgataactcaggtggacattagttaatattaccactttttaaaaattaatgatatcaagttatttgaaatagccagtagaaaacctctgcagtaacatttcccatttttcctcatacaaaatttacataaaacctttgctttgtaatagccactatcttttttctttagagaaccttctcctcctcctgcctttagaatataaatataagaatgtgactcaggtctggtcagtccctgttcatcccattggccagagttattggttcagaaatgagcatgtgatctacattattccattgagactcagtacttggattttatgaacactactggaaagagaattgctgctggttggtaaagggatagaatgaaagattcaatgtggttatcaccacgtaatgaagacctgcctaagactgaagccaaaactacttaaaacttctcagttacatgaatcaataaatgccctttgttgcctaagccagtttattaggactgggtttcagacctggaaccaagagttcttactaatatagctataccaaaaaagtgtgtagcagcaaccaagtctgtcaacaagagtgattaaccctcaggtttaagaacaaaactgaaaagacgcagtagcattaggaacatgtttttgtggtgataagatttattccagtccactgataatgttttactttcccacctacatttacaggatgcccaagacatgaggcctgaaatttatcaataatatcaaataacatagccccattcttgaagttccaaagttagagtattattggcatttttcacctattcctcacagagcttagttatttggggatgaagtaagttacagaagtttccaaaaaagaaggaaatctctatgtgtttcatgtttttaaaattctgtcttcggctttggcttaagttatggttactgatggtagctgtaagtaatattcccaggagaaaggctgcaaataaaatgagaattcctcagcatctttattgtccttcaagtggacacgaattcaagcaggtgcacatactgaggatcatacatttctactcatggcatttaattaggaggaaagtaaaatgtgcagggccagaactttaaatattagtttaataacctttatgcacctaatttctgaatgattttcttactctctggagaggcatctaatgtcagacagtggcattaaggtgaaattaaggtgagtcatggtaactgaaaagccatgaggcaggcacatgtcagaattattaattttaaaggatatatgaaatattttctcctctgaaaatatgcccagttaatgtatgctgaacttgaagtatggctttatttccctcattcacaactaatcactgtctccaggaggaacagactaaagagagaaagattacaaaagaagtatagccatttcaaaatccccaaacaaatgagaaatcaaaagaacaatgacaagcttgttggttatgtagagtaaaatttttagtgtgccaatcatggctgataccatgttttgaccatgtcaaaattcatcaaggcaggagttttcaaaccttttttgaatatgacccacagtgaaaagtatttctatatctatctgtaatatgactgtgtatgcatatacatttacaaaactcttaccaaattaaatgaactctcatattttctattctatataatttcactaaaagcaatccctaaattgtctcacaactcaccagtagcttacaagttgatataaaacatataatttgacatatattccacatcttaggctaagagaattacacatattcaaatcattaccaatgccaatttcagattaagactgttctgaaatgaaatcaaatcaactctttctacacagtggaaattcttagaccgtttattaacttcactaaatattttcataaagcatttgaagcaagatgctttcttcaggataacacctccaaacatactttgtatctttcgtttttctttttcttttttttttttttttttttttttttttgagacggagtttcactctgttgcccaagctggagtgcagtggtgggatcttggctcactgcaacctctacctcctgggttcaagtgattcttttgcctcagcctcccaagtagctggaattacaggcacatgctatcatgcctggctaatttttgtatttttagtagagacagggttttaccacgttggccaggctaatcttgcactcctgacctcaggtgatctgcccacctcggcctcccaaagtgctcagattccaggcgtgagccaccacacccggcctcagaacatactttgaaacaacccaatgcaagctcaccacctcaaatccagatccaaagacgacactatctttaaaacaaacaaacgaaaaaccatgtctctataaaaaggaatgaaacataatgtcacagggtgatattctaatgagacaaagaggtagtcccattatctgttttgttttacctggtggtatcaactgttgtttcatcactgtttctgtgaagaacatgttttcttaatgaacccttgagaaggacagtgatttgatgaatgaaagatgtgacacatgaaacaaaatattcctcattccacacctgtgtatataatatcatttggctctccaaattatcttaaagtttgaatctcatttcttccttcctcaatattttcttttaccatggaggcagggacagcaaagaaatgtttcctctccagatccactattaactgaaaattccagtgctctgaatacttgtttttttttttttatttttaaaaagggacctgaatttctattaaaggatttcctttattaactcctgctgaagaatttacatattggcaggttggaaagtaagccctgtaggaaagaaatcggacttgtttttcatcatcaacatgacggtctgatgatgggtgtatgagtttcctgttgacacccatgtcacatttactgaattactgttgagaccacagggtagacccagcttatacaattcttttgtcttctttctgcttcacagatcattcataatcacacacggggtaaaaaatgagggagcgaaaattgtgtaagctaattttcactgttgctggaagcggaagcaaatagttctcagagctgagagtgaacctgggtggtgaagagcagtcagcattaccggtggcaagttcagcattctgaccaaaatgagccactctgaaccctggtgttcagtcaatggcggtttcctcaaatttgtccttaaaagttgaaatgtatcatacttctgctcagccacccttaagaaacttgagtgtatgagtgtgtgtgaaatacaaataaaacctacacagctattgtctggattgaacaaacaagcaaatgtgctcagttttccaaacaattgcagatgctgtaataattcagaaaagtgtgtgctgagcagtgggggatgctggcatgctctgttagaatcattgtggctgggtgcggtggttcacgcctgtaatcccagcactttgggaggctgagatgggcaaatcacctgaggtcgggagttcgagaccaggctgaccaacatagagaaaccccatctctactaaaaatacaaaattagccaggtgtggtggcgcatgcctgtaatcccagctactcaggaggctggggcaggagaatcacttgaacccaggaggtagaggttgcagtgagccgagatctcgccattgcactccagcctggacaacgagagcgaaactccatctcaaaaacaaaaacaaaaagacagagtcattgctaaccatgttgcttagcacaattttggaaggaggcatgatgctggcacagaaaacccttgtcagaaattcctattccttaattttatgctctttctttcattcttttctcacttcattgtcatacaggcaagtgaaaaagagtggaaagagaagaggcggtgtcaaaggaaaagagaaaaaatacacctgactcctgttgtttatgattgtcttgtcagttaacacctgggcaatcatcaaccatgtactttccttgagccaggtccttaaagaacccaagatgaaggaagtagacagaagcagctttggggtggttagggtagtgcttctagaactttaacgtggctacagatttcttgggagtcttgttaaaatgtggattctgattctagagtggggcctcaaattctgcttcagttggtgatcttgttaaaatgccgtttccgattatggggtggagcctcagattctgcacttctactcttagggaaacccaagcctcagggttagtctttgagcctggggcagtggcctatcctgggcctttttctttacaggtatttcacttgactacttctccttttttcaggggcctgcagtaaagagaaataaagcatgacatagtctgaaaagcactggttctagaatcaaacaaacttgggttggaattccaactctgcaactgatttgcaatctgtgtggtcacaggtgagttttttgaatccctcttaaattcattttctccatctataaactgggtatgccattttttaactctcagggcagctacaaggaacaaatgagatcatgtgcatcatcaggtaggttcacattcattatgaaatgaatgactaaagagcctaaagcacaaccgttctatctacaggtaataaaaaggaaggtagggtgcaacaatgtttaaatacatctttatttttcttaataccatgactttggctcttccttagatctacagctatgggttgtgtagagttgtaaccacattaagccaagcatgtcttcccatttcgaatacttttctgactccagaaattcattctctgatcatgctttcagtaatgacaaaatccagaacagattgggtttttgaaaatatttcttgctatatcaaatgaggaaaatttgaaaatatttcttgctgtatcaaatgatgaaaatacatctgatgatttacttgccctcaattaattcagttcttaggcttgctcttctggacttctctggctcctgtttccaacaacagatttcccttcttctcaagctcccctcttcccagtctctctcctccaatctgaaattgggctccctttgctcccatagtaaataaggcaaaagtgtcccttcattcccatgtgatccagctggggaatctcagtttctctaaaggaatcaagaagatacttcagagttaaccagaggaattaaagaaaaaacagttaatgccagccttctccaaccttcccacatcagcagactgaacaaagcgctcaaaactcagggtttaataaagagggaaaaaggaggaggagctactttattgggtgtagtagagacaaagagggaaatagaagaaaattgtgaagtagtgacattagctgccatgtcctacctcctctggcagttctccagggcagacagggctggcagcggatgggtgttataactcctatggatcatgcctgacccttctgggcccgtcatgacttctgtttagatgacactaaagggtctcagggcagcatcagagcaggaaggatgtgccaaccacagaagtgccaactcatgacaagaatcattgctcattcagggattgctgcccctgccatcaccccctctgtcccaggatctgcattccgctgttctctctcctgcaagctgtgacagcagaagaggggcctccttcccattagctcatttccatctcggacttagtcaaaggaataaattattgtcagctcatctgtcttattagattgagccacatgatattgccatgttgttgctccaatactggcaatttcatgtgattcaacctcatctgctgtttagagaaaggaagtttcactgctatgaaaaactaaaccatttctgtggctgagctatgctgaccagaacagagttatctcaaattcatctactcaaaagctgcatattttaaactgaaatgcactgagcgtcttccttatccctactttccacatttctaagacaagataaattcagcaacattctttagaaaacattccatctccaacagcaactatcagtcaaacaacagggaatcattgtgcatttactctgtataaagcataagaaggataaaaaaaataaacacaacatcttttctgtccctaaggagtaactgacgtagctgaagaaagaagaggggaaaaacaccacaaaaaatgtaaagaatgaagcaacaatataaggaatgtcacaagacagaccatgatcatttgctaaatgagtggaatggaaaataagtacagtgagttgagaggcaggagcaatcacctagaatctgatgtgagccactttctatctaatttagctcatcaatcacctcaccctcccacctacttactgtgggaagttatcacagaaaatgaaaatctcctctctgcctactcataactcccagatgtcggttccagaaatgtatgcccagcaggtctcagaccactcccactcatttattgggtccatctcaggaaaagatgggggaatggggacatttacactggatgcttttctttctctaggtgaagtcagcatgacacaggaaaatgggagaaatctaaatgtgtgtgcctcaatataaactgtagccacctggtagcctagcacttttcctgacttcatgactccttttaattctgaatttcaacctttctgagcagttgccaatagtaaaaaaaatgacataaatttaagcatactacaaatacctgtttagatacaaatgaggtcacattaacacctcacagcccccctattttagcaattccctgcgtgctctcactcacacaatctcccatggtaccctgctcttcctctctgctgagggcctccctcttgaggacaatgcctagccatggaccctgtctctagtgtcctcctggagaagggtgtttcctttcccagggggtcatagccaagggctctgcaaggcagcagcagccctggctgccccagtacttctggcatgaaagccatgctgggatgttccatgcagaaatgcagataatacccttctgcccaacactgtcaccctctactgcctgggttgaataaaagtgaaagtttgctaaggtcccaaggcaacatctctgaccaggccttttctccttctcccctttcttccttccttttttttttttttttcttttttttttttgacagagtctcactctgtcacccaggctggagtgcagtagcgtgatcttagctcactgcaatctccacctcccaggttcaagcaattctcctgcctcagcctcccgagtagctgggactacaggtgcacgccaccactaccagctaatttttttaaaatatattttcgtagagatggggtttcactgtgttgcccaggctggtctcgaactcctgagctcaggcaatccacccgcctcggcctcccaaagtgctaggattacaggcgtaagccacggtgcccagccacttctttccttttttgagacagggtcttgctctgttgccagtactggagtacagtgatatgatcatagcacactgtagcttcaaactcctgggctctggtgagcctcccttctcagtctcctgagtagctgggactacaggtgtacaccaccatgtctggctattttttttttaagagatggggtcttgccatgttacccaggctggtctcaaactcctggactcaagtgattctcccaccttggcctcccaaaatgctgggatgaaagccattgtgctcagccctcaccctccacttctaatccataagaaagacgtgtcaattttacctacaaaacatccctcgagtcctccccttcactccatctcggcagataccctgttggttgcttattaattaccatcacctcttacctgggcctctaccacagcctcctaatgtcctgcttccactcttgcccttccagttcattctgcacaaagcagcaagagggatcttgtaaaaagactaaatggatcatgtcttcctagacttaaaacccttcagtgctttccctgctacactcagaataaagtcaaagcccttggccctggcctacggggccttccaggacttggccccagccttgctctacaggagactgtccagtgaaggttataaactcaaagtccactgcttcccatgagaagcctgggtcagaattctgggtcttctgtttaccatgtgaactgtggagctttgggccagcttcttagcttccctgcacttcagttcctacacatggaaagttacatatctcactggattattagaaataaagtgagatacaacgtatacagtgctaggaatattgccagtcaatagtaaatgcttcataaatataatcagcctggtctgctttcatttcttcgaacacatcttttccacttcagggccttccatttgttgtcctttctgctcagaatgctctccctcctccccgtttgtacagaaaggccttccctgactaacagatctcaatggggactctccctgtctcactctgttattctctgttgcaactcttcatttccttcgtatcacttgtatcctgtgataaactgccattattttctttctttggctattcactgcttattgtctttcccttccatgagactttaatctttataagtattaccattgaattccagtactagaacatcattttgactcagggatccttcaagagcttccatcactatttaaatttttacagtgaggaagtggatgaatcttactaatctctcatctcatggtctatttccatttggcttttacttaaagggtcctctttctgtggaggtcagaccaactctctggggcagggttggacaaaaaacaccatgattgactcagtctccccaactcccctgaaagtacatataagcttcttttcaaggactccttgccttcttggacagatatttaactaagtaacctctgatggctccttttatctcaatccgatttaccttctctcttgtgtgtgtgtgtgtgtgtgtgtgtgtgtaatgcacacacttactaagatgttggcttagcccagagtcctcagaaagcacagcctgaggcaaaatcttacataatcctaatttattggaatgtgccatccagggaaggaagagggagagaagaaggaaatgaggaagggacggagaacaagcagatagatacaagggtatatttctgagctggctgccactgttactcagcacaactgatgtcagatctccaggacccatcttctgaggcaggctgtgtgaatgacagctcctttggacaataagtcagggtaagaaggagatgaattccaggttgcacatacgtgggagctgagccatctagtgcatcacaggcctcagtggcaacatgggagccctgggggagatgacaggctgacttgagagaatgggagcagtcactgtaacagcctttggcccttggcagcaacaatgtcagcagcattagtgacctggctctgtaaccatgagagcagcacaaaccaggcaagcatacagatctggaggatggcctaaactaagtctcgtactgatgggtaggaaggtgatgactgtccaaatgtagtgtttgaggatggcaagcatgggacatataggctcaccactcctgaagcttgcactcatggcagacatctttgtactttgtactttgtctggctgagcccaagtacagcctcaaaacacttcttcatacagagctgtaatcagccactacatcacaacagtaatgcaaatgatgacagcataagataaaaaaaattgtaattcacacctgaaatgataaagacaaaaacagtataaagctaatgaaaatgatgaatttcagaaagtgaaaaatccaccaaagggaagcccttccagagcatcttccatctaacccagctccatagcccagaaatcagcgtctgtggatcttcttgatattgcaggaaaagagaatgccattcaaatgacagcttttccagaactggaattctatgtacaacctagcatcacagctctcatcattctgtatttgatgacagttttgtgggtttcatatcccaaaatgatacctgcctaattcacagagcaaagtttatttcatttaaagcagttctgatcaggggaaaatgtttcattgtggtgttataaggaattgatctgctaatgttcttcttaagctttgacattaattacagagaagatgcatcatcatttctactgacccttcattccacccccacctaccaatacacccacccaaatgttcagagctttgtatatgtgtcttaataatctgtcatccaatacttggcaagtgaaatgtgctatcatatggtaccaagaatgttcgcagctctggctaaaacttcactggatctgatatttaagccttagtggtgatctaacataggcagagaactgtgctaagaactgatagatgcagaagtgaataaaacactgcccctttcccttagagtagtaagttccaaactaaaggatagaacccaatagtgggtcttgacatcaacttaggaaattgtaacgagaaattttaaaagctacaatagaattgaatatagtagaacatatctcaaataataataaagggtatagtttcatgaaggggtgtgtgtgtgtgtgtgtgtgtgtgtgtgtgcatatacatgtatttctttctgtaggtgatctaacagtttgaaagcctaagttttccaaaggtgaaaaccatcattcaaacacataatgataaaaatttacgtatagagaatccctggagtcatgcagaatcaacattcagtatgcatacaggatggcagagattagtactaagggggcctgatattcaggcaatggtgagaatctagagtttgccttctaaagcccacattcctcatattactctctgctcagaaaccactgtatgtgcccccatcactacagaacgtaatccaagctcatgagtatggcattgaaggacctccaagcttatttcccactactcttcacctcctcccacaccttcttgatgccatactgttgctataatcatttttgccattttgaatgtgttctgtgtttgaatacgttctgtgtttttttacttctggacccttgcacaaactcttccttcatgctggaatgtctttccttccctatctgaccactaaagtaatatacttacagtggtcagcctttgttttgtctctccagcaagctatccgatcctccttctggtaataatattttctttcctttgagaaactccctgaaatttcatgggttctgtggtcaatcataatgccccactgcctatggccacaggagaagctctgtgacaaacatacagtgattggttgaaaaaaacaagcatgtgacctatggcagaacattatactctatctcatgtacagacgggtacaattccttctctgaattctaacagcagccctcaaaatacagtgagcataataattacctggaagacttgctaaaccacagattggttccacccccagagtttctgattggataaatgtaaattatggcctgagattttgcatttcaaataaattcccaggtgcgttagcttcctcctgttgctgtaacaaattaccacaaacttagtggcttaaaacaacataaatttatcttcttacagttctggtggtcagaagcccaaaacaggtcaaggtgttgacagggctgttccttctggaggctccagggtagaatccatttttttggttctctcagcttctagaggttgcctgcattccttggctcatggcccttctcttgcatcactccaacctcttactgctgtcctcagaactcctactactaacgcttacctcctgtctcccccttataacgacccttgtggttatattaggcctactgagataatgtagaataatctctcattctcaacccccttaacttgatcatatctgtgaagtcccttttgccataagaggtaacttaggcctgagtcctttcacctgaggattaggatgtggacaactttgaggggtcattattcagtctaccacaccaagtgatgctgatcctgatagtccagggtccacactttgaaaaccaatgaattactatcactatcaaagccagcctagtattttattctttagtctgtctgcctcccactagattaagaggttgcagaggctggaatagatcttggcctttttaaaaattgctttaattctatgtacattctcctttctgaatactggtaaatacatctttcagttaaactggaggaataggtaaacagtctgaaatgctgatagaaaagaaaactgtgaagataaaaccccaaagtggagaggtattggttaataggattatctggattccttactgccaacagtaaatctttctacctaattatgctcccaaatttcaaatttctctattgctgacaactatcgccattttgatgccccccagttatttctcatttttctcaaaccaaatttgtgtagctggccagcctatcctgagttctacctcatgggctctggatgtcagagatagcttcaccacacactcaagaactcaagccagaaatttcaccagcatcataggaatagccgctgacagttattcccccactgatatgtgcttggcaacgttctgagttctctgtgggcacttactcattaattcttaccattcttgtcttgtccatttaaaaaatatctcccatagtgctttacatgtagcatacatacactttataagtctacattgcttggttcattcagtagaccataagctccttgagggaagggatgggtcttattcatcatcttgttgccaggatgaaactatgtcacttgtacctcatattacatttgcagtaaaatgttagagagatgagaccatatgtgagcagttggaattaagtcagtcaagttgaagtggggtctaacatcaaattgccttgaaaagcaggcagaacttaaaacatgatataataggcatctcagagctagtgcaaaatcctaagcaagagcataaagctaatgttgggagcaggccccccaaaatctggccataaactggccccaaaactggccataaacaaaatctctgcagcactgtaacatgttcataatggccctaacacccaagctggaaggttgtgggtttagggaatgagggcaaggaacacctggcctgcccagggtggaaaatcacttaaaggcattcttaagccatgaacaatagcatgagcaatctgtgccttaaggacatactcctgctgcagttaactagcccaacctattcctttaattcggcccataagagatacttttagttaatttagtatctatagaaacaatgctaatgactggtttgctgttaataaatatgtggataaatctctgtttggggctctcagctctgaaggctgtgagacccctgatttcccacttcacacctctatatttctgtgtgtgtgtctttaattcctctagcactgctgggttagggtctccctgaccaagctggtcttggcaagctaaaatcattttatagagccaaatcagtaagtccccagtttagcttagaaacaatcagacaaggaccaaaggctttctaggaggtatgattctttgaagagacaagggagattgaaattgagtccataaaattctcttccatcttcctgattctaggtgttgaggtatctgtcctttgttcttggtgatttactatatctgattgcaacttagaattcaaacattaggctctgccttcttttccatccggattctaaaatcaatatctttactatgacgcttattcccaggattaatttatgaaattgtatgatgtgctttgaagactgaaggcttcttagagagagagggaatgtcaccttgtactatcaaaccagtatattaaacagttactgctttaaaaatcagatgtttgttggttgagatgctattaaatcttaacctacaaaaccagcacatgatcatttcaatggtacaaaggcaaactaaatatagcagatgacaattgctacaacataagagaaaaaatgtaatgtaatattttaaccatttagttatatgccacatgaaaataaattcttataaagaataagttttagcacttgccccatttgtgtgatagggtacctaccatgtgccaagggctgtgcaatactgtgatgaacaaaagaatccctacgtgatggagccatcaatctagtggacaggatggatatttaataattatgaataattactacataatcacaggacagaataaaatgaaggatttccaagagcaatgtgaacatagaaccaaatatggagcatatctgaggaaacaagaggctgtccagaggagaccatattccagctgagattttaagggcaaatgagagctgacgagcagcacagaaggggaaagaatcttccagcatttgatcggcatgatacataaaaggagagtagcagggcatgggctgggaacctggaggcctgttcaagactgttcagccttgacaaggtaaagggcaagaggtgatatatttgtttgagctgaatctctcagcattttgcatctcaagtctcctagttttaaacaactttctagagaggaggctgctctttatagaactgagtatatggaagacagccttgagaaccttaaattcaatgcactgtgtagaatataaccatgattctaaacgatacttgttaaaaggcttttttttttttttcaaatggccatggctttgttaaaaaaaaaaaaaaaaaaaaaaaaaaaaacaagataatttggtaactgagtagagacaggacaggtttttctactgaagtctttggtttatggatacacctatagtgttggaaggaagcatttgtattttaaggtatctttcctaggtttgttgctaagttcatggacagcatacccccatgaagatgacaacacagttcttctaagacattatttatttatgtatttattttttaggcagagtcttgctgaagtgccataggagtgatcacggttcactgcagcctcagcctccttggatcaagtgattctcctgtcgcagcctctcaagtatctgagaccacaggtgtgtaccaccacacttggctaaattttttttcttttttttttggagagacaggggtcttgctttgttgctcagtctggtcctgaactcctggcctcaagtgatcctcccacctcagcctctgaaagtcttttaagatatcatattacggaaactttaattaagctcttgctacatataagacactttgcttaggattcaatgtatatctttcatttaaccttcacaacaactctaggaggtaggcacaattattattctgcttatcaacgttgtcaactgaagttagaaaggttagtaaatctttgaagttcacacagcaagtcagcagtgaggctgttaatccctccccactgttaaccaggaaaactctacttctgttaaattctgatcattttttgctaaaggggttagcagtgcttttgactcttttatgtttccctttgatttaccatctaatggttattgctacagtgtttaataagcaatgcattatccctgggcagtggaagtaatatcattactcagagacggtaaacagaagtttgcatctgtgcactgcctggaggtggaagcatcaataaaagcctgaggtggaaggaagagatgaatgtgcaggcttgaatcagaggcaagggacgcaatttgatgtggggtaataagaaattctgcctaggctagcaaagaaacacaatcctttaccactcctagcctcaactgcactgttagatttctcctaacactgcttttctttgctccacagggtacaacagtcccagccccgcccatcacacccacaacccttatgtacgcccaagggtgcctggcatgcaagattctaagagcaatgggttgcaagtccctttgacaaagtttgcctggggaccaggaaatttaagtctacatccgaggaccaaagatatttaaattaaaaacttcctaccaaatccaacagcagctaagagagtggcgaatgcgatattacagaaattggtctgcagcctccaaatgccaaagtggcagcttgttatttatgataagataaggagcagctcgttactaaagatatccatgtcaaccccacgcattgagcagaacaaaggatcgttaatgattcctgggcttgtcatgttagaatggggtggcgatgataaaagagcatctatatatgctttccttgtgacatttcttatttttaaactccaatataaaaatatgtgttaattgttatgatttgtgtcacatgctatgctccagggctggacaggaaacagtgtccccattctagtatttttataataagcaataaacaaacaataaacaatgacaacaagaagagaaccactttccaggatcatatgattagttctgacatttgggaaattgcttcattgccagaagtcaattcccgcgattgcgagcatcttccacacataaaattaataatgtgcccagctcccctcctgccttcattttattatatgaaatttggacctcccacagcatgtaaagtcacatttttaaaataaaactttcttcctttataaaatatataaggaaatgtcttatagagttacacagacctttgaaaacatacatttttccattcctttgtttattcaggcaatacccgtttgagtacctactaagcgccaggtacttttctagagtgaatatgacaatgagggaaaacagacaattattaatattccaaatgaacaaaataagtttggtagtagtaagtgttgggaaaaaaataaagtaagtcaacgtgatagagagacaggtccttcctaatggggacgggggtggaggggcggtcagagagggactctctaggaaggtgacatttaagcaacaagttgaattacaagaaggaatcagccataaaaagatctggagaggagcattcctggcagaaggaatggcaaatgcaaaggcccagtgccggggacaagccgggcttgttcaagaacagatgaagttcaatgacccgagggcattgaggagggcccagtggatgcgggatgaggtcagggagtgggggcaggagcagatcaggtggggccttgcaggcctaatgaagacttagtattttatattaatgacaaggacagccaccgaaggttcaaatctcggaaatgatagattctatttgatattttaaaaattacagctgtctgggcgtcatgggggaagaaaatggacaaaattgtgttccactcaaagatagcatttcccttacagatcccaaggccctgtctttgtcagtacgggtagtgattaagaacatagtgctagtcagaaaacctaggtttgaatccttgctctgccatcaatatgccatgtgatcttagggactccatcaaacttactaaagtcttcacgtgaaaactataataataactcttcccagagtcttggtgaaaattaaatgagatataacacataatacagagtagtgttagtgcctagtacttgatacatataataatagctgttgttgttattattattattattattaaaattaggaagaagaaagagaagcataaggtaaagcactcagcaactactctgatcattcaggtgagaatacagacttatgggagacaggatggaggtttccatcagcatagagcatctctgtgctccaggcccttggacaaatgtcacctctttaatgtcctgaagacattaggtagaatctagaccaaaacagaattctggaaaaactggaaataattcagatgctcaccaacaggaacatgaatcttgatatcatggatgcaactcacaaatatgttgattgaggaaagctagacaggagagactacatgctgtgtaattccatttagatgaagttcaagaacaggtgaaactaactgctgttggtagatatcaaagcagtggtaacattataagggaccgtatttggaaaacatttggaaagagcacaagggagcctgccagggtgctgaaaagtgctctataacttgatctagatggcagttacatgatggatatacatatgtaaaaatatcatcaaaccatatacttaaattagcatactttataaacttttactgatgtatgtgttataccttaatttaaaaaaatatgtatttcaggggatcagaaagtcagctacataaataaacaaatggtgactgctctcttcaggaaaacgatgacctcaggactacttaggagccagttaatttccaaagctacttcccgtttctaagttaaacagctctgcacataatgtcagccacagcaatggcaaagaaccgcagggcaggtgatgaaaaagctcggcttagcagcaggacaatggggaagtgtgttaaactgggaccatgaccaacttcccaaaaccctctctggtgattgccagtgcctgcttaatgccttacctttcaattgtgctgaatttgtctgcattaaatgaaagttcgagggggcaggatcacttcttttttgttttagaaatatagctcaagtacctgtgtgctctataaagaataaaaataataacaggaggccgtggaacaactgaagtatggaacatgtatttagaaagtactttctggcatttcaataaaggaaattcagagggcttccagcataagaacaggatccgaatggattcattttcctgatagagtgacccaacccacaatgcaaagtcattaagtcccatcgcgtggcattaaaaaatgcttttaagctaagatcagccgaaaatgtgcccagggcagatttttatggccatatcatcacaacctgaaattcaaattggtgaactagctagaaatacatgctcactagaatggttcagagtttttctgcatctatctcagtgaaaaatgttagcaaaggaaaccttattttcctggaaaaacactatcaaataataaaacaattcaggaccagttttcacaaagtaataacaggccatacataattgattgcctttagtcttcgtctctgggtattacaaatcacagttactagcgcatcgaacaagctttcattccggattcagactgtccgtcttggcactgcctgaaacggcttgagcacctttattgcacactttactgcattgttcttcagttgcttcttcagtgaagttctgctatacccaacaatgttataccctccttctttctgtgtgtttactgactgtccctgatggtaggcaaaaagtaacttctagaagggaactgatttagacttatgatctcacctcaggcttgcaaggcaatacacaccacccagggagataaaacatattcctatgaaatcatatcctaactctctccattaaaactctagaactgcactaaaagcaggaaagatatactaaaattataccaattctttggcttaccaaacatcaggcagctgcatccataaaaaaaaggaataaataattcattccaaaactcttttttgcacatctcaaggctcataacattggtttgtaggaggaggtctgaacgagggcctagaaattctgagttatgccttggctataacaggaacctgatccctctatcttactctccctttgtatgtacggctaatgatatacacctgggctgccagtgacagtagccatgagccacgtgcctattgagcacctgaaatgtgagtagtctgaaatgagatgtgctgtgagtataaaatacacacaggatttcagagatttactaccaaaagaagaatataaaatatgattctttaataatgttcaaatattaattacatgctgtacatgccgaaatgataatattttaaagatattgggttaaataaaatatactatttaaatttatgttacttcttccattgaacttttttaatgtggttattaaacatttttttaagttatgtatgtggctcacatgtatttcatttggatgacaatgatctagatattctgaattgctatgaaagctaagattctctccttgtggaaatgggtaattacaagcctaacagttacgcatgtcttaaaggatggagaacgtgggggaagaggaagcaatcaagtcaccaagtgtattacatatttagttatacttcaattttcctaagcacattacaaaaagaatggaaagaaggaagaaaaacatgcacagtccttcaccctcctgagacagaaatgagactgaaaatggactttgaaatcaaaccatttcagattagaattctgcctctaacctcagtttctccatttgtaaaatggaagataagcatactcaccttttagagaattaaataagatcatgccgatcaagtacttaaagcaacattgggcacggttgggaataaagatcttggcaccggagatgttgaacctggagcggaagggacattgagaccaaaatgtccattgggcaatgggaatctgagcctggagaccaataaaaagatggatagatgcaagtgtcctagcaagcaagccgcacaggtgagaaaacactaaaaccaggaagggagctggtgtcacataagcagctcacacttcatggaaacatcacagctgcagctgagctccagccagtcgttcccatgaaggaataataatggtacagtgttgccaggttttccaattttctaagagaatctagaaatccagctttttaaatgtttagaaattttaaaaaatttagtttaatttaaaaagcactcattattccagagagaacccacgggaaaatagtttaataccagccaggcgcggtggctcacgcctgtaatcccagcactttgggaggccgaggcgggcggatcacgaggtcaggagatcgagaccatcctggctaacacggtgaaaccctgtctctactaagaaatagaaaaaattagccgggcgtggtggcaggcgcctgagtcccagctactcgggaggctgaggcatgagaatggcgtgaacccgggaggcggagcttgcagtgagccgagatcgtgccactgcactccagcctgggggacagagcgagactctgtctcaaaataataataataataataatagtttaataactctgctgctgcctcaaaggtcaacaaggtaacttgttagatttctaccatatgaaagttaacggggatctcagatgaaattcccacaagcccccaaacagttgagctgccaaagatgaagagggagatttacctcttcctcctcccagctcttcatgctgtaggaacacagttgctgcgactacaggtgtcccagcggtctttccctctccccagaccgtgacctggatgttatgcagaatgtttcaaagagagctgcaaaagcacaaggactttttacaggagacacgtgacataaaccaaggtgctactccggctattatccattgcccgctttaggtctctctggaatattgtctgtttccatttcaggcactctcagctactacccattttggttaataaattatcatattgtgtaaatgtatacaatctgtaagcctggaagaactgtctggaaaaaggatttttaaaatatcacactaaaaaaataaatactagtggcctctctgtatctattgtaaggagtaaaaggatttacacctgaaaaattaaaattacagtagctactctttcctcaagtggttcttagcaaatgcattttaaagaggatgactttccagtgaacactttaattttaatttaaccttcccagaaaatgaagtgctttgtgtagattcttttggttttatttaaggcataaaaattagttctgaactgtgataattgtgggcttaggaatgtaatcattccaagcaccacttctcacttgcttataagccctacaggtcttgagttgctgtttattgctaattcgaagttggcaagttatttaactgtgaagctgaacttgaagtcagagtgtgacgagatggtgggaggtagattgttttgttttgctttcaacaggttatccaaagcccggatgcaaaatgcggtgcaagacacggttctagatatgtgctcctctaactcttaatcttaattaaaatgggatgatgaaatgttctaaaggtggaataaaatattacattaatctataactctatcttgtcaaaccaaccacagataggatacaggttcctatcatccacccttatgattttgttcttaattgtggcattttgttgttgctgtgaggactcaacctaaatactattgcttctatttgattgtttaaaggaaaataatgtaacaagctttggtcatgaaaaatcgtaatgtccataatacagtagatgcagcatttctaaacattttagaattacgtgtttgaatccacgaccacatactcacatacatataatcaacattaaccaaagggtcatatggcgatttttttcctttataataaagagatcctctgaaacattttaagataaatgaattcctgcttaagtatgggtgcatttgaagtgagaatgctttgaataaagttatcattttcacacaccactatgcctgaaagttatgagcattcagacagaaatcattgaagaaaacttaataaaaatatgtttggcatatgccgtatttagtgtgatcaatagtgtttagtaattcaagaaatgaattaaaatttcaccctcattttgccactcctaaatttccatttgaaaaacaataagagaaattattaactccctgaatatttctaatgggcttctcagcattattgagtaaaactaactccacattgcaggcctgtgtgctgactcaggtttccaaggtttctctgggaactctttggtctgttgttgctgttctttattctttattgaaaggcatttcctagtgcatttcctaattttaggcacctggctagactttggggatgaaacaatacatgtggcagaatccctgcccttgggtgccttaccctctccttcatacagcatctaatggatccaaaaccagggagaaggtgcacctcacagccacaggctgcaacagagaaaggtaaagtgctggtactacctggtttgtgtttgtctgtctgtctctttcttttcttctttttagtaggtgtcaatattttacataaagatctaaatttctgacttctcttaaaaaaaaaatcagaagatcttagcatactggaccagaaagactacttggcaacatctggctgaagctgtggggtgggagtgttgaggggggtgtggatggtgcacttttcctagtcatctctggatcaaaactggctctagtttgccagtgttcccaccactccctatagttttatactcactcatatccattacctgctttgtcctcgtattacagtatttacattactgacctgcaagaagtaactagcagtcagaaagcctgatactagcccttggtctgctgcttattaaatatatgacctagcatgaattcgtgaattgcataatgccttggagcctcagttttctcttaaaaaagattaaagacaaaacaaaacaaaacacgccttctctggcactgcaattgcaaatctccaaaaagaaatctatggaggggtttccaaacctggaaagcattaggccaaggaataatattattgtaattttgttttcagaagaaatatctagaaaatcagaaataacagcctatatctgattatacctataaagatcacaaagcactctcaactgaattaaatctcatgtgacctctgagataaatatcactttagccattttgatgatgaagaaactcaggctgaaaaggaccaagggatttgccccaacaccaaatgctgacatttttaaaaagtcaactttcaagatagttcccataattttaacacctatgaagacactattaacaactgacatcacatgatgaaacaataaccagtaagatgagccatcactttccaaggatatactctggatagagagtagcagcttctttgagctttcgtttgtttgcttgttattcaagagcaacattttttaaagggtattacatgttgtaatataaaggaaatattttaagtaaatatttgtaataggtactcatttggacttctaataaactagtagggttaaagcttttgaggacgcactttctcattaaatgtttgtcaacattacattattttcttagagattgtcatcagcaagtaacttctatgagaaacaaatgtccttaattttattaaagtctacttttattaatcccctccctacccctaattgagctaatttgaaccatagtgccattcagaaagaaatatgagaattcatctggctcattgtcacatacattttttccacaaagaacctaatagagttaaaagcttgatttaaacatgaattaaaggtttatcatttacctttaggaacaaactctccataggaatagtaagctcttttaatgcatttacattttattaggcttacagacattcaatttattggtgtctttaggtacacatttactgcatacagtcaaatatataacaccttcatagtaactttttttaaaaagagaaggtagacttatttaagttttttcatggttcaccataattcaggtagcgaagtctaaatgaacaagcagagggcagatgagtgactttaagtgcacaggagatctccacatagtaatttagagacaccgtgggaaataaataaggagatacgtgaaagagtaaccagctcttggcaggacatgtatatgactgagtaacatgcaaactactgtttatacattgcaatcagctggcagccaagcaaaaagcttatagatgagtaaggacactgccacagccatgtttttgttctgaacctcctgattaaacaaataaactcagactagagagccacatggagaatacaatgctagggatacaatacaatagaatacaatacacttagcatgcagggtctaaatattaacagcaactgcagaagatatcactgcagatttgagtaaactttctgaaacaataatctacaaaaccagctgtgtttggtgatggctcttcataaaaacaaacagttgcaagaaatctaacaggattccaagctacagttcttagcttatagatttcaaacactggagagaaatgcataacatcccagctttttattctccaaagtgaagattttgaaagcaaataggattactatctagtatggtcatcataacattttttaaaaagacattattattctggaataggaagtatatgatctccttacaatgaacaattccatgtagaaaaagatagaatatctgcaaagcacttttgaggtaggttaaggtcctgggaaacagattcctcatgcatttagcttgaagaaaggtttaaaaggaattctttagggatcaacacctgcagaaggaaagggaaatagaggaggaagcaggtgagctgaaggagaagtcccaatggtagcttgtggggaataatgaagatggggtgccttagcgcattctggcagttgtaaaaaatatcataaacaacagaaatttatttatgatagttctggagactgggaagcccatcaaggtaccatcagatttgatgtctggtgagggcccacttctggttcacagatgatggcttctgtctgtcctcacacagtggagggactagcaagctccctggggcctcttttgtataggcactaatcccatccatgagggtggaaccatcacaacttaatcacctcccaaaggccccactttgagggttaggatttcaacatagaaatgttgggggtacacaaacattgagaccatagcatggaatgtcctgagtgagggtgagaagggaggggcctttttaccctccagtgatcagtcactggaagcaggccacctcatgaaggaggtatgcctttgggagagggttgtctatgggcagcaccacagcaagtagggtgataagcccttagctcctaaaggaggacctgagcagtgcattacagagtccatgcgacacttctgttccaggctagataaaatatttttaagctctggctgtaaggacagtcacctttaagcttttaatcttagacaaccatcataatacaagggctatttgagacacaatggtaagacattaaaaggtcaaagcatataatgctcttactgtccatcagataacatctccaggaaaatcagtcctgctgctctttgataccaaatggcttcttaggtatcagatctgctggcttgttctgaaaaaaggtagagtgaactcatttttctctactccttccctctaaataccctggaagttattcaacgggaagtgataaagaactctaaaacctggaaaaaaaaggagatagaaactgactaggggccttagcacttgagggacaacaacctggtgagttccgtggggtttcctttttatttccaatataccctatgccgggttccagagacggctgcaaccccaaaacagcaacagggagagcctgctccctctggtcaaatgaccagtaaagaagtccagtagagacctagtggggaagccccagccccagcccctactctaccactagggcagcgatgggcagtgaggccctaggccatcccaaccatatatctgacaaagaattactatctacagtatataaataattctcaaagctcaacagaaaaaaaaaacaataaacagttagaaaatgggcagaaaatatgaagagacagctcaccaaagagcatatacaggtagtaagcacacaaaaaaatattcgacatcattagccataagagaaatgcaatttaaaaccacaaaaatattgttacatatctatcagaatggctaaaataaaaaagcagtgataacatcaaatgctggtgaggatgcagagacactagatcactcagacattgctgatgggaatgtaaaatggtacagctattctagaaaatagttcagctgttcattttaaaacaaaaaataaatttgctatattacccagaagtggcactctcgggcacttgtcacagagaaacgaaaactcatattcacacagaaatttaaacatgaatgttcgtagcagctttatttgtaatacccaagaaatgaaaattatccaaatatccttcaatggataatggtcaaacaaactgtgatataacataacacggaatatttcttagcaatacaaaggaatgaactattgatacacacctggatgaatatcaaggaaattatgctaagtaaaaattaaagccaatctcaagaagatacatactatatgattactttaatatagcattcatgaaatatgataatcatagagatcaagaatagagtagtggtggctagttgttcagaatggggtagggaataggtgttgactctacaggggtagcatgagggagtctctgatgatgggacagtgaagtatcttgatagtggttgtggtttcatgaagctacacttatgataaaattgcgtagagctacacatgcacacatatacacacacaaatgagtacctgcataactggtcaatctaaataagctctatggatatgcattgtactaatgccaatttcttggtttttatattgtcctctagttaggcaagatattaacattggggaaaactggaaaaagggtacacaggccctccctctacatttctttgtttgtttctgtgtatctactgttatttcaaattttaaaatttactttaattgacaaataatacttgtatatatttagggggtgcaatgtgatgttttgatatatgcatacaatgtagaatgattaaatcaaggtaattaacatatctatcatctcataatttatttgtggtgagacatttgaaatttatactcagcaattttaaaatatgtgatacatttttatttactatagtcacaatgctgtgcaatagatctcaaaaacttattcctcctgactaactgcaaatttgtaccctggtttttgcttttatttttgagacaaggtcttgctctgtcacacaagctggagtgcagtggcccaagcacagtttactgcagcccaatctcctgggttcaagcagttctcccacctcagcctcccgagtagctgggactacacgcatgtgccaacatgccaggccagtcttttactttttgtagagacaggttctcactatgttgccctagctggtttcaaactcctgggctcaagtgatcctcccacctcggcctcccaaagtgctgtgagccacaggcatgagccacaggcattagccactgcacctggccactttataccctttgatcaacatctccccattccctctccctatcccccagcctctagtgaccaccattccactcactacttctatgacaaaaattaaagtttgtttcttttttttttaattaggcccgttgattgctcagggtaagaaatcgtaataaaattctaggtatttcttcctttgcaatgtgccagcatctgcatctatcactggaaagtggattgcaaacccatctcagatgcccacacctccattaacctctcctactcccggcccaatttcctgctccataccccttctgatagttgcttgcctggaatcccttcaatggcttagcaaactctatggcagttcctgggttgcacttcaacactttcttgaccctggcccacctctgttgtaatccctttctcaaggtctggtgcaattaagaatgctgctgaaagggtttttgttgtagttcgtgcctatcaaacacagactattctgattacttgtggcattttgcagtgatataaaattaaaactaaagcacaggagaagaatcttaggtttttatataaataatttattgtctataaattctcccaagaggaatctatgtcagtctacagaaagtgtctctccattgagacccataccatttgcctgtaaattcagcacactgatagccatttgcaatctgcaaaagaaaagccatctatctaaaggggcacgccacactgttattcctttgtaatattaagaaatttatcctaatttaaaagataactgaattcttattcttttacaaattagactttaaaacacagccactgaattgaccaagcactaccaagcttttatcctacttttatttaaatgtactgaaacattagtgatgaaagctttcatttaaagaattctgatgattctaatattcacttataatgtccatttagctaccacattgtgtttatgccccttaaaagctgaagctatgactgctctagtactgagttctccagtgcttatcattaattaaaaggtaaaacacgattaccagggtatctgcaatcaagctttcaatgtaagaaatatcaatatccagtacttgagaacattttggaaccaattttaataggtaaaaaagtccaaagagaagaaaaaatgttctttattatttcaaattaaaaccagatcagtatatcttactgaaaagttgcaattgcccatgccttccaggcatctgcctagtttttctcttatagcagatgctaaagaagagaaatctggcatgtccatttctgtaatatttacagatataacacatcagcaatacatcagtttggttttttatggaagctaacctcaagaagcaaaacatgctctgtgagtgtacttgtgtacttacttcagatcatccttatgcttgggggtgggcagacagattattaaataatgactgtactgagtgtctactaagcacagtggtgtacttgtgttgagggcaccgagacgaatagaagaatccctaccctaaaggagtgcaaaatctagtatcggagccacatgaatattgtgcaagtgaaagaaggtgagcacagattatgtccatggtgaaacaaaagttctgaatatctgttgagactgataaaaatagatcctgctaatgttaatggcaaaaatggcctgagtgtctttagctccccaatcaactctaccagtatccacccaagccaccccaaataaagtgtttgcccagtgtacatatgcagtttcaaaaaagttgcccggtttctcctcttctgtattggtaggaattgagcaggacacagatggcccactgaaattagaataatttgaggaaggtttaataaagggactatttataaaactttgggtagtatgtaggaaaaccataagggacattcaacactctggaactgttatcatcacacgacataaagggagaaggggaaggagcactgaccagaacttggaaagagaaagtctggtggagaggtcaacctcgagaagagctatctgctttgatagaggaacatagccagctcaaagggaccccacagggagtgatccaaggcaactaataccttgacctcactctccttccattttccagtctcctgcttgggtccccccattggccagaaggcaaaaaaacccactgatgaagcatacaggtcagcaggtggaaaaggatagcatccctgattcctggtattaagaaaatcaatcagccgccaaccgcagagaactgctgtgaaaattaaatgatgtaaagcacattatgcactcaaacatacctcaaacatagtaagtaaatgagaaatgtaagttgttaaatatataatatgggatatttttcattatacaattcaatatagcaattatctatgcctcccaccattttctccccacatgagaggtacagcagagagggagaagaaccaatgtttcctgggtggctagtatgattgcagcagagtgctaagcatttgctatatatcccatcttatttcattctccctagaaagaatgtgataggaattattaagctcttaggaaaggtgagtaaatgaagctcagatatgttgcctataattattgcttataattaggatctcagatctgtcaaattcctaagctaatgacttctccattattttatgtagatgggctacctgtccatattagataattttatttttatcacgttgaggggaattagagaaaaacttgctaaaagctaagcatctaacttagggcttgccacagaagagatagtcagtaactgctatatatgatgatgaggaggagcaggatgataatgattgtgatggtgatggtgatggtactggtgatggtgatggtgatggtgacaatgataattatggcagcggtgacaaatgatggtggtaatagtgatgataagaaccaccctactttaacctaggagcaaagaacttctgcaacagacacgaagaattccttaaataaggtttcagtatatagttgaagtagtggaactgataaatatttgttaatcctggtccctcaatccaagaagaagctttttcagagcaggctgtgtggtgcatggctgggccactatgaatttcggtttccctgtgtgtgaaacgcaataattatatatgtggtgcctagagctgatgtgaagaatgaaaggaatgcatttagaacacttggaacagcctggagcacagcgaacactaggtcaagatagccacttactgtcggggaggttagttccaacatggctgggctctcagcaagtcttcttttgaggaaaggacccagaagtggaaatggcccctctccttactagctgtgtcctcacccactccactcatctacacagtttagaatctgagggtgaaagaaggaagagcaggcaagggaaggcagcagtggaaaacagctcttgggtggtaagtagggagcaggaagagcagttaccaccatgcttaaaacaaggtttttaaaaaaaaaaaattgcctgaagtcacatttgaaaataaagagcttggtaaacatgctgatggcaaagagaacttgtaaaacagtttcacttgaaaaaggccaaggttaatggtataatttcaattttgaaccttcttttaatatggattagtgctctcaaatatgggatttgacattaagatgccaaaagaagactcagaaggtaacctcaagcagtattttttaaggaaatttcttccttttatcatttgaacgcagctgaacaaaaacgttattaaaaattattctgtcataaaaacagcaacatcaatgaccataacaaatgctaaaaagcaaaattatccatgaaattaaaaatatttcacgaatccaaggtgagaaatattttagggatgacacttggcacttgagatttatgtaatgagacattaccaacttttatgtataaaatttcctttctgaaaaaaaagtatgaaaaatcaaaagaaggcaccaaaaaagtcccccactgatttggaaaacatattcttttttttttttttttacaattaactgcatttggagaactgcatcacacttttaaataaaatatacataacacattttctctttatagaaaaacctttacaaacccttaagtttgctgaattactgctgaaaaagtatttttgaaataaaatatacagaatgaataaagcatctttactccattcttcggaaattatctagatacaaatatatacatggctaagttcaaaaacttacatagtagaaagtttaataatttgatctataatattaagctgttgatactttcgattggaaagaaggaggggaaatagtgaaagaaaaattaaccacagaatatattctttgcagtttgagatataaaatgttttatcatttacattaatgtgcataacattttaatattaattgttgcctctttcatcttgctgtcttattttttaaaagcttatcatagaaaagtctctatatgaaattgttcatccaaacagataaaaagttggaattataactgggccaatgaaatgttgttgttttgtattttattgctttgcttcttctttagtaatcatctttgcagtctgtctaaacaattctctgtgcactgacatttgcaataatgtgtttacatcacaaagttagaccctgtcattcgatggaacaagaggctgtattttgtagcccccagacactctgcataacttactccctctttggcctgagagtgtaatcgttttttcatctgccatgtttaattacctttacaggcattaacaacagtttactagaaatcgatggaggagcaataaattcattaggttcagtggaggtaagaagtttcatattctttttctcaggtgaatacctatttgagaactactaacttcatcttccataaacctaaaaaatataatatatgattttcatctgtctaccagttcttaa

SEQ ID NO: 2494 - DNA, 15147 bp, Homo sapiens
ggtgaagccacttcagcccactgtgacttcctaaagcagtatttgaaaggacccaaatataaagcaaggtcgtctcttctgagggataataaattcagggggaagcaaacctcacctttgtatttgaggatatctggtgtattttagtgcaattctgcctttaagataaagtgccagctgacttaatggcagttgtgatctctgcttcatttcatcttttatctaatgatccgctagttagtaaacctgcaaatcctgaaagaaacataagtactctttttctttgcagtgtaatcaccaacaataaagctttatttttttgcattaacattcaactgcaatgtatttaaatgttccacatacacaaaaacacctgatttttcccaagatttgttaaacatagtccctttggtgtccttagtaacactgcaaagatgtcttcatgtaaaacttaatttgagtcctgattaccttactgtgaaaaaccgtaaacaccaaacaaaagtaagcataatatccaaatgcctaaaacataatacccaggttgaaggaagtgtaaatgttcagattcaccagtgggactagaatgtaaacttcttgggttgtggttcctccaaatcatctggccacctgggtatcatatcccacaagcatatggtaacactgatagagtaagctcaaagtgttccaacaccaggacatttcatggccacatcagaccaattgtatttttcacttcctctctttccctaacttttctcatacaaagcttcctacatttcctttggcacttagtaatacttaaatgcatcttcactgtcttattcagtgtttttagctttggaaggtgtatcacttgggattgctttcagatgcattaattgcaatctagctaaccaacagcccaacagtgatttaaacacagaaagctttcttttccggatatgcatgtgtgcatattttgttttgtttttcatgcaacaagatgtctgaaggtataatctgacactgagctggtatctcatggtgtcatgaatgccccagcctacttctattttttttttttttttcctctgctgtccttcagtgaggctttcactttcattgtcatagacggctgctggatctccaagtttgacacattctccctaggcaagaagagggggaaaggcaaaggggaaagaggatgccagccaagtcagtctctttctaaaagctttccagaaagttccatccagtgacttccacatacatctgcccagccacaaatgggtcatacagtctttcctaactgtaagagagtgtgggaagctggatatgagctgagcattgctgctccaaacaaaatcagatttctgttaggaaagaatggatgtaaagtggatcttaggaagggaacaaccaatgcctaccatacacaagtatttgtggtgagcagacatggctaagtgcctcttcctatctagggaggttcagggaattactcaagatctcttttgtgccagggaactagggagtcagtcatctcatttgctttcatttcctcatctctgaaatttcctactatggtattcctcttagaacaccatttagaagtgttatggttttctgttcttaatccaaatgtgacaaaatgtattctccttcttctctgataacaaaacccaaattctgacgggcagcatgtgcttagccttagataatgaataatgactggtctaacccaatcatggcgatactatgttcttttgccattgattggtattcagtagtaggcatgtgacctagatctaaccaatgagtggacatacactggggggactcatgaaagatttttcacctttggtaaaaagtcatagttgcaagaggagaaagccttttcttcatatgcctcttctttcctgttttagatgctgtcatgttaacgctttgtgcttagagctgtagaagccgtcttgtgaccatgaggcaatagccaaaagaggaaagagcctgagtatgaaagacactgggtcctttatgatattactgagttgccaaactaaccctgggatcctctacctcctgttttctcatagtaataaatatccctgtgatttcagcactatcactttaattttctgttacaggcagctgaaagcattcagaactcacatactatcttaacatcatcttccatgtgttatgggccaagagtatattcaagagtgactacaaaactacattcattgtcgtatccctgtgggactcccttaaagttctagtgttctgtagtgtactttccacagcctagaaggatatatgtttccctctctccagccctaaggaactcttaatttaagactgacaagatgaatgagttacaatgagggtgaatccaattcaaaagacgtaacaacaagcaagaaaagcaaagaaccttgtaaacacccatgttatggagtgtgagagtgtaagcttaaggaggcttttattttggggagaagatgcatcacctctgtttgaatgagagaaattaagttgtaattatgatggtgtttcagttaaattatttgatgtggaagacaaggagaccattcccaacatgttatttagcaaagaatatggaggagaggcagaagactgtgatggaaaacgttcagaggccatcaaccaaaatggtaatgcattcgaggcagataaagttgcttcttgctagacagaggtggggtgagccctgacatacgtcttcaaaattgcaaaaggcacagatctgggggggaaagggggttgattcaccaaatctcagaatagcagaatggcaataaccctactccaaggcttccagttttcctcagtttaactccttttgcatactgcagccaaagagattttttttaaaatgaagatcactcagactgtgtcctcttcctcttaatctccccaaaggaagaaaaaaacaatgatcaatggcaaatggcagttgcaatgaagcaacaccaagaacgagcttcgtgctcgggagagaacattgcatatcttcctgtggtttccagtgctctacacacttggggaaactcctttaagtaatgaaccacagaaatgacccctggaaatataatcttcaaagtgatcttttaaagatccaaatatttcctgttcccactctgcccagagatcttcagtggctcactactgcttccatgataagatcctaaaaccttgtcacaatccacaaggccttcattgtccatccctgcctgcctcactgtctttatctcccaccacactctgccttctctatgctcccacctgacaacttcttcagtgcgtggaccctattgtactctctcaggcctcaaaaccatgtaacatcctggacttcctcttcactggtctaatgcctactcatacttggcttctgagattgtacttcactccacatggagattatccacaaccatgccccactccaaaaccaggttaccttcccaatgtgatatacttgccatagcactcagcttccttttttataatactcatcacacttgtgattgattgactctcttctcctttacattgtaagatccataaaggcaaggatcatgtctgtctctttctgatgtgtaacaagcctgaacatacatacaataaatggccaggtgtaatttaccattgtgtggatgccatcttgggaggggggattctaatagttcaagggcatgtatgaaaaacagactcatggtaaaataataagaatagaaaaaagttactcagagtggtttaatggctggggtataccttttactattttacttagacatcaaaggaaaatcagtgtcctccctatcatgttccatgattttgtacaactgagtttagagcacaagctaaggtatcagacagcatttgacagcccagcttcactacttatcagctgtgtgaggtgatataatccctctaatccctataaaccttagtttcctcatctttaaaatggggataatgacaaaagcttttcaataagggtttgtgaggattaaattagataatacatggaaagctttcatcccagtgcttgccacagagttagcatgcaataaatgttataaagagttctttattgttctgcccatcaacatctgagacagaatataaacacaactgctcctgggcctggtggctcatgcctgtaatcccaactttgggatgccaaagtgggaggatcacttcaggccaggagttcaagaccagcctgggcaacaaagcaagactccatctctacaaaaaatgaaaaaataggtggatatggtgatgtatgcctgtagttctagttacttgggaggctgaggcaggaggatcaactgagcccaggagttcaaggctgcagtgagccataatcatgcctctacactccagcctgggctttttaagattccatctcttaaaaggaaaaataaatcaactggatcactagcctataagagcttaacaattgttaggtagtattactatgggtgttattgttttgttatttgtggcaaaaagtactagtgctcacctgagcacatgacttccttatgatcaggtaggtccatgtttgtcttggtcactactccagcccagtgcctagcacagtgcttgacacatggtgtgtatgcaatgaacacttaatgagtacttaaagatctaaccagtatgatagtgcagattctcttgtaagcaaatgaatagagaaaggcagtattccacagagaaggagacaggaaaaaagaacaggcttgattttactaaaaagaaaaacacacttttaagcagtaaaattagaagttcccatttcaatggcacaaaatagagaactcactgagaattgtgtgctataacatggtcaaagcagaggccgataatgaagggagcagcattcagaaccatcacatgtatggtcagctttcagaccctgaaaactcgattaaaacattccaggaaaccgctgcactttcattctaaaggaagattgtgaactctgttcacatattacaccccttcatattgctttgtctaccagtgtggccttttatgaagtgagggcttctttcttctaccttgctccatgacaatcaaacccaaaatgccttccacccttaaaaggaagttttggtaagtgccttattataactatcacatatgacacaaggctcaccactaatcggagacagatgagaatgaattacttaaataggacagaaatagccattcacttcaagaaggtcccagtttcttgaaagtctgtggcattgagaccatttacagtttgctgtcaagattcctagcagtgctcattaccttggctagcaatccctctggactacagaaaacttatctgaaatatatataatcacaggctgcaatgcctaagtgcaacaggatgatttaaaaagcaccatgatagtgttcccccaggacattcatctctccctgtctattcatctttgatccagacaaaaacttggaatgcaatctgtatattgatattccctaaaaaggatttcaccagctctttaggaagaattgttttagcggctctggaagtctagaacattctgcatttgtggtatttacagcttttgtttctatttcataaaaataaagccccactaagagcagtattcaattcctatcccaataggagtatcgaatagtggttaagcacatgttttttggaacgaagcagacctgtgttcatctctgggctcctcatagacctcttcataaacttaggcaaggtattcaacctttttgagtctcagctatatcaggtaaattactatgcgtgcacagaagagcttaataaatgttagatgttaatggtattaatattgttttgctgctgttttcagtttttctagcagagattattagtattcacccatgtgcacaggtagaccgcatttccacccatgcacacaggtagaccgcatttccaagcttcagtggagttacgtgggtccaaatgactgagttccgatcaatggaatgtggcagaagtgatgtacaccctttcctggatgggcctacagaaatcctctagactctactcctcactctccttttcccttctcaggcaccctgaaggctacttgttaaagaatttagagctacaggatggaaagaacctggatcctacctaagaacctcctaggagagccacccttcagaaacatttgcagtggattctgaatacgatttttttttttttttttttttttttttttttttttttttgccgagcacggtggctcatgcctgtaatcccagccctttgggaagctgaggtgggtggatcacttgaggtcaggagctcaagaccagcctggccaacatggtgaaaccctgtctctactaaaactacaaaaattagccaggtgtggtggcacgtgcctgtaatcccagctactggggagactgaggtaggagaattgcttgaacctgggaggcggaggttccagtgagccgagattgtgccattgcactccagcctggtgaagaagtgggactacatctcaaaaaaacaaaaagatacatatatatgatatatctgatatatgatatatatatgatatatctgatatatgatatataaatgatatatctgatatatatacatatggtatatatgatatacatcatatgtatatatggtatacatgagatacatcatatgtatatatggtatacatgagatacatcatatgtatatatggtatacatgagatacatcatatgtatacatgagatacatcatatgtatacatgagatacatcatatgtatacatgagatacatcatatgtatacatgagatacatcatatgtatacatgacatacatcatatgtatacatgacatacatcatatgtatatatgacatacatcatatgtatatatgatacatatatatcatgtatatatgatacatatgtacatatatatgtatatatgatacatatgtatcatatatatcaggtatatatgatacatatgtatcatatatatcaggtatatatgatacatatgtatcatatatcaggtatatatgatacatatgtatcatatatcaggtatatatgatacatatgtacatatatatcaggtatatatgatacatatgtacatatatcaggtatatatgtacatatgtacatatatatcaggtatatatgtacatatgtacatatatatcaggtatatatgtacatatgttcatatatatcaggtatatatgatacatatgtatcatatatcaggtatatatgatacatatgtacatatatatcaggtatatatgatacatatgtacatatatcaggtatatatgaacatatgtacatatatatcatgtatatatgaacatatatacgtatatatcatgtatatatgatacatatatacgtatatatcatgtatatatgatacatatatacgtatatatcatgtatatatgatacatatatacgtatatatccatatatatgatacatatatacgtatatcatgtatatatgacgtacgtcatatatatcatgtgtatatatgatgtacgtcatatatatcagatatcatatatacacatatatcctatatgtgtatatatgatatatgtatatatgatctatatacatatatatcatatgttctatgatatatatgatatatatcatatatgatatatatgatatatatgatatatatgatatatcatatcatatatgatacatatgatatatcatatcatatatctttcttttttttttcagttaagctactgggttttgacgaagctcattacagcagttagcctacttcagggtttctcagcctgggcactactgatattttggactacagaattctttgttatggagggctgtcctatgcattgtagggtgttgagcagcatccctggcctctatcctgctagatgccagtagtaacctctccagtagccatgacaaccaaaaatgtctcctgacattgccaaatgtcacctgcaaaatcgcctccgattgagaaccagcagcccacactggccaaaacatcaccatcattgctatcatcatcatcataggatattgatagtctagtctctcatgttccccttgaaatcactgcaaaaggactcaaagttccaaaagaggtccagcccagtttttttaggagaaaaaagtgaaatgacactaaaatttaagaaaaggtaagggatcaagcagtaaactcaaagttataggagaccaaaaaacaaagtaagaaccaaaataaatataatccttttttaaaaaagctagtttgtgtagtcccagctactagggaggctgaggcaggagaatggcgtgaacccgtgaggtggagcttgcagtgagctgagatcgcgccactgcactgggcaacagaccaagactcggtctcaaaaaaaaaaaaaaaaaggccggtttgatcactttggtaacctagaataaaatgattaaaacaaaaacaaacccaaatatctgggtctaggaatttcaatgtgtctaacaaatgcttatagaatatctaccatgagataagcattgggctgaatataacttggtaaataaaacagatataatccctgccctcatagagatgaaaggtaaataaaaatatggagttttttgtttttgtttttgtttttgttttttaagacagtgtcttgttctattgcccaggctggagtgcggcagtgagatcatagttcactgcagccttgaactcctgggctcaagtgatcatccgtactagctaggactataggtttgcaccaccatgcccagctaatttttgtattttttttatagagacgcggtctcactttgttgcccaggctggtctcaaactcctggcctcaaggaattctcttgcctaggcctcccaaagtgcttgggattacagtcatgggccattgcacccagccaaaatatgatggatttttcaaacagcttaaacacagtcatgaattgaccactgcaataggcagacttctaaagatgtccctgcaggattcccatccctgggccgggcatggtggctcacgcctgtaataccagcactttgggaggctgaggcaggtgggtcacttgaggtcagaagttgaagaccagcctggccaatatggtgaaaccccctgtctctactaaaaatacaaaacttagccaggcatggtggtgagtgcctgtaatcccagctacttgggaggctaaggcagcagaattgcttgaacccgggaggcagaggttgcagtgagccaagactgcaccattgcactccagcttgggcgacagagtgaaactccctctcaaaaaaaaaaaaaaaaagattcctgtccctggttatccaattaaacactagattaggtgctgccatgaagagacttagcagatgtatcaaggttactagtcaaccgactttaacataggaaggttatcttgaattatctgggtatgcctaccctagtcacatgaggttgtaaaaacataagtggaaggtggaagaatcagtcagagtgagaaagcagaagaggatgcaggagctatgctgcagagggaaagtcagattccaaacacaagaaagaaaaagataagatgaatcattgatggttctaaaatgtaggaggctctgtgtgaggaccagaaagaggcctgagggagctaagggtggagccctgcctaacagacataaagaaaatagggacttcagtcctacaaccacaaagaaccaaattctgtcaataacctgaacgagtttggaagttggtttttctgcagtctccagtaagaaacacagcgctgctgatacctcgattttagcccagtgagacatgtattgggcttctgactgccagataataaatgtgtgttgttttaagtcactaaattcatcatagtttgttatgacagtaatagaagactaataaaccattatgcattaaatatcacagaaaagaaagggtttaagaaaataggtattaaagtatgccttatcaccttatcattcatcaatctgaggtttactaaacacttgatgggtgctcattagtggaataaattaatgcactcatattttcattcatttgttaaaaatatgcatacagtgcctcctctttgatggtccctgggtgaggtattgaggttacagtagtgaaataggtattatcctctgtttataacagctcataatggaagtggaggacagaaacatgtacattcaacaataatgcaaagaacataataaagatattaacatcatcattataaaactatcagtaaaagtgtgaataagggagtacagaataataattacagctgacatctattgagtacttgtctcatttcccttcacaacaagcctatgagactgtattagtccattttcatactgctatgaagaaatacccgagatgggataatttataaagaaaaagaagtttaatggactcacagttccacatggctgagaagacctcataatcatggcagaaggtgaaggaggagcaaaggtacatctcatatggtggcaggcaagagagcatgtgaagaagaattgccctttataaaaccatcagatctcatgagacttaatcacgagaacagcatgggaaaaacctgcccccatgattcaattacctcctacccactgggtccctcccatgacatgtggggattatggtaggtacaattcaagatgagatttgggtggggacacagccaaaccatagcagagacagacccatgattcataccatcttgcagattaagaagctgaggtacaggcaggtgaagaaaccagcctaaagttactatcggtaagtggtggagctggaattttaacacaggaggtccaactttagagcccatggttttaaacacttcattgtgctgtctctcattgcagaagggtgaggaggcctcacagaagggctgagatttgggatgaataccttcatcaagaaaaggaggagccagtagaagaaactgcattggtaaagccagagattcaggaagaaggtggatggtgtggcatattctggaacagggctctgtattggcaaggaggggtggcagatgaggttggagcctaagttgtcctgacttgaaagacttgaacctctcagcagtttgaatttcgttctaaagctatcaaaagaacctattcaagagcatgatacggtaaatcatcttcagcaactcacatatcatttttaacattgtttcaggggatattagtggacactcttaggaacgcagtgtatagcccacaagtataatgacacttattaatacaacttagaaaacaccctttgaaaatgcatcaaaaccctaaaagattcgattaactctatggaaatgaggataaagggtagatgcatgtaagaatccagctgtcttctatctacaaagctcttcatatccacaaccacagagacactgctcagcttctgaatcgccttagttcacaataaaatagaaataaatcataataaaataaaatagggaataaatctatctgttggctttgagaaaatttctcagtagcaacaaaccaactgctcaaatcagaatcccccaaaataaataaataaggtacctaagagggaatgcatgtgttgaccaaaaaactaaaaaattctcccatttctgtctgacgttgaaaaaaatcataggtatttggcattttagcctatgctgttgaatgtggtagccactaattatatgtggctatttaaatttaaataaggtaaaattaaataaaatttattttctcagtcccattagccccatttcaagtcctcaacagccatatgaggccactggccactgtactggtcagcacatgtatcagacatgtccattgttgcaggaatatctgttgggaaaaaaatgaactacttatttagataaaagtagtgatttgttagacatgcctaataaaattcagtttattttaagattatgtaattaaattcagacttacttataagagtctgaattttcattttaatcgtttgtatgtatttcattcctcttagtatgaagagagtctatatcaagagactctctatggagacaggagccagtttgtattaggccccagctctgtcttgggctctgtgctaggcatttcatatctgttatgctacttaaggctcatgactccctgtgagataggcatgcttattctcatttttccctaaatggggggctgtgacaaggctgaagcaaagagagggcacaacatcttttcagggttaacacttgagaaacatctatttcttcttaagtagctctactgctgcttagagaagtagagtatgtagacaagacagttaaattttccacagatggggtttacttagagggagataagatttcttttgcacacaattgtagatttttttttaaatggtcaaaatcctcctgttctagcagtagctaagaagtgactcggggaagcattcaacaagtaggaaagaagtctgctcagatggaggccctgaatcagagatgcctgtcatctgttcccaaaggctccaaactcctgccacaaatacactgagggttcctctctctataacttcttctctttattttctctggaaggaatgtacttgatacttatttttaatctgagtctccttccacaaaaagtgtagaggatgtgctacccagcccctaaagttttgcctcttggtattcacacttgtgaagtcattttccatgtggaagagggctgacctgtgtaagcaataagatgctgcagaaatgtatgacttctgtggctaggttagaagagccatgagtccttaaagctttcccccttttctctctcttgagtggctgtctctggaggaagccagtcaccattctatgaagttactcaagcagccagtggagaggcccacatggggaggaactgaggcctcccaccaatactctccatcaagctgccaggcatgtggtaccttagaagtggatcttacagccccagtcaagccttcagatgactatagagccagaaccactctactaagcctgtcccaaattcctaactcaccaaaataacatgagatagtaaatgtttactgcagttttaagcagttgagttttggcataatttgttatgcagcaataggtacctaacccagagggtttttccagctttgcctatgggcaagtctacagatgaaacaagctgcttttcatatttagtgctctctctcacaattatcaggagatataattatcttaccatccaggctgtgattcttgcacacaagcaccaagtcatccattattgcagtctcccttcccatgcttgatgaataactgggttcctgtgatttttcctcttttctttccccattgactgttgaaattgtttgcctcaactattgagtcccttctcttcagtttgcctccttttcttttcctcctacatgagcagaagccaggaaattgaatgtattcgatcacaaagtatgcatgaccctcagcaacatgagcctacaatagtctttttaatgaccagaggaaggttgtgaggactcttagttaatttgttatgaacacccactcccataaggaagctgctatgtatttgtggaataaattaaataaaatcagcaaatttgcttattatctatttcctgccctttgaacacaggtttacccataaactacatttgttacacactaactgaatatggaaagcactatgggtaatgcaaaaaatatagcttgtctgttttcagtgtactcataagcaaatataggagacatcacaaagatgcaaatatgtattcatattcacatacatgcttaagtagacatttacatatcaaagacagtgaaggctaagggccaaatgaatggtacacacaagtgttaacagatcttcaaaagaagatgttatggctgtgagctgaattgatcagggcagcctttatgcaggaacaaagtcttcagaaggtttaactatggcagatactattacagatactacttgtttcatccagttctcctttagccccaagcatagagactcctgcacatctcagcctcttatgagtgggcaggatcatgtgactagctctacttagtggggcacgagaaaaagtaacatgtttcatttcttaagtcaaagaaaaaactatgtttaattctccaatctttctcccccaaaagttcacatgctctggggtaactagaggatgttagtggctccctcagcctgggtctatctgaatgactacaataagcagagccccctgacaactttttttgggcatgtaccattagcaagaactaaacctttctttgtgataggccactgtgatctggggactcatttgttactgcagcataacttagtctctcctaactaaaacagagattcccaaagatggagaaaagcagagcacagtagaggtagcttataagtcatgtcttatatgacctttctcaatgacaaacctgtgtgctcaccaagacatagcttgttatgacatatctgaatagaattgaaggtttttaaataaaaacataagaaggttggaaaggcagcagaatgagctactgcctgtgggtgatctttacacatctcagaataacaggattattgatgccttggccagaagcattcctttccctctgttttctttttctttgagattgcaagccatatatttccatttggaaaacagtatttcataacctctaaacctaacatgagtcctgtgaaaccctagtctacagttgaatggccaaaaataaagacttgaaattccttcaaagctatcccattttacaaggcaatgctttctctctctaccaagaaagtgttcctgcttgatagattcccctctcttgctgtatattacacttactgctctcctgtcactccctattctcttcctagttgtttgtgccttattaaattccacattttgaaacaaccaataagaatcagaaagcctgaagaagccctttctcatacaatcagagctccctttttatctaggaataaattatattttccaatcaattcatgagtgggattcattgacaatatactctctttgtaacatatttctgaatga

SEQ ID NO: 2495 - DNA, 11610 bp, Homo sapiens
taaatcattaaagatatggttaatagggagagataattttgactattcagcttgcattgatccttgatataaaaagattaattttatattccgtttttaaccttacaggcaaccattagccatttcttttcacagagttgagctgagctggtttttcattaaaaatgtggcatttatcttattgaattctagctgtgatatctcattccaggaacaaaaatatattctgacttaccaagaaagcacaacaagacaaatgttacatttttaataaaagtcattgtaaacaaatttttgaaatttttatgctttttaatctacccaagtatacatcctccttattcctattaatttagaaaattgatatcttttccccttaaaactataggaattatgtgattttattcgttactgaaattaatgaggatacagtgtcaaaattatttggcctgtaatacataaaatgtaatattttgtgtttgaggcattcacagcaaaacttaggtaatatttttttttttttttttttttttttttgagacggagtctcgctctgtcacccaggccggactgcggactgcagtggcgcaatctcggctcacttgcaagctccacttcccgggttcacgccattctcctgcctcagcctcccgagtagctgggactacaggcacccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccggtaatattttattgttaatgttccttggatgcttgtagaatggtgctcatttttaatagcttttaattaatttttatgtttttgctattgcttggcaaagttgtataataagaaatacttgtattagtagtcatgttgatctattgcatgccaagattatattggataatgtatgtatccatgaaatcaaaaagtttcagtgttaactttttcaaaataacagtataagaaaaatgcattttctgtcaaaactcatagagtttgagtttttaaaaagtttattgaagagaaagtcagaaccatactatagaattttgatttattttttattagaaccaaaggaatagttagtgctactctaaagttagatcagctaaacaattactgtatatacactagttttatttccataatctgataactttagaaacatgacaaaaaagagcaaacttcagagtcgtatcctattgtgacacaaatcagctatttatatccaaagtgtgcattcaaaagtattcctggttactcttgaatgtggacttgtggaagctcacaaattcaatctctgcattacattttatttctccatttactgatcctggtaataggccaggagctacattttattaccatcccataagtgcacccgacttgctttaccagactatgacacatatttttaagccattattatagcccccactggtacccaactggtcagaaaacacagattcaaactcaagacaagtaaaatgatatttctccccttcctcagacttgattggaaattcttcctttatgcaatcaactaatcatcaaaatcctattttgctggtctctgaggggaatctcaggcagtatagagagcaaaggactttgcagttttgttatgtccatggatctttgggttgtaagtaatagaaaacagttcaaaattgctcatgtaaaaagcagggttttttttttttttttaaatgcactcagtatttcatgatgttcaaatactgaaaaggaaattcatgagaatcagacctagaaagttgaaaaacacggttgtgatcttccctgtgatcacaatctgtgatcacaacaacacaatctgtgatctgctgtgatcacagattgtgatcagtctgcacccctttctctctgcatgttgatacttgtggtttgaaatggccccacacaaatcacaccttacggtctcttagctgcggtgctcactaatgactgtatctcaagagagagaatctggatcaacatggtagagcctaagagtgggagcccctggcccactctgctgtgaccatgaggttagatcaggtgaggcttctgtgcaatggacagtgatcgatatgtttcatataatcctatccctagaaacatggcacaggcactgaatgatagctagaaacccaagcctggagtgattaccagcttgcaatccattctgtggagaagggaggacttctactgatttttggaggatgagggcaattctgacagggagtggtatgagtaaaggctaaagattggatcctttctaaatggtgactagaagggtgaggggagctaaaggtctacatgaagaagttgtggaagcttggaaaggaaggctttgtagaaagccttagataataaaatttttactttggcatcctttgaagttttgttgttgatatggcttttgtgtgtgtttgtgtgttttagcaaggagtggccattggtcagaggtgtgctggtgaatgtttaacaaccagctctccaaaataaaaatgtgtatgtacatattaatgtattaaaaattttattgataggatatggacacacaatttacaaataataaaatatgtggctaagtctgaatgtttgttttccctcaaaattcttatattggaatcctaaaccacaaaaggatgatactagattatgaagtggggctttttagatggttagtgaccttataaaggaggccccagagagctgccttgctccttccactacaggagggcaccatctcaggggaaccatgccctcaccagacactgctgccaactcaaccttggacttcctaacctccagaactctaagaaataaatttctgttattaataaattgcccagtgtaaggtattttagttatagcaaccagagcaaactaagatatgtgtaacaccctttgttgtacatttcatatggctagttgatgatctcaagattctgtcagtgatttttgctaaacttttgtgcctgtatctcatctgcatctgcagtctagccatggtttcccaaatcaagttgcatcccaatctgcttattcttttcccagtaagtttattgtcattaaattttatatgtgatctgctgtaactatttctcatcctgatattaattacattctttaaactggaaacttttcagcgttagaatcaattagaaatgtatatagtgcaacaacagactcacaaagtaactgagcatttagcaattggctcctgagtttcagccggagctggtttcagtgagtaactcttaatgtctgagaggtgatgataccctcaattacaatgttacaatcctcaaaacaatcaatgggatttgattagatatgggagtatggtgaagacaaagaagatttcaggaatgtgtcctttgataaaggggttatgatcatccacaatggagaaataatataggaatccattcattcaacaaatatttatgaagaagcaaatactaatgaggaaaagctaaacattttatatgctctacaggatagttttctaattaattgttcaagtcaaccacagttcaaaaatagatataaataattattgatttctattaaattaagcctctcttttcagcttttagtgatgaccctacttgcacattatgcctgaaatgacatagtcgctggaccctgagccctcccaaagcagaatctgtcttactttcgtcctgtgttcccagcatccagctcaatgtttggcttatactattcaataaatgtgggttgagttaaggaacaaagaatctatacttggctccctaaaagagctagtcagtgatgaaaaggggcagactggttgacttcaaccactttctagagaaagtgttgacagtgttaaatctagggaggctattttttattcttttcaaatcccaggaaagtctatcagtctataaggaagtctacaagaaagattcaataacgtaagtatgttgcttgacactgatgtttctctgtcttcagggtgaaaattctaggaatcattgtttacagggacatccttgaattccaaatcctggaattaagctaaagatttgtgacttaggttggatattgatgtaactctaaatatttagcaaaaccaggctgagcaattttctctgcagcatataatgaatgtgcatactctatgcctctagcttttttagcaatttggaataaaatctttgggatttgttctgacacttttgccttgttaataaacatagtaagaataaggacaaagagaggattataaaagtcatttgtatggtcaagctaaaacagtggcatttacagaagtttataggaaatgtaaggaatgacattttatatacgggcttatttttcctttaatcctatattaataaagtgaattctgtatgggtaatacaggataccctctgtgagttgactgtgtttacaaaattcatttctaaactattgttcgcaatggggcatatagcggtgcatggaagcaatattaaatatagtttttagttacctccacaccagtctacaaaatctgatttagcaaagcatctgaagtctctgaagggactaacgatattatagaccagggtgtggggaagctattgtccctgggccaactctggttcaccccctgatttaataagtaatgtttttattggtgcacagctgtgcttatttattagcatattgtctatggctgctttggggccacaatgacaagactgagtagttgccacaaagaccttttggtccacaaacccaacttttcagtgggagtgtttgcctatcactgaatggtctttaatgaccacaaggaagggtgacctgtgaagtttattcagttttgactgtagagatcaatcaggaattcatgctaccctagtcgacccgtatgctggtttattgtgtctcacagcaccctcttgtattttcccgtccctccagacagtggtacaacttcatgtggcaggaattaattctcaaggtctgaagagaggactctcacaggacatagtctaagagacataaaagaatgggattggattgtttcttttggtgtctcaagttcaccgcagaggtgaggacatggctttatttggcgacaatgccttattgtcggatgacaattgtcggactagtgatgaagtcaattgcttgcttcctttcttcttgctacactgtccccataactagtctctctgcatctcagcccctgatcaggatgggtcttgcgatgagacaccttgcagacatgagttgatttttcaaaggtttagtcttggtcaggagccaatagagcaagataaacagaaataaagacagtgaggcaaggtgagcaggggttcccagactcctcctgcatttcagataatttattagctaggagagttaaccataaagtagctgtttcccatccgtcctaaactgttctgtattgtgttctattattctatgttatgctgtcagtatcactcctagatgacatctatataatgtttattagggaccatgcagggtgctagatgccctgcacgctaaggattttccttcttctctggcaacttgtatatatatatatatatatatatatatatatatttctccttcatctaatctttaaacaactgagtttctctagacttacttgtgagttctcttaatctcttattctatattttctccctagacaatcacatgaacatcacagcttcaagtgccttccctaaacagataactctcaaatgtataactctgtcctggacctaatttctgagcttcagatcaggatacccaactacctacttggaaacatttcctcttggctcactcatggtctttctatctgactcttcagtcagagactgtctcagtaaatacatccaccatccatgaaacttctaaacccagtaattcttgtgtcagttttgtcccttccctttcccttatcccctggatcaaatcacccagtctagtatgtattttcctctaaatataattgggaatccatctacttctttttattcatactgccatcactctcgtcaaagcagccgcatttctccctcggagtaggaaacagcttgttagctagtgcacctaaagctactcttcgcaccaatcatgttgctcttctatttgaaacttttccctgacctccttttactttttggaaaaagtccaatagcattaatgctacctacaagaccctgcattatctcttcacagctctcttcttggcctttttctacttcctcctgtgtgttctccttcttgcctttgaatacattgcttccttatccttagcctagataacccctgaatatctttctcagcagaacttacctcatatccttaatatgatttttttaagaatgatcagactaggtgaggacccccaaatttcccatttgcaactgtattcacaactgtaattaagtaaacaagtatgtaattgtgtaaaatgtgtcagcctcaccagaatggaatctctagaaagacaagagctgtatagttctgtttaggactgtgtttccatctcctaacacaactttatcattactgaaagaattaatgtgccgactgaatgaatgaatgagctcatttaacacttgcatacttgttagatatttattgttgtcaccatttatgagaactaggtagaactaagtttccaatctaggctatcagaccctcagaccatgtactgcgatacactgcaaagaaggtttagtgcttatttgctctcctggttccccattaccatgcataatgaaaagttgatgagttccagctactggatcctaggtaaggaagagcaaatcaatatgtaacagtgtttttggtgttaagggtcaaattgaataaattgtgtaccatattacccttacatttagaaaatggcttcactggatacccttttattttaagatcacttattgtatttttattttaatgcactcgcatataaaatgaagaaacagccagataatgagtacttgatccccaaatcatgaaatcaattttaatatgcttagaagatttaatattttcttagggcaatgagattgatgaagtcctgttaatgaatatattgatgtaattgaaggaaaatgggctcaacagtcttttgccatcagtgagatgaaccctatcacacaaactaagaagtaggtaaaaaagaaggcattaaagacattgcataagcataaaagttcattctaaacattttttattaataaaataaatttgttgatatagataacataaggctaattttctcttgaaatttacataacactaatataattattttaagtatcttatactgactccatgaatctgtttattttctttccatatcagagattgtagacgaaaaaagaaaaaacacctcctttttgcagtacattgatggaaagtattttatttcatatcatattttattaagaaactgatctattatgaaaaacactttttaagccaaataagtactaagaaatgtgaaaagtagcattgttttaaaaaatttaaatttcttttaaaaacattcattttctggaagaagttttgaatacaggtttaacaatttcaaattttttttccatctaaattctacctttcaaactgtattcccatgttaactagcctgaagacagatactaattgtaccccaatttgtaatgcatcagtttagcactattgatccgctaaaaaatgaaagcaaactaagcaagagccagtctcaataccaaaggaatgatatattgattccatctgacaatgctttgtctacagatcaatgtgtatgtgcagcatagaccagttaaaaatgaaacagggtggacaaaggtcgtgaaagaaacagggtatccaagattattggagatcatgaaatgaacatatcttaaagtatatctgatagttgttcacttataaaggaattctgtaggtttactgtgcaaaaaaatcataatgtaaatgttttatgatgacaatgccatatcttggtcctgggagtctctgaagaaattgagactcacttcttaatcaagaatgactttgtcttgattaagaatgactttgtcattcttgattaagaagtgagtcttagagaaaaaaaaagacatgatatggattcagtcctgctatgcttggtcataaagagatgactgtgtatgatatataatacatctgattcttaggttctctaatgcatgttttatattcctgcagttttttttacatttcagattttgaaaatcagatatattgggctgatgagagattgagagatggaagaaatgttttctggcataatcacaaagtagtaattaatcagactgtgagatttcctccctgtcgaataaaatttaatatactgtagtgaaatatatgcatatacaatacattatctgtttgttctcttcatcactgtattaaagaatcacaaatatgttctagaaccagaggtgggtaatgttgatagtatagctatggaaaaatagcctaccacaaatttctttttttcttttttattcctctacacattttattttcttgggcttgttacattttaagagcaaaagtaggtgtcagcctgtatcaacattgctactttaagaataaaaatactctgttttatgaattgttcaagttagcatgtctgtggggatttttgaagattcgaatatggtcagatgtgaccttctgagttgatgtaaaaagaacatagaaactaatttatgtgtagagatactggatttcagaataataataataatatttggaaatcacatattagaaagtcagaactagttccaaaaatgtatatttgggatttccttatctagatgctatttatgtttttaaaaccaatttgaagtctattcaaataggaataaggaaagaaactattatagcctgtatgcagaggaaatatctgtcaacccaaaagtttagcagctatgcaataaaccataatgtgtattcaggctttgcttatgcaacttattttattattaagaagtgtgaatattctgtaatagcaatctttggacaattgtatacacatgattttctacttttgcatttcttctgattcaattctgcattaaaatatgacaaatggaattcatgcaagaaaatgtgtttctgaataccttgcatagtccacatcttctgttattcataatccctgacaaaggatgacagatttttgcttttaaccactaaagtggaaccaccctgtggcaatagcataaagccagttcaccattcacttggcctgccagcatgaaaattctttgaatatttgagaaatttttaattttcaaatttgtgatttctaaaagtttgtttatgatatgaggatatagttcttacactattttaaataagctcaaaatgttactgtattatattgtctttcatcttataaaccttgtgctcaagtactgaaatttaatgtgtctagggttacctatttaggattttaaattatgttctaagatttaaactgtggatttaaatagaaatagtgattattattacattatagataatacatagtattaattaacaatttatttttatgatagcaaactttactgcctattaaagcatctaattttagtttatttttcttatagttatattaaaaaacatttgcatagaactgtaacatgtttaacctttctaagtaaaatgggactagaaaagctcctttattacattattcatcgtaagcttacagataagtgagagaatttgacattgttttcacaatctagcctataaaatggcttaggtttttgaattgatgattacctacttactcaaaactctttttttaaaatcaaaagaagccttccatcaaaaatgtccccaataaaatatgacagccttctgtgaatacaccctgtcctctgaccagtcaattccttaatatccagatgcaagaacttatatcagtcggtatgccacacactacagtgtgcaaagctaggataataaataaagtgtagcagtatgtttattaaaaatctatgccttaaagcaatttaaaacatttttaataacgataataactataataccatatacatgattaataggaggtttttactgtcttataataatactttccccttctctttggcatatgcttagtttcagatacaaacttttcaacctacacagccttgattggattggaaaatgtgcttgcacgctctctctctgtctctctcggcctctagatagatagataggtagatagatgatagatagatacatagatagatagattgattgatagattgatagatagatagatgacagagttgacctctgagagggatgagcaaatggcaacagcaacaagacatccaaagaggactagcaattgtccaaatgactacccacttagactgatttctgagcatttcaagcctgaaactgagttttaccaggaaataaatctgtatatattttatatatatatggaaagagagtgagcatacccaacctacgagagagagcaggtttgccagaacacttcagactgtttagggtgaaaagtgagtatctgaaaaagagtgtgtattgaagagaaggggatacacacacacacacacacacacacacacgcatatatgtgtatatatattgtgtatattacatattagattatattaatatcaatagttatgtttattacatgtaaatcaagcatattatatatgtgcttactagtcatttaaattgtaaccatttaaaaatgtaaatagcattcttggctcaccagctctacaaaaacaggcaacaggcagatttgacccacagggtgttgcttccagatccctgtgctaaactgtacttttaaagtatatgcagaagaagaaagctttcttttgtggatgatgtgttactaaataactatcatataatactaaataactcatattggctttgtaagaaaaagtgaagtagtttttttgagttagttttacatacagagctattaaatctgtagtgttctatgtggtcaaagtcatttaaactaaaagaaatctcactagttcaagggaaagtcaaaataataaccatgatgggggagaacaaaaattgcaaaatacaaaaggacaatatatattgtccttttgcattcaaaccatttttaaattcttacaattatcatcagctttagcagctaattttctaaatgttaattaaatagactagaacattctatttactattatccattgtcccttaaattaatagcaaaaagtgagtaatatcttgtaagttattaagaagcaattagtatcttaatacagaacctggactaatcacttcattgaaacagtcatctgctttatcaactttgctcaggatttgaacatgatgatcaaggaaatatatttaaaaaggaggactatgtcatttctaaaatgaagatatctgatgatttttccattgcagtgtatctgtattttatgaagctacatggctttgt

SEQ ID NO: 2496 - DNA, 6883 bp, Homo sapiens
ctactaccatccaggtaggaattagcaagggcctgaagtcagttgtggcaatgggagtcgaagtagagacagtatcatttgtctatacctggactcttgtgagtgaaagggagcactgttcatgattatgctgggacaatgggcataaatcaagactgtcctggacaatagagacatattgttacccgaaatagagatgaagagatggacaagagatcttaaagaagtagaatatgcaggtcctgtaaagaaactgactggaggaaagtcaagagaaaccccaacatttctcccttgggggactcggtgccagtctctgccacagccagtttgtgttgggggaagaggatgagcttgattttggactcgttctttacaaatcaagactgccttttgtggacagttctggagaggaaggaggggggctccctagcgatcatatcacattgtatcagaggcattgcagggcatttggctgagagtaagcccttgaggtaaagtccctcactgataacatctcactgtgtaataaaggacataaactgatttcttatcagtattctgcatctcatctcttaaaagaggtactgccatgcaggaaaatagctaattatataattgaaaaggcattaatagcctgtaaaattcaatattagagacacagaacttgaaggactcgctagaggtcatttaaagccaggtgactggatccattagccctgatcctaagtcatcaggggcacagaaatatctaaagaaccctcagaaatcatcaaggaagatttttttttttgtgtggtcagtcttgtgttctgctctgttatttaactgcctttcacatcaggaagatttgaggtcactgcataatagccaacttccaaatatacacagttgaaaagaaaatttagattttaaactgtgatcctgactatattgcatatatcatgagaggcttttgaacccagaatagcctcatttcctgtcttaaaattcattatcttaacactttaactttgcattaacacagacttttacatttacatttccctgtaaaataaattagaaaacatttctttttgtgacaacaagtagaaaaaaatgtctttgggttattccataattaggcttcatctttcttttgttatggggaaatgatatgatcatttggtggcaaatgatgcagtgccccatattaatctcccagtggcccgatttcataattcaacttggcaaagtagacaaataaaaaataaaaatctctcctcatcatcgtaagaggctcgggagaaagtcaaatcaggaaaaataaaatattttcagtggttttttcagacttcactatgaataaaactttgtgcccaggaaggagtttcttgggtgtttttgaatgtttaggaggatatttatcctgcaagcattgattcctttccttctgaacagatgatcagctgggatgttaagatgttaacaacatttctttcatgcatgctagtttgttttattttgttttagcttgttaagatgttagaataactacattcctttcaccgatgctgaagattcacctttttaagaaagagtcactgatcacatgaatgacatagatgttgctttatctgcctctgcagtgcagctacctggctggtgtcagcctcttgggtgaataacaggcgaatttcaatattgtcagagtctatagctgtcaagcttcagatctaacttccttaatgctaagccacttccctgtgtagtgtcttctcataacatcattgcttattggtaatgcttgctttaaaagagaaatgtggatgtgtccgaatagaggaaatcctggaaaactttaagtccctcttctttttgattcttgttgagtggcattctctcaggccatttgagtatattcccatgccttattgagaaatagcatttttaggttttccctgaggttcaaaggttaaatatttgtcctcatgttacataaaattgggtcctggaagcccatgtgacacagtagagatggtgattggcttgaatgtcagggtcttcaggagcagggcaggttccctgtggctttcttacagcagggcaagtgatttgggaatgagatattcaagagacaggagggaagatacaatttcaagaggaaggaacaagtgtctttgggctgcagtaaaatctctagcgttctgtgtgtggttcctggtttcaggaaggaatggggcaggttagggcatagctgaggagtgtagtgggggcttgcatggcctcaaagggtcagaagtagacccaactgaaggtcctgttatcctggtagatcttcagtgagaggtttaggaggggctatgtggtggcaatgatgcctgtgtaggaaaacctcctacctctttagccattgaaatgaagagatggacatccagaagtctaggaaaattggcttaatgcaagaaagcaacactttccagctttatgtgcctctcagaactcatcttgctaaatctttttgggtcacttgcaaacacaattggtaattctataccaattgtgtttgcaagaagaggataattcgtgactgaataaaagctattctcaggcataaggccgagtgtggtggcttacacctgtaatcccagcactttgggaggccaaggcaggtggatcacctgaggtcaggagtttgagaccagctttgccaacatggtgaaaccctgtctctattaaaatacaaaaattagccgggctcgttggcacgcacctgtagtcccagctacttgagaggctgaggcaggagaattgcttgaaccctggaggtggaggttgcagcgagcagagagcacaccactgcactccagcctgggtgacagagtgagattctgtctcaaaaaaataaaaaagtattcctaggtgtgaatgcaccaaaccaattagaacatacatcattcttaatctgggcctcttgcagcagctctggtcaattgagggtttatactcagataaatatcattgagttatcacgccctgtttaatgagaagaatgccagacttcttataattcttcataaagccattaccaacctgccctctgtgtgcctcactcgatccctgtctttgacctcctgatgtgccaagttgaatgactttcggtctcccagaatagccgtcctctttagatgtctcacatgtgatttcttctttctggaattccctgggaagacagcttttacctcatcccaagcctctgttttctttaggaatacagccttgcctcctctgcccacttcccttctgggagttgtcttgctattgagttccagccaagtctagaatcctgtctgacgccactcctctctgtgtagacgtctgcccagtgtctgccccggaagtgcagctccctctctctgagccgctctgagtttggttgctgtcttggactgctttcacttgtccctgttgtattctccacaaacatgtccacatgccaggctgagctctttcttccactgctgtagcgggctcgtcccacagagctttattcctcccagtgagcccctcacatcctagcttcaggcctttcccagcccatctggccacccactgcctttgctaagccctttctctttccctgagggcttttagggtaggaagaaaaataaactctatgactggattcatttggaatttggctgtcagagtcatgttctcttcttttgggtctatttaaaaagcatccagcgcccatgggaagcaataacccttcccaaagggctaaggcaatctgctccgacccccggagcatccttcctcatccttcacatctcagagcagacatcggtctctgctggaagagtctttctaaccttcaggtctcacagaggtctcccatgcccctcactcagtgcattctccattttagctttactgcactgtatataaccaccagatctcaaggacaatgatagctttaaaaactgatttgccattgccgtatctccagcactcagctcaataggtgcatgagtgaatgaatgaatgaatgatttctctgcacatcttccactgattagctctctgttgcctaagacatctcagttaccattcattcttcagactttgttttttattcctttcttctcttattccagtttctagcacttgttagctatatgaccttgggtaagtgactaaacctctttgtgcctcagttttatctgtaacatggagtaatagtattacccatctcatgaggttgtggggagattgaatggagcagtgcttggcacataataaaccctcaataaatatgatgattgaattatttcctgtgctttccttgatgttttcacaggattattaaccatgattttgttaaaattgactaatagaatagaataattacttgttgcaacttctcttgctctcttgctaaattgaggagaattatatagttttattttccttttcctttgctcctccacttgatccctcccatatttttggagggactcaggcttttgggtggggaggtggtgagtagttcctcctagggctgaattactttgcaggtaacacttggaatattagagatacctaatgttggacttaagtttgaaagtctttcaatagttttataaggtcaaaacaaacttttttaaagcaaccctacgtgaacactgataaagttaaaatgatgactgagaaaaagtggtgtcaacttaaataacagagagatgccgtctaaaagaaataatatttacttgggaacaggcattgcaataggaatacatgtgccaataggaatacatgtgaactatgtgtgtattcaggaaggtaaaagaagacaatggcttttaaaggaaaatgagagggttgcatagttgttttgagataattatcctgggttataaggatcaataacaagggtggtgccggttcaaggttggacaaatcttctgggcagatgtccttgccgaagtattgtttttatataagattgtgatggtctttgtgcaaggttgtggtttttgctgaatctttagtgatagttcttgttattaggcgtttgtgtgtgataaccttcttttcatggccttccctggcttcttttgttagggtttttaacacaagcgtctccattttgattccaacaactttcacagtggaaacttgtatgtgtagggctggtcattccagcccaacttgcaaagactttcaagctggacctctgtgcatccgctaatggggagtctgtgggaggatagtacctcttgaagagtgcagcctcctgtgtgcccatggggttcttcgtgaagagtttcatggttgctgcttcagaactactgagatttgggaattctcctttcttgttcttttaaaataagcaataagtcaaaggggtttttgactgcccttttttttttttctgggggagagtcttgctatgtcacccaggctggagtgcaatggcacgatctcagctcactgcaacctccacctcctggggttcaagcgattctcctgcctcagcctcctgagtagctgtttacaggtgcatgccaccatgtctggctactttttgtatttttagtagagacgcggttttatcatgttggccaggctggccttggccaggaggccttggcctcccaaagtgctgggattacaggtgtgagccactgcacccaggcttgactgctttttaaattctcaatctcaaagaataataaataatatttgaatagtaaccatactagttttagccctgtgttggttaattttatgtgtcaacttgattgagctaagagatgcccagatagctggtaaagctttatttctgggtgtctatggggctgtttctggaagagattagcatttgaatgagtagactgagtacagaagatcttcctcgctaatatgggtaggcatcatccaatcccctgagggataaaatagaacaaagaggcagaagaaaggcaaattctctttttctctgtctttgagctgggatatccatctggcctttggacaatggagtgcctagtttttgggcctttggactctgggacttaaactgattactgcacccccttcccacctgctgtccaacctcctccaggttctcataccttctgcttcagttttgccatcagctccctcccctggtcctctggtctttgtactctgactgcattacgccaccagtttttctgggtctcttgcttgcagacagcatatcatgggacttcttggcctccataatcacatgagccaattgtcctaataagccaattgtcctctttatctctatctctatctctgtcttatctccaactatatctctcttattggttctatttctttggcaaaccctgactaatccaagccctctgatgatgagacacattttttgtttttcaaaagtagttctggtccttcactttaaagggcaaagtggacctatgtccactttggttctgctcacaaacaggggttgattccaaggggctggagtagggctgttttatccatctttattatcttccatggagcagaagtgatggcagttatcaatatccagtctgcatttaatcaccccatttgaagcaggtttatggcaagtctgcctttgctctataggaacaacagtaaacagctgactggcccaattttttggaagatgagtgtctcctacgaatctcacaagcattgcatgttctacctgttgcaatattcgtctttttggaaaaagtgcctgcagatttcaatgtaacttgcttaatattcatagattcttactctcttctcttccaggaaaatattgttaattttaaggtgagtatcagggaggttgtaggaatttgatcaagcagaaccatgataagaaaagcca

SEQ ID NO: 2497 - DNA, 15284 bp, Homo sapiens
gtgggtccaatgatgaaggttacattagatcatttcaagggtttggtgtcataaaacacaagagacaaactgtttctattagtagtagaaatgggaaggagcaaaacagatacacactaagtaggtgggatgccagcagttcagtattacctttataatagttacataaaacaagccaggaaagaaagttagtgaatatgggctctgggtcattatagaattcatttagagaagaagaatttcagttagtagccttcctgaaaagagatgataaagaggccaggattacgcccagggtctaagtaccggctgagtatgaggaaattgactctcctccaactctggggtagaagaaacatgattggatcagagggagagagatgattgagtcattagttaggcaaagcaagagctgacgacaatgataaagcactaatgcatccaagagattttttttccccactctagtggcaattttttacactttaaaaaaagaaagtgaagtcgactgatttgtcttgctgactttagaaagcatttaaaaatcttttaatgacactcgattatgttaaacggtacatttctcctctttaatttctgcttgcctcaagtgtgtccacccacttgtcctagtttccctgattaggcacctggtggcaaccaatgatgtgagttacaggaatgaaaaggcataaaaacctactttaggttttactgaagttccaggaggctgggcgtggaggctcccacctgtaatcccagcaccctgggaggctgaggtgggaggatcgcttgagctcaggagtttgagatcagcctgggcaacatagtgagactgtctctacaagaaataaaaaaattagccggtgtgatggtgcacttgtgtagtcccagctattcgagaagctgaggtggggaggataacttgagcccaggagttcaaggctgcagtgagctatgattcagccactgtactccagcctgggcaaaagagtgagactctgtctctagaaaaaaaggttccaagaatgtcatggggaattttatcacttctattctctggacatttcactgggactaatttctctcataaattggatgggtgttttccttgaacagattctggactaaattgggaagtggtacctaagtgccttctttgcctcttttctgtgactcatttcctgctcttcatgtctctctccaatctggatgtttcatattctcataaaggcttgtgctcagtgcctgtcaacttagaagacacctccgctaatgtggagataatagctagccctctaagagcttagcttctgggattcttacaagggccattcagagacctcactttgattgaactcaaatgaaacaatgtttttttttttttggagacagggtctcactttgtcacctaggctggagcacagtggcacaaatatacctcgctatgatctcgaactcctgggctctagcgatcctcctgcctcatcctcctgtgtggctggaactacaggcatgcatcatcatgtccagctaatttttttctttttatttttatagagacagggtcttgctatgttgaccctggtctcaaactcctggcttcaagtgttcctcctgcctcagcctcccaggtcctgggattataggcacaatccactgtgcctggcctgaaacaaatctttaatggtaaaattttaggtatcataataggttgctggagaagtgttctggattaaggaaactttgggagtcctttgaattctaccctgtgagaagcttcacacacttagaatttctgagctcaccagactctgatgtcctagttgctaggagtttagagtaacatgaagctgacacttggacactgttcttttcctctgttaatcatctatgactaaccaaccacattctgcaggacttaaaagtattctagtagccaaattagctagtagtccttaatgcttttaagcatcagaaagtgaaaaatatcaaagaactattgctgcatttgaggagctagaatgaagtttggtttggcttgaggagaattgatgacacccaggagtatgtgctggtttccatttggttcccattcacaggcaaacggaaagtacatacagcctggggtaggtcaggccagcagatatttaagttgttcagtagtggctgggcctgggaatatggggtgattttgaagaattaagttctgcaaaagattcaagagtacaaagctgtcttcatcttagtcaaatgcaggcaatcaatctgtcctttgcatgtaataaactgggaccttagaagtgaagattaaataatctgggatggaaaattggttggagaaggtccagcctgacctacatgtagacatttctcctgccttgtcttgtctcttgctacaaatcatcctgcaaggattaggtaacagcaacttcaattcacacacctttgaaggatggtgacttcagcattatccacggtgaaattcacagccaacaatcaatacgtattttcaggcaaagaaccattattcatttctgttatcggacaatctcaggcagaaatcatatcttttgtgactggaatgcacagcattttcaactgctttattactgcagctgagaatagggctttgcgctgactggcatttagctgctgaagttttctggactggcatttgcattggggtatccaggacaagtgtgggttttgaagggaagggaacgagggggagaagaaggaaagaaagagccgtctgcaggtaaaggccatttttgttagcttgaagcagcatgatttgttatcattgacactgagtgcaatgttgatttaacttttgcactgggggtattgactttacattgaaaagacagacaccaaccattgtctgacaatgaccaacacaatcagaatttcagacctagcatgatgtagaggaggaaagtctgccagaagacaaaggatcttgtcctggttctttgaagaattagttgtgtgaagctagccaagttgctttacctctttgggcatcagtttttgcatctgtaagaagatgtagaatacttgacttatgttcccttccagctctgagaggctttgactctatgattggggttctgttttactcttcattaacatcataaattcataaaatgagggagattgctaaaaaatataaacacaaatatgccttaatccacttattgaagtgccaactgctggctgatttttattttcaaaatcatctattaagaagggaatatgatgaagccattacttagaagttaactagtttcctacacacttttcagatcgtggtaatgatattcaccaacatttgtatagttctctaaagtgtgcagaagattccacatgcaccgtctcattttcttcttccttaatctataactctcagttttgtagtgcagctgaggagggagatgaaaacactgtttacattttttacatcggtttacattttttttggcaaaaaagttgtgttttgtctgaagaatgggtttattaatccagcagtgttcattgagcctctatgaagtgtcaagacctgtgctatagatgaggagatcaggatagacatggtgctacccttgtggagttcacagtgcagtaacaagaacataatcaacacatgattggataaattagagagtggtgagaattttgttgcttcatggaaactgggttgtccaggagtggtgatagaacaagggtactataaccttcccatggctggaaggaacacagtgctcactcctcctctgcaaatgctgtttggggatgtaagttggccatctcaggtcaattttcaggggttgcatcagcccggcacacgaggccccactgattttggtttgagatgcccttccaatcgaaagcccattttcctgtttcacagaatgaaagcaaatactcttaatggggccgttgggcttcaagtctgtgccaaacaattggctttcccagcactttcataaccacgcagctctggatttttcaggagcccgtgcaagactagtttgttgtataaaacgcatccaagaatttttcctcatagcactgaatggtaacttggtggcactggctttgccccacattgtgctaaaatccatgggttcactctctcttttttttttgagacggagtcttgttctgtcacccaggctggagtgcagtggcatgctctcggctcactgcaacctctgcctccagggttcaagcaattctcctgcctcagcctcctgagtagctgggattacaggcacatgccaccacacccggtttatttttgtatttttagtagagacagggttttaccctgttggccaggatagtcttgaaatcctgacctcaggtgatccgctcaccttggcctcccaaaatgcttggaatataggcatgagtcaccacacccggctgggttcactcttaagagatgaattcatcctgtcgttcattatggccaagtcttcacaataggaggcggggcacagtgactctagggtgtgtgtggataggctgcccagtgttgtgtttacattgaggctcatctgcgattccccgtgcctggcatacagcctagcatacagtaggtgctgattacacgcttgcttatccaaaacactactcaaatgtattgctttttactgttttttcttttgtccattttttttgttaattaccaaaataatttatatttaattttttttatttcaatagatttttggggaacagacatgaataagttttttagtggtgatttctgagatattgatgcacccatcaccccagcaatgtacactgtacccaatgtgtggtcttttatcgctcaccccctcctaccctttcccctgagttcctacagtctattgtatcattcttatgccaaagtaatttatgtttgaggtaaaaaaaattaaccatataaaaatgatttaaaagtgaatggtccttcatccccttccacagaaattaccactgtaaaccatttgatccttttagaccttttcaacacatgcatgcattcattcttctcacttcaaaaatagtatttaaaacacagcttgaaactggttatttttacttatcaacaaaaatctgacttttttcatctcagttatattgatctatctgaatcgtttcacaatgcttcatggcataatgcaacataatttgtgaataagtttttctattgaatgacactagttgtttccaatcctttcccaaaggatcgtttgtcaaaatgctttaatgaatttcttgattgtatacatatattttgataattgtgagagcatttcttcagaatatatttctggaagtaaaattgttagggcaagaattatgcataagaaactctttttgtagacactgataaattgcctattaaatgctgtatgaatttctactttaaaatgtttttggtgttagtgataagaaagtcaacccagtgcagaaaggaaatttaatggaccttgtactgaaaggttcagagtgtagctggtttcaggcttggtttgatacaggctcagaaatgatgtcatctggctccaggttctctctcctggcctctcagctcttattcctctttggtggcttcatctcaaacaagtttccctcatagtcttaaaacatctctggctgggtactgtggctcatgcctctaattccagaactttgggaggctgaggcaggaggattgcctatgcccaggagtttgagactagcctgggcaatatagcgagaccctgtctttgcaaaaaattaacaaaaaatttagccaggcatggtggtatgcacttgtagtcctagcttctcaggaggctgaggcaagaggatcacttgagcccaggaggtcaaggctgcagtgagctgtgattatgccactgcattccagcctgggagacagagtgaaccttgtctcaaaaagcaaacgaacaaacaaacaaaaatcaaaactccccaaaacctccaaaacccaaaccaaaccaaaagcaaaaaacaaaacagctgtggaactctaggcttcatcatttcaggttttagctcagtgaatacaggtttatttcccagaagttccagtcagtgtctcatttgatttgattggtcacgtgttcgtctctgaaccacgtagagtgtccagggccatgaaggcttttgttggcccagcctggagctgggtgtagagtcagctgcaccagaactacatgggctgagagcagggcaggatggctcaccaatgaaagttggtagctatttctggaggcagggtcagtgtgtagagtgtgaagtcaataaaggtggatggagtactgtggagacagattctttcctgtggacttatgagtgtaagttcagttttatcttggtctttgggaaagctgtcactgaggatcaatttggtgatatgacttaatgacattccttacaccgctaactgggacgacaattatgtactgctgaagtgtgtttaagggttatccttagataagattggatttatagctgaaaaagaaacacagtccctttaaaagaaggaacagatgaattaaagaacaaaaacatcttaatggttttgttaagattgctatggaaataactgaatgcaaatttcattttaagtctcttgaagttagcaatctattgagaggagagaagtttgcagcaggatttttttttttttttttagagagagagagagaaggaggaggaggagggagaggaagaagacttaaagttggggcaaaaactcttatggttagggcaaaaagagtttgaggttttttaatctggaagagacctgtaagattgtttaggcctatggttctcaaatttgagtgagaatcacctggaaatgttcttaaaacacagatttctggggtgcatcctagagattcttccttagttggtctgggaaagggtcaaatattaacatttctgataaattccccagtgatcctcatgccaacattgtggtggtgaaactggtcgaattttcccatagaactgatatttacaggtttttttttttttttttttaaacaaatgtagaaattgaccctccggggttttaaaacttgaaattttcgtttgcctcatctgggttgcttcctcaggaaatgagccctcaggcaagagactaaaagtcaccagatcactgcaactggataatgacagccagacccttcatttgtcatgattgcttgtttatcctgccctaattccttcccgcctatagctacattccttctaccagtacagaaaccccccagttttagttggccagggagacagatttgaggctttgtttcctgttctccttggctgctgagccaagtgaaagccttcttctttggtaatagtcattgtctcagtgattggcattctgcgtggtgaacagcaggacctagactgacctttggcattggggtaacagtggctgatgctactggtggaggaaccacaccttgagaagcactgatctaggcaccttccactcctctcagtctatagatgggaaaatggaaactcggagaggtgaggggctggctcgcggtgactctgggagaaagcagaggagctggggctagaatcacctctcctggctgcttccctgccctccccttctcccctcttctctttcctctccctgcccgccccttcccttgcctcctcctctctcccccattttcctcccctcctctctctctttccctttccttccttctgtaaaggaactgacccctggtctggttaatgtcaaggttacagagtagagtcaggaaagaacccaaacctcttgacttccaggttggtgcttaccccacgtctcaagtttcctgctcctggagaagcaagacaccaggagattatggggtttccctctcagtagctggatctttctgaaagtgtttttctttgaaggtgagaacaaagacagcctgcattattaggcaggatgtccctgagacacatgacagagggaggctgtcagcagtaacaaagaggctctctggtttgggaaaaaaaggtgcttgtagttgttgtgggagacgaaaaagcgtttctttgactttcttatatttagtacctgggggccttcaaattaaactaacaaagacagattaacagcaggaaaagaaaagcatacagttttattcgtattttacgtgcatgggagttcacagaaaagaagtgaaactcaaagaagtggttagttaggctccagggctaatatcgcattttaacaaaagaaagggggtttaggcttcagaggatgagacagggtagggaagtgactgaaaaatatatgggagaactaatggaagataaaaccttattttagtggggtctgtttttgcagactcctcttggtgtcaactctctgtctctggtgatgactgcttttgctccccggtattggggtgaagggtgggacactttcacaaagggaaatttacaccctgcttttaggcagacaagaggagggcagagaactcttcctgcatctgttgattctcaattgccttcagctcaaaataatccttatgccaaagtggcacgttttgaagcggcatattctggatctcttcattggatggaggattcacagacttgccaacatcaagggtggtgaaatgtagatgcatgctaaagcagtgtcccagtgtcacagggtgagggaatcagggccatgctcatccagcccaggggaagctaagcttagattaaagggacttatttaagagcctagtaaaattaaatttcaaatgatttttattaaaaaacttaccttaattgtgtattatattttagagtctagtatttactgatgttgcttaatgaataactctattttggcttttagaaaatatctgtgttatccatacctatgtaaaggatagttatttttaccactagataattagtaagtgactattatctaccttatcttatcccaattacaggcaacataactaggaagaaataaatggcttcgggcatgctggacttgcgaacacaaatttatgaagtgacagctagtgtcatgatgctcctgcctcaagatgacctcccaacccagagcccggctgcttgggtgaaacattttcccctccctgaattgtcttgcaaaatgtaaacacacattgtcactccgaaggagttagtttatcagatttcttcccttggtgataggagggatctagggcaggctgagcagggaggtgaggtggaggatgacagaagcacagacagggatgcctggggcttgtgactcacccacaggagtacagcaagtgcatgtgagacgcttctcaggatttatatgttagcttttctccccaattttggaaggcaaggaattgtagtcagcaatcggccaggtgaggggagtatttttggtgcaagggactgtccaagggatactgactgcagtgtcctcccatcttcactgttttcttaaagggactcactccttccctgattttctggtgtcctccaggttcatcagcagttatttggatggtcttctgatgtgcaagcccagcgtggtaggatgtggtagaaagggcgtatcacacactgatgctgcatcagctcagtttaacctcagttctactgccatgtgacccgagggccagttataaaccctcttagagctttggtttccttagatgcaaaaggggacaaatttatatatatgtacacacacatatatacacacatatatatgcacacacatatatatatatataaaaaatatattagtgcagattaagggggtaacatgtaaagtatctggtacaataaaatctaggccattgcagtgtaggtttttggaagctgatgctgagatggagtttgggttgcaagacatttattagggatcagctcctgcgcttagaaacggggggaagcaagaactgggcagagggacaggttgagctgtaatgtgggccccggagagccttggccaacccgaggagccctgcagtgagtattgtccatctgcattgtcccatgaggggctgagatggccagcccttagagccttgcttcactcagtcaccagacctggctccctgagaaggaggtgttctagggtgaggcaactccagctgcagaggcagcccctgagctgctgtcagaggctgcctgctctggccacctcctgcagctgcacagcaagtgcttcctgaaggatggtctgggtggctcattttcatgcctaccacataggcatccaacagacatgtctcctccctgctgccagaactatcctcttttttttttaaccttttctccaccttctttctgttctccatctgtcctcttctcttgcacctgcttcttccatccatcctctccacagtcctgggagcttgtggctcctctgcaggggccctagaagtggtgcgtgcctttgctactctctctgccagtcccactgcagcaggaagcatccgacacatttttgtctcacgcagataatgtacaagttacccatgacttctcttttactttggtagagggaagaaaagaaccaggctttattctgcagaataaaacaacacagatgctggtgaatgcactgtcagcccatgcctgccagctgggaccaacaataggagaggaggcactggctgcatcgctaacagatttccaagaacgctatgggcagccaaaaaagccatttgggcttgtttctttttcctctgttgcctttctgagagataaagaggctgatggatcataaatggagatatgaatttgataacatttggaaagaggttaatggaaaccaacgtacaaactacagaataggagaacacggcagatttctaaatgccaatagcatttagaagctgctcttaaagaaaatttgaaggtgagcaggcggtgggcagaggatctgaagcagctgcaagggcctcacatgagtttggaaatgtcttcctaatgtgatggatcctggcatcattccacgcagacgccaggtaggtgtccctgtccacagctctctgagctcctgggataatttcaaaacagcagagagtgagggcatgtgcatcatttgagcacatcatagagggcaccactgattcgctgcactggaagtttgtttgctctatgtgaaatctcttatgtctggcctagaagcctgcatcaaggaactgggaaacaccaccggctccctctgtgagtggcaaccatgaaatccaccctccagtggcctcttgtggactgtggactaacttccttcaggggtcccaggaagtcctagggaagtggaaactcccttccatatcccacttcaagactcagccattgtgcagaagaggccaatagcaagaccccaatttagttccatgcctgaggagttcagcctaaaatcctgaagttgcacagggttttactgtcttattccattctctcaacaatgctgtttcattcgcgaggacaatggcacttggagagattgagtgacttcctcaggtctcaccaattgtaaggagcagggtaggtcctgaattctggcctcttctggatccacagggttctggtgcatggttatcctggttctgatttttctcaaatcagagaagacaaggggacaaagacatttaatcccacggaacctcatgtcagtctcactaagtaaccagggcttcagaggatgccactagtccttgcttgcaagtagtcaggcattatgctgctgcctgctagactgtgttggccactagccacacttggctactgagcccttgaaatgtggccagtctaaactgagatgtgtgtgtgaacttcaaaggctttaaaaaagaaggtaaggctgggtgcagtggctcacacctgtaatcccaacaatttaggaagccaaggagggaggattgcttgagcccagacatttaagaccaggctgggcaacatagtaggaccctgtctttacattaaaaaaaaaaaagaaaagaaaggaaaaaaggaggtagatacctcattaataattttgtattgactatatgttgaaataatatttttgatatgttgggtgaaatacttacatttaaaaactataatttatatttataataatgtaaaatataataaaaatttattttacctaccttcttaattttaacaattgtgcctactagaaaatataaaatacccatgtggtttgcattacatttctattggattactctagattcatctgcatccctaaatgtctttagtctatttttagcttctgcttcttcactctatatcactgttactggtagcgagcgactgggtaggtcatctgctttagactttgaaatttaagaggcagttcacagaatgacggctatttcacactcaggtgagcatggtcataattgggtgctcataggggacttggcggtttaatgtcaatgaagaagcctcctaggggtgatgcctcattcattcaacaaatatttatgttaacagcttctttatgatggatgattatgctaggttctgggactatgtctgggagcaagaaatagtcacaggcattggggagcttatcatctggcaggggcagtagacattgtgatggttaattttgtgtgtccacttgactggctacagggtgcctaggcatttggtcaaacatttttctgggtgtgtctgtgagggtgattttggatgagattaaaatttgaattgatagactgagcaaagcagactctcctccctaaacgtgtgtggtgcttgtccaattggttgaaggcctgaagacaacaaaaaaactgactaagagggaacttccttggcctgactgcttgagttgcaacatcaatcttctacccttgggctgtgacttacaccattggctctcctggttctcaggcctttggattcagactggaatcactccagcagctctcctaggtctttagcatggcaactgcaaatcttgagatttctcagcctctatagttattgatatgatttggctctgtgtccccatccaaatctcatctcaaatcataatccccacatgtcaagggagggatgtgattagacatgggggcggttcccccatgctgttcttgtgatagtgagtgagttctcatgagatctgatggttttataagtgtctggcatttcccctgctgaaacttctctcttctgccgccatgtgaagaaggtccttgcttccccttccaccatgattgtaagattcctaaggcctcccagccgcgtggaactgtgagtcaattaaacctctttcctttataaattacccagtctcaggtatttccttatcgtggtatgagaacggattaatacagttgtgtaagccagctccttataataaatctctctccctctctctgcctctcatctatgtatgtatgtatctgtcatctatctcctataagttgtttcttttgagaactctgactaacatagacattaaataaacaatttgtatactgaataattatataactactgcttgggggtgtggttgtgttgtgtggtgagggggtgtagaaatgtctaggggttgatcaaccctaacaccttccagatgaccctaggttctggcctttccccaaagagtcctggtctactcagtcatctcccacaatttggccatcttcttgggtcctcaggacaataaatgacccagccagatctctaccctaagtctgacttaggatggaaaaatgtctccttatgcctttatcagtcttgacttcaggtcagggaggccagaaaaatgaaatctgctctattttgaaagtttccttcatttcctttttatgatttaaatttatttttataaagtgaattgatgaaaacaaacacctttaacacctctacccctcggtattctacagatttcctgtagttttgacagtgaaacaaaaaacgtcataattcttcacatacttcaatactattcttgcagttctagtcttgcattactggtggagagtctgggggttggagatgggggttacattgtaagggaaagcacatagtttggatgtggtgagagtataatgagattagcgtgcatgtccagctgtctatccactgtctatctaaccatgggtaagttattcaaagttacctcactacagcttccttgtttagccagtggggctcataccacatacctggtgggtttctggaagaattagagataaagtgtagaaagcacctagcaccactctggcatataatggatacccagtaagtggtctctattgatatttttccttgttccttggccctagactggtcaggttgtcagaggaacagaatttgaccacttaattagaacaatgtttcagtaatatatgactgcataacatacaattccaaacttcggatcgtaacatattattatgcacataaatcctatgggtcagaaatttgggcagtgcatgcaggggtgactgtctgtgctccaccatgtctgggttctcagtaggaaggcttgaatggttgaggcctggaatcatctagaggcttcttcacatacatctagctgggatgactcaaaggctgggatcagttgggaccactgaacaaagcacctgtacccagcctcaccacatggcttgggaatcttacaacagtgcaactgagctgtgagagggggagtcttgaaaaggggtgtctgaaagtgagcattctaaaggagcaaggcagaggttgcaaggtttctttgatcttgccttggaagccacacagtgtcatgtattctgcttctcttgtgacaggtgaattaccaaagttagcgtagattcaagctgagagcaactagattctagcagcaaggccacattgcagaagagcatgtaggatggaagatattattaagggcatctttgaaaaatggcatcagctacaaagaacaacctacattagactcctttagacttgtttgttgggcttctcaaaaggaaacagtggagcccaggagtttgagatcagcctgagcagcatagtgagacccccatctcaattatatataaaaaaaggaacagggcactgtgcagttcccttctcaaagggaacaatcacattgcttatgtcaatgtatcttcagagaacaagtttcagcaacattgttgaaatttgcctgaggtaacactgtaagttgatagtgaattagaccctgaaatttcagatattgactatattcaaaattacagtgtatttttaaaaaaataacagctttattgagttataatttgtataccatgtaattt

SEQ ID NO: 2498 - DNA, 22654 bp, Homo sapiens
ttaaaaaccattaaattacaagaccattttaaactgctgtagtaggagaaaaatgttcagatttttacaatatcatattctggcaccacaccaaaaacatgatgtactgcactgcttgggggaaaaatgtgaacatgagttcttatacttgtgtatagttctaatttgtgtgacaaataaaaggtatttttttcagcattcacaataaaaaaaaattgcctatactatgcttgtcacaatataaaagtaagccattggtctaagctgtagcccatatggttggtacacatatatttgtgagtttggtacaacatgctttgtgctggcaattttaatttcaatagcccattaatcttttaaatacattaagcatgtccaccactgctggcagactcttctgcccttttgaatctcctttctaccccaatgttttctccctagagtttgagctttcagcatacaaagtgacgcctgcgaacaggaagataaagaaatttaattaaaattacagagttgttttgtaattgcctaacaacacttcaattttctactctaagttttctaaaatcaagcataaatgcatttgaagcagaaaaattcatgtttttaaaaatattacccgaattatttaactcatgatctggggttgatttcaaacagctttactggagatagattcttctataccagagttatttaactaatgagtatgatgtgccttttcctttctgccacatttcttatataaaaaattgttcactgaaggcaatggtgagaaagcaaatatgcatcaatttcttgcccaatagaagaacactaagtaggttaagcaatatgtacaaaaatctagtatggaaatctcttttttaggaacatgccctaagttttgttatttagcaatagctaacctaaccctggaataatcttatcctttaaaattcccatttcaatttcagctttcagattttcattgcaaccatcattcatcttacatcattttattagaagaaattcactgattgtttatgtattgttatcaatggctaaaatagttcttatgcatttactctatgccaggcaatcttttaagtgtttcacaggtattaacgtatctaaatctcacaaaaaataaagcagggagtttatataacataaaataaagctgaaagaaattttatattttctgacttgagagctccaatacaagttgaaaccaaaatacatagcttttgttagatacctttgtatcacagccattcagaattcttttatagtattcatttgacatctttctctagaagatttagtcatcccacctctgatatgatgagaatggatgaaggagccccacagagtcagaaaggtctaaattaaaccaactagaatctaaatcaaatgtattttagccatcacaatatgccctactttaatatatttgttcctacaaataaatatatgccccagatatgctcactgaataatggtcctaaatttttttttaaaaaagctgaaagcagagaaagtaagttttttcaaagtagaagatgtaaaatggtaaaatgtaagatgaaggtgacagagagaaatagagatacaaatttttgaattataattgtaagcatggtaaaactaataataacaaatatttattaaaaaccttccaagttttagtcactgaactttatgctttattatctcatttaatcttcaaacaaccacatgaggtaagtgttgttatataacgatccccatttaaaatatttaaaagaagaaaaggaagtttagaaagattgaaaatttgcttcaaggcacaaggttagtaaaaagtacaaccaggaattggaatctaggtatgccaagatagtaacatgggttactaagttaggtcgtgtgcctctgcaaacaaactctaagacaaagatttgtgtgtgagaagtttaatgaggtaagttttcagaaacaacccatttctgtgaaatgcagtaggatttggcaaaaggagaatttggactgtgtcacattggtaacagaggtctcagccaatcccgggtaagctctggagctggaatggcctttcaagctattcttaattagggcaggaggccaaccattgcaatctcacatcaatcaatcattgaatatgggcagccccaggcaggggctgtaatcttgggtggaggggaatttcctgaagaggggctcaactgcaaattgtcagtagccaactcttctggcatgagggaatgagtgtctccatcctgcaggggtatctggtagcacatcatagtacccactacagttatattgtatcaattcgagaaaatcaaaacacttttaataaaatacatttataagaaaaacacgaataggtgatgaaccaacaaattctccctgtttttgtttttaattggagacatttatttgtttagaatggttgctgttacctaaagttatagaaaaatatataccatacagtttatatcctatgagctaagggtactaatcctaaaaccttaggctctagataacatacaaaacagaagggaaaccatgctttatcttttcttactgaagatttaaatgcccatgtaggtaataatccaaattgctgtgaatctcttctgtgtttaagctacctgcttcttttggccagaagcaaataggaacccagctgtattaaatgaatcaaagtccttacttctcagtcagacgaagctgttttaagggcattaagataagctactcgcagttcttcagttcttcccattagaatagttttccttcaaatttaaggctaaatgaaccatttatcagtttttaagctagttcatgtaaacaggaaataaagttttcataagcaaaatatgaaattgaaagaaaaaagtaattattctgctttgtattgctaccccctcttataactgaatctgttcttgcatgttagttcagtgaggtaaatctgattatttgggtagcaaggtcctattcacaacaaggattggtttggcatgaccatcattcatattttaagtgctacaaagatgaaacagcaagacaaactcatagtgttaaaaaaaaagttttttattttgccccagcagaacattttctgacctatagcctccaatcaccctttactgtgggtgatgtcaaaaacacttactgcacaagcagagacctgtgtttcctttgccacagacaataaatctttagtgtcttctcctgatacgcatcactccacttgctctcaagaggcactatacatctctcttgcctttcccctcactaacaaggtcacttttgagtgataacacaacttattgcaaaaatgtatagacatgcacaataattagtatccacttttaagtaccttgtcagtaaatattataaaactctggaaaagacttcttcccaaacataatgtattcataaatttaatttcacaaatatagatttgaataagcccatgtaaaaacagattttggccctaccttttcattactgttataaaattatactttatccagaaggtatgtatttgagaaattaattttagcttcatagaaatctccttttcgagtaatacaataaattgctagttgactgtactcatttctagcttgcaaaaccaaaactttttcttaattaatgatagaaatagtggaaaaaatatgtaagatggaattattttttaaactattagcgtttcttaaccaggattccatgagtacattaggactgagtgctcaaaggcatctgttatatattaaaaactaacttctcatcaaagccttatgctagttatgtggcatccttaggagaattgggaaaataccccctcaaattatcttctctgttttgtggttcagataagaggacttggttgaaaaatgctgttaaaaagagactcaggttatataactcaatcaaaaccaataagcacgtaaatataaaagctgacatttgaatctgaacttttgaaaataaagctgaagtcacataaaaaatacaacacgtgttactccaaatttcaggcatgacttattttgttttcttaaagtgtcaaattaagatacacagaaattcagaagcacattttagattaactcatctaagtaaaataaaccataacagatgcctatgaatagggttttaagcaaaacaaagattatacaaatctaaaaataagtctcaaccttcaatctctgagacaaagaatttctaaacccattcaataaatatacaccattatgatgacttaaattcgtgattaaaaccgtgatggaggtttcttccatttccactttagtaacttagcgaattccctgcctgtctgtctcctgtctctctttcaaactaaatgcaaagaaggagaaggaaggggaggaggaaggaaaggaggaggaggaggagaaacagaaacagagaaacagagaaaagtctctgtaggtaacctagatctttgaattaaagcaaagtctttaatgtaggcattatgatatgctctgtacatgatttaaacactttgaatttcatcatcatcatttctttgagtcagcactattattcctttctctgatttctcctttagctctccaatatttttaacaggataaagagactctaaatccagtgaccatgctttatgttcagaaaatattacctcttaataaatgtctggctattattataaaactaagaagaaaaatccttttaatatgagtggcagaatgaaaattcatcaatttaggtataaaatgtatttgaacattataaaaaaggaaagacagaggacgcaagtacccacaaacaggatgagaacacagaaataacatgggtttggcacattatgacatgatgcttacatgtttgggatgactaagagttatctgttaaatagagggtgacaggtagtaattattccaatgcaagacattgaacactaaacaaggatggctaggataaagtgtcaaatgcaggtcattaatgatgacaaggactggattcagctgcagcagctgtcactgtcccaggtgggtgaccatactgtcataatccttatcgctatggtcttcctggaaaagtacaggctaatatggcaggttaaaaaagtacaaatgataagtattgcttacagaaatgtactgaacaaatctcagtgtcttcagtggcccaagaatttatttcttggtagatcatctttttaagtttctaactccaatgtaagtgaagctttgatgtcaggaagctctgagtttaaatgtcacaacttaccagctgtttaaccttttttaacctccaacatacatagtggaaagcctacttcatatgaggattaaataagaaaaggaatgcaaaatagatggcatgtagaaggtatggaataaattttagttttctcctaagccaagttccgccctgaacaagttgatcaaattttacctaaaattactttctgctagtaaatacatttcattcttgcaaatgtttgctgcaaatacatcagtttacaaatactatagtttattaattatcatccaatattttaaaaataaagtatataactgatgattatatttgaaattttatgattaagggacaagaacagctatcatatcaacgttattgtctttgaataataaaatctataaaactattagaaaacttcaatttctaaaaatttctgactcaatatttattattttgttcaatatctgttcacttcttttaaattaaatagtcatcctaaaaccactgaatcatcaatcctaaaaaagttgaagaaatacagcccaaaactactatatcatctctattcatattctttctgcagtctacttaagaatttaatagttactatttgtgctattcctcacaaatgtcattatttaacacccatttttcagatacaatggcccttaagaccccatagaccctcatctcttagttattacccttgtcgatttacaaaaacctccaccattttaggaagaaaaaaggccacatctccagtggctacaaaagtgtatctcttgaaagaaagaagctatgaaaatagctgctgcaatttaatagcttcaaaacatttcaaaccaaagctactatttcttctttcccctctccactcccattgtggattattccaatacttcagtttttgtacattccatgctatcaaaaatggcaaagaattggaaaataacattatgccaagaagacgtcaaggtgctatttcaaactttaaaaaacaaaacaaaacagatgccacttttgacccatgagagagaaaatattcattattaaagtagaccagactgttcctcagtcccttaaacactctacagtttgaatgatcaaaaaagcctcttcagtgtgcatgtccaagcctgacgttcctgccaaatccagtatttctaactttctactgagcatttccagtattttctttcaagctgaactccatggaaccagcctcaggttctctctcctctccctctcttctctgctacacacctagctccacatagtaatcaagtcctgctagcatccccctttcaactcagattgtcccattctgatggagtgctactgtctcatgggggccctaacaaggtggttcctgcattagcccagttgccttctgctcttaccttcagtccttctaagagtatactgcctgtcaccaagataatacttgtaggaaaacaaaataaaacaaacaaaaaacccaacttgttttcatgaagtcttagtacaaaattagaaaacaaaattcaataaaatatttttgtttgatgggacacagatttatttaaaattttaaagttgagaaacagcaataaatatttgttggacattcatagctaagtgctagtctaatatactacattctccagaactgaacaggactctgctgggcgtggtggctcatgcctataatcccagcactttgggaggctgagggaaggggattactcatggtcaggagtttgagaccagcctagccaacatggtgaaaccctgtctctactaaaaatacaaaaattagccaggcatggtggcagctgtaatcccagctactcaggaggctgaggcaggagaattgcttgaacctgggaggcggaggttgcagtgagccaagatagcgccactgcattccagcctgggggacagagagagactctatctcaaaaaacaacaacaacaaaaaaaaaaaaacaacaaaaagaacaaccaaacgggacttagatttattctctattatttccccacatatagctcaaaagttgctaaagaaaataattgaatcactgtcccagaacaaatgtaaatgttcctactttctctacctctacaaatccttcaagattaactcaactctctcttctataaaacctcaccttacctcttggtctgaagtattcttccttaataactcaaacagcaattaatgtccagacaattcatttagaaattaattaggcaacacttttgtgtaatctcttctgttacttccttgaattgatgtttaaatatttcattattttacgttgtatatgtggattgttgcccttttgagtagattacaaacttgttgataactatgtattaaatattttggggtttcaaagactgcctgaaaatagtgggtactcaggaaaaaatggctaattttattttatgcctatcatgtcctaattctagcaaatttttttaaaccaccaaaattatttgatgtggaattataattgtggagttttcaaatatatataataggtatatataaactatttgctgtttatatataaatatatatcatatatataattctaattagattagattctaattagaatccatcttgactatacaactggttttatcttctgtttttatttgttaattgcattttgcttgctctgctttgggttataatttttgaggcttttctttatcccccactacatctagactgtaataaattcctagcaggtagggattatctagtattcactagattttttaaagaaaaaaattttttctcgagaacctgttgataacttgtagctcattttcctttgtctaatcttactagaaaatattttcaccaaaaatttagaaaagtcagaaatgtgtttaaatgctcatgtgttaaatgctccaacatgccaaaaagaaaaattatagcacttataatttaagttttaatattcatctgtaatcttacagagaatatgttgtattttcattaatactattaattaatccaaaatttcacttgtttattatttctaagatttcagaaacaaagcagtaaatgtttataaatgattagaaaaactgtttgctctaaagagtataaaaagccttaaaatgtagtttacatgggtatttttcttatgccttcagttataaaaaccatcttattattattaataatagtaatattattattttatacaacagagagtacaaagaatgatgccctaggaataaaggaaacctcctatttcttataatttgataaaactttctttctcagcaaaatattatataatattagcatgccacaacatgaaagtctttcaagatgcctcatctaaacaacaagttctatgacagctgtatcatggggaacccttggcccctccatgtgaaatagggaatgtaaggactgaggtgtctaccacaggacctagtgttgaaggcaggcagactgaagaggaggccgacctccagatgctcaaccctcagttcccagtactcacacactaaggatttctcatcaaaaaaatagctggcagcccatttgcctcagttttcactaacgtacctgaagagatattaagactttaaaaaccatttcaggattgaatttttgtaagatgattttgggcacactattttcagatacatcaaagaataaatttgattagtgaaatcagttgctccatagatcaaaataagagctcaagctctcagaatgatctgggaaataaacagtaaattcacagtaaatttaacggaagtctaaaatgatgaaagattctgaaaactagattttaagagggaattataaataataaattatgactgtgccaacagtatcctaaactaaaaatgatggcttttccatagtaaatctgagagctttgataattgaaatatataatttgggattgtgtcataatcttagcctccagatagaactccttttgctttgattttacaggttagaaatgacaatcaattttaatattttaatattaagactaacatgttgatttattttctaccactaattatatttcttttttttaagtaaagtatataactttataattattcttaagttttggcctctggacaatatctgtaggtgcttaaaaatcaatccacaaataattttctgacgccaatatttacaataatatgactaagatacttaatatttatgttttgtatgtattatatttaaatattcactagtgattcctatgttacaaaaatagttcactagtacttctcatttatatgttggccttttcaattttattgttaaatttttcttaattcaacacctgggcctataacatattaatataactaaaacactaaactctaaactgctgtaaattttctggaaaactgaccaataaattctgaaacataaagcagaatttacacgaactaaatttttcaataacctatttaaagttagagttaataccacttattacctacctacctgcatgaatctggcaacttgagatctctatatagttgttgtttgtttttgagacaaggtcttgctctgttgcccaggctgaagtgcagggtcactgcagcctcaatctcttgggctcaagtagtcctcccaccttggccttctaaaatgctgggattacaggtatgagccaccatgtccagacttacttgacattttaaagtctcagtttccttatctttaaaatggcaataaaaatattttactgtgagatgttttgataattagagtaacatgatacatgtttgaaatatttgaaatattaagggcctaaaaatttgtaattaaaaactgggcccagtgacaggcatctgtagttctagctactcaggaggctaaagtaggaggatcacttgagcccaggagttcaaggctgcaatgagccttgtgcaatgtgccactggactccagcccagatgagagcaagaccccagattttaaaaagaatgaatttgtgattgaaataatattaattcaggattttgttctatttataaaaaatatctgaaatatactttcatctaattaataaagaatatgtcatataagaataaaatcatgatctgtactgagaggttttttaaacgcattcagaagccagaccggagggcagaggccagaggtcagaggctagacaagtgttatttgtcatctagttagctgcaggtaaaaagaccacttaataaaatgagtctattaggctgatttaagtaaaagtgattgattttcatttaacatttgtccattattgttaggtcaagttggaaaatcaatttcaatgtgacccaatgggagaacagttccagtatctatatgtgtttaatgacaagaacacattagtactcatttgcttataacagtattaaatgatagcttgtgtttaaattattttacagttgtgacacaagacagcaaaatacagcatatcaaaatgacaatggagataatctaatatcacacattgatctcttcttattttgaaagaagaaaatcagtgagaaatagacaaattttatagagaggaaactggaataaaatttaaataaatatacagagctcttaaaatctgtatttcccttactctctttcatatgcagttattttcaaattattttaaagtgtaaccagtagcaagatatccattatggatctagaatcatagtatttttatagtcccttgaacatattttcaaatactatgcagaatatatgccatttttttagtcttatagtaacttgtaaaatatttatttattcattattgctggcctcatgaaatgtctatatactaaaaaaagtatgaattaatttaaacatattctaaacaataagttagaatttccacctgcatgaattattctgttcaaatattgttaaggcctcctctctgagggcaatgtgcagggttttgggaatacccttatgagcataggaaaaatatcatattcatagagctgggttggttgaaattagatttttttaaaaaaacaagactgctagaattcaaaggtaactttttgatcatttatttttctatacacaaatgagaagaccgaagaccagaaggtttagaaaatttgcgccggactgaagctgataaatgacagtatcgagatcccaactcccctgactcccaatgcagtgttctttccaatatgccaccaagggctataggaatagctctaatttttcttccttcctataactcactttcccagctcctaatctcttgcataactcaccttctcagctgccaatctcttgctacagtttgaaaagcaatgtgcaattcctggaatatataagctagttcatccctcttgtgcttttgaacacgcttgtccctcttggagagaactgaagtagggatggaagttgcagtatacgaaggggttgaattacacaacttctaaggtttcttgtgatgtaaaaattccttattctgtataaacttgctgtagaatttattgccacttctaaatattaaatattatttatagatgcctatataattaaatgtatgttgtgtatgtgtattatagagtaatatgcatgcattctgaatatatgtcaaatatatgtgtatcagtaaaaacacagatacacagttgataacccaggcaccagaagaatcaggttcaaaactgaaattcaaaagtgcttccctacatgtataattgccctaagtcagtcagttattgcctgaataggtagaggaatcaagagctgcactgtaaaatgacagcatggaataacgagcgttcactggattttaaaacctgactctcaatctagattctgttacattcggcaatgtacccttgggaaattcaccaatcatctctagatctcatattcttcatctgttaaatgagaacagtatgacaccgactcaacacagataggacaaaaatgtgataattaaacatacataagacatagtaggtgctcagtgactgttagctgaatcggagttctgacccttctctataaaaataaagtatactcccctctcctgaaattatgagttccctcaacaactacaataccttgctacctcccattagacacaaacatcaccatgcacacaagtatatgcatgcgcgcgcacacacacacactcatagaagcattggaagtattggaaacccaagttttattcccaagaagcaaggaaggagaccccgggcaaatcaagaaaaatagctgaagccaataatccctgtttttcagttaatgaacctaaatttgtgttctaaaaaacagagtggatttatattaggaaaaaagtgttctttcacctaagaatccacttgaccacttgacaatccaccaaatccaccaatttgaccagttatatcacatataatatgacctgctatatcataatttttatgtgattccttttggagcccataatgaaagactatctacaaaggcagaaacattgagatagggctaagctactcaggaaaacacatattatttccattccttttacaaatttgagaaccctccaagagtctaattctaacttcttttgcatcatgttattgtccaattcaaagctgttattatccacagactataaataaaatctaaatccttaatgcctgcagatttttgcatcttcaataattaattaataggtacaaaaataaatgggttgataaatgaaacaaatgaacactgtttcatttgtatgttttcctacttacatttaaagataatcattaaaggaagaaaacattgctgcaaaaagaaaagtataatgtatctcaaagccaaatttgtgattttaaatttgtagaaaacttaagaatatctaagctactgattatactttactactgaaatttacttcactgtcattagaggtaagatatatgtgtaaatactaaaataattcagtgtgctctatattttcatgacagagcttttctttttattttgtccaaataaatggagaacatgagatataatccgaaaatcatacttttgaagtttagagccttatctgttttttaaagatttccccttgaagccattttttgtggccaaaattctcataaacaatatggttagttgcaatttcacattgaaaaatatcacagaataataatatagacttaatggtaaaaaggtattaactagacaaacattagtggaacagcaacgcagggaggaagggaaggaaaacaaaattttaagaaaagactgtttagtcatttcaagtttcaatccgtttacttccaagtgattagggctgcaatagtgaaatatacaaccttaaaaacataatttatagtttattatttaaatgacacttcattttcctattgcctgcaaattattaattaaaataatatctcttccctattcttcatcttttttccttttcttttctgtctcattttctagctcttgattctctctccttctatatcacctcataatctgatgtttcctcttcagtgaagtattttgtatgctggtaaacatgaaagtaatattattcagatttactgctgttgctatacctagggattttatttgaatttattggtacttgtctatcattcctaactgccctacagtaactgtcaaaaggtgaagttctgaatattaacccaaggaaatatttgaaatatgtaaatgaaaatattttatcacacacacacattctctccttcctaaacttcttatctcataaaagagtatctgatgccagagcatgaaaagtgtattaagagcttaacatcagtattaataactcagatttaaaactcttagcaattaattaagattaatgacagaagtcatccctttttctccaatgtaacacttcctcacatcttttcaatctctcattcatgagcccctccatgctcatttcaggctgtgaaaaacgaaggtcctgaaactttgatcctgttatctgctgctttttgtatctgagattaaggaagtagacactggcaaatttacaaccaacagctcggacagctgtcctactttaagcagttaatggaaaaggaactaatctagttaagagcataagactagttcataaatctggattcggaggacagttaaaaccgtcccacctcttctgaagagtagtaactgaattaaattctcttctcactgtttgttgagaagagccagtgtttctgtaaactggactaatgaggcactcagagctaacataagccacatataggccagcaccatagatgattatgcaaaagattaattaacattaaaatatatgatttggctaggacaaatacagatctcacaagaattccgatcattgaaaatttttcttaaatagaatatgaaataaagatcaaatgtttttaaaaaatgaaaaaaatgcaactgcaagcaaaaaaaaattctgaaaaagacaataaaaattaaaagccttcatttgttcaaaatttagcctaaaggaaaatgattgtgttatgtttttataattcagaaaatgttcaatagatttaattataatttaaaaattaatcatccaaactgactaattttagccccttataaataacatttttttgtatcatcatccttagccacatttttgcagaaaataattcaaacgttaaatttcagaattgttctgtcttatttttctcagtagcttaatttataagtagtaaaataacaagtaaagataacagaaatgtttaaattctacaaattcaaatgatacctctcttatgaatcactaggatctaatgcacatattaacttataatttatattcttaattataataaaactaagaggaactataatagacaaaattctgttcctcaaatcaatatctcatgcatatcacagggtaattatgttatctgatggcataggagactgtacccagaattagaaagttaaaatcttgaccctgctcactgagctgtgggaaccacaatggtgtgcttaagtctagtgggcctcagtttagatacatctggtgagggatagagcaaatgactgagagaaaagttatataactacaatttgaaagacatacatgaggaaaatggctaagtcccgctaaacacagataatgtagtgacaacagggggtcaaagcggaaaattcatataagctctcagagacatgcaagtggaattcaagagggaaggtcgcattgtctaagaatgatgtctaacgacgtctctaacaatgaggacaaagcagtggaagcctcaatcaatgttaggaagtcagacaagggagagaaatgaaagaattagagaaagataatgggagagtaatccctctttactccagaaatttatctgtatgctacgtatgtaaacatgatatttgaacgttttattgaaatgttttacagacttactaactcttttaggcaactaagatttgagatgggcatatgtgcatgtgtctgtgtgtatgtctcaccaatctgcactaggttccgccttaaagctatttaaataaaataaagtgaattcataattaactattaagaaatcattcatgtcaggaaatggctctagaaaacaaaagtgcttgatttaaaaaaattagaaaactctaatatgattcaaaacaaaagtatgcttagtactggatatgattatgaaatttaatatatatgatgtattattttcagtatactaacctgcttactaagaagcattatgggaacctaaagtatctttctgccacattttccaagtgaaaagagctctttaaggagaaagagatgatgtatatcagagaataaaattattgtgaaatggcaatgagtttgtagaaattatcccaactttataagttttttaaaagcataaggagaaaaaaaacttgtaattatttgaaactaagaaagtgttaacccaaagccagaaaaaataaaatggtaaacaaatgtccaggggtattctttcatttctccttattttctgtttccttctctctttttttatgttatttgcaaagtttgaaaaataaattatttttattttataactcaaaattatatcagtttcaaaattcttaaatgttagaggttggaatttgattcagagtacaattagtggaaaatataaataaaaattatatggaaaaatttttaaagaaattacttagtataattattactattgcatactactatatattagcttctatgttatacaaatcctagtgttttatttataaataaaaatgagagatatttagcaaagttgaaaaggcatttataagtacatttttaggaataaaggggcaataaaagcttcctactcaagccaatttccttaactgagttataaagctttccttaaactaaacttataaatggggttctggtagacacaaaggcaccatcataatgcattctatttaagtaacaaactgtctacaaaaaagatgcactgtatccccccttggactgggtcttctgagctctaaatttaaaaatgagtatttaacacatgtagaataatgtagatttctgtaaattattagaaattatagtaatttatttaaatatatatttaagcctctgtaataaaaagtatataaaaaccatacataaagtaaccaaaaaatggaaaataaagcttaaaattgtatctgtgttgacatttctgctccccattggatgatttaattgattctacatcacagccatacgttgagcctcagaaaataatgtgtttagtcctggaccaccaagacattttgaaagtattctttttttaattattgttatttttttaagatgggatcttgctctgtcacccaggctggagtgcaatagtgtgatcatggcttactgcagccttgacatccctggctcaagcaatcctcccacctcagcctcccgggtagctggtactacaggcatgttccactctaccaggctaatattttgtttgtattttttgtagagacggggtctccctatgttgcccaggctggtctcaaactccaggactcaagggattctctcatctctgcctcccaaagtgttgggattgcaggtgtgagccccacactcagccaaaagtattctttcagagtgccaaagctcactgatgatgatgaaaagaagttacatttctaaaaccagtgcattgagaagaggtatttacactaatcattttttgtttcttgtttatcaaaaggttgctgatgaaattttactcaagataaatatttatctaaacttggaaattaatacagaaaatgtatatgactccactaaatagctaataatgcctatatggggaggggagacaactaagtacccaagttctgtttatagattctttgaaaaaaaatatattttttggtaatttaaatgattaaattttgcatattctgcatttcacttcaggaaaccagactgagtcaacacttttgccaacttatatacctaattaagagattattttattgaaactaagaaatgttatcaaaaagcattctatttcatgaatttgttattttccactgaaacagttcatgatatacacagtgagcaaatatgtcctataagaatatatgcatatatatagttataaacatgctatatgcacattcatatatatatacacactctcctaaaacagtcagtgggatagtagtaaaaatggcatgttcatgagatggattattctagtaaaaatttatctttcaaatatgtataaactgaagttaattacttccattaatttaaatggaatatgatggtattttaaagacgccctgaaaggtaaaggccaaagataataataatgaaagataatataaagagcggaaaagactagtggtattcttttccagctttgttgcatcagaatcgccctaaagaaactataacaaatttcagatcttatagaaataaaaggtaaacaatgggtttacagtttttaaacatttttatattttctactctgtcactttaatatataaaaggaaatgaatagaaatacatgggcattttatacatgataggactgactcaattaggctacaataaagggttattttttctaaagcccctaaaatctgttacaaagttcagctatatggcacaaaatatttggatggaaactaaaaactaaatttaaaaatgtagccctttttcaaaacaatgatttttggggtaataatattgagtagcccaggctatcaatatacatatattttaatgattttttttaagaatgcagtcattagcagcataattctaggtactgaagacacttgaagcatcaaatcaattgagtgaaggttccaatctgcactgaaagacccactagtggttacacttcgcaactgtgatgggaacataatggcagtgtgatgcagaatctctaccatccagatgcttattatatttgaagatgacatggtttaagagtgccaagcactgggtgatttgttaacataatggagtacaaagccatccttgagaaggttgtaatcatttaagaagccaccattaaaaagggcaaggccagtgtgagcctgaaaattcacaagcaggactgaaaggcacgagcataaatttagaaattagagatgtaaacaagaggtagagcccaaagcctttgcctttgacgttatcaggattctcgggtcccttttaaatgaacttgtgcaacctgtcttctctgatatttttgtgggttttgctgtagatttaaaaaattggaggattgagatagtgttctgtcagactgaatattcttgagaaagcaatcgccgtcaatcatttcaaaaaaacgaaattacatctgcacaactgacaaaagtcctctcaatatactgaaaaatatttatgttgcttatttcaacaagacataaaaactttgctacatactaccatctgccctttggccattgctccctggctacttccctctccaaaggatacttttgagtcagcatctctcctttttctcaagaaagggagcctaaattttacgaatgataatattttacgttactatagaatctttattatcttaccattcccaggagctctttcttatcaggataatattgtaaccaattctattatgtcatatttacgtgtgcaaaattaaggagtttttgcagtatttccattgaaaagtcaacacattcttgaattttttgtttctggctgaatgtaggtagtagaggaggagaaccgcccaaaaagaaaatgtttgtttacttctgacttaacattttattttttatatgtaactataggaatgaagtctttatgaataggaattagttaaagtcaattcaattttgtaaattttgttttagtaaaaaattacatccatcggcaaagatttaatttaatttcatctccgtgtaataagaaaccttaaaagtttaaaaacaaatggtggatgtacttgacgagtgttactaggattcttcaaccgctgtatacacacttttatgtctgcttgctggtgaggagagactgccttctgaaggttaacataacctcgattacagccaagaagctccttggagatttaattggtttgtggaactactccaaaactagtgctgcgctttcttctttctttgcctttctgcttctctaactctctcttttcaaatcaaaaaggagaacgcatggtaatgcatcatttataaattaccttgttactgcgaaaaacaaaacactgctttgaaaaccaaacaaactcctgctgcggactccggcatgtttgatggaggcctttcaaaagagtccacggcttaatggaggttgtttatgtggagacttcgatctgtacctgctgtcccctgtcactccctggaaacttggcggcagatgttgcagcgttaagttgtctctgaagtggctttctgtcctcgtctccccaccgcaacggagtcaaactacattagatctcttatttgtgcctaaggcaagtttgggagcgcagctgtgtccaccccgactcctacctttggtgtttcaggcctccaggcagcgagagtgagaccaaaacggttttgccgctctcaactacctccgctgacaatccggccgctagctgcgggatggggaggccgctgccgccgctgcaaacagatgtcagcgacaacctgctagcttacacctggacgcgcggccctcacctcgcgcgccgcgctgaaacattcatgtctcggaggacttcccgccgcaatcaaagcccgggcccggcgtgcggcccgcggaccccgccacctctgcggaagctggcgcgcggaagagagcgcgagagagggcccgagcgggagactgctcgcccgctttgatactttctgcctgaacttcaattacttgatcaaggacttcaattcagcagtgaattcttccacaaacgtgcccggtgcggcctccgagccataagagccataaaaggggcgcatttggctggaaattcaccgtgacgggactcacagagtaaatgcgcgtgactctgggttgagttctaggaacgctgatttgtttatacaactaaacttgagtttcaagcggcagaatctgcagtaaacaattataaataaatgacaagattgttttcctaggtagaaaacatgctgttgactaggcagaggtcgtgttatttagaaccattagccacaacctgaaaacagctgtgttttattgtctctcaagtggcatgaagtttgttttgcctttttttagagtcactattatctcctttaaaaaaggaagcattctcatttacttcttgacaatacacatcaagttccatccatttctaactaaaaaaattgtttaaactcttcctgatttctacagtttaaaaattgctttataagcacacacatggaacttgtatacctgtataaatacttcataagaaccataatcaaaagtaaatattatgcatatatacacacaaaaaccattatgagcacagaacacacaggaaaataaaattatttgcaagatatattcaccaatttacatgttgataagaaagtttattttaaaaagaattgaccttaacagacaataacatttgttccagtgaactttttgctatgcatagacaattcttttagagggaatcagtgtatctaatctaagctgatacaatgctatttacaaatttcctaatattcctaatatcagataatttgttgagaacatagatttgttgatataaaagtgatatacattttcaaagggcaatggacatctcttaaaaatataaaatctttcatgaattggtctcagttcaacgtttttcatttaatcagattttgattgacattagggatgtaaatttgcaaacaataggatttcacccttgcttagagcccaattgtaggtatatgtgattatttaaagctaacaaaagaactccaggactaatttttctcattcaatgaatgattatgctaggacttagacacacacacacacacacacacacacactactctaaagacaattcattttctcctttcttgaagcaaatataaatgtaggtagatagttatttaaagaacagccagagaagtagaggatactaccacttgggcatcgtagtcccctaaattttaattttctttagtacatgtaattccatgagataaaccacatctacataaactaaattggtaaaaaccataaggttcagtaactttaattttttaccaactaaccacagtaagtagaaggtagtggtgagctatggatgtcttctcgtgcatagataaagcattaccaaagcagatcatcccattttaatatgatgcatccaaattagctgtgccaaatatactctaaattcctgatactcttcctgcctctgcgtcattattttctgaataggtaaattactgtaagttccccaaatgaaagatactctaaagcaaaaaagaactgaaatttaagaaatattatgtgctctttctataaaatagaaataaaatttgtaggatattagagtctcaatacagattatatcactgccccatgcaaatatgattttatttaaacaaataatgaaatattactttttggataatactatttttatgtttacattattttagagacttaaaaaaatcactgaaatatttaccatgattaaatggcctgtgattgctgcacattctttttggcacaagttgcctttgtcaatcaagatatttactgtgctggcgactataagaatagggcgtccggggaggagccaagatggccgaataggaacagctcaggtctacagctcccagcgtgagcgacgcagaagacggtgatttctgcatttccatctgaggtaccgggttcatctcactagggagtgccagacagtg

SEQ ID NO: 2499 - DNA, 14313 bp, Homo sapiens
catttacttcaaacataaagctactaagattatttttgattgaatcatttttagatgtatttatcaacattctactgaagaaatgttccactgagcaaactattaaatggtaatgttagaatgcatgaaaaattaacgtaaaatcataggtcaaacagaaatgtaacactatagatctagtttggaaacaattaacagctaaagcccaggatatgactaaagagaaaggatctctgcttagattacagaatggaagaaaataaattctgataactaggtaattaagtttggcagctagggatgaaaaagacaactgaaaataaaatatggaagaagtaagaatgaaacacagcaagtactcttttgagaagaaaaagagttaagatttttctgtcccagcactttttgaatctaagtcccgtaatatatataaaatgagggattagactatattgcctctaccaggttattgcaagcacttaaacttgtaattctcatataaaataaaaaaaacaaaaagtatattcttccaatattttccttaaatatttacacattacatgatacattttatttgtgaataactttaatactcttaaattagaatgttataaatgctattaagttatctgttttaatataaggtgtgtgtgcatctagtaataggaagaaaagaaggaaggaagaataaggacgacaaaagaagagagggaaggaaagaaaaaacttgtcaaatatttcatagctgatctaattttgtgctctttttttctgtgccacatttattcccagaagtttctttggtggatcaagagatgtgaagccagtgcctggtatggaggagatgaacatacctgaatctctcaattttaatgacaatttatttttttactagacatatagacatcctaaatatatatattatgaaaatttcatattatattaaaaggaacattgttcctttttgttactttattaaatttaatttttttaggacaggatcttgcacttttgcacaggctggactcaatcatggcttactgaagcctcgaaatcctgggctcaagcaatcctctgtgtctctgggactacaggaacatacatgccaccgagcctggccaatatttttttttcttttttttttagaaatagactttatgtatttaaacataaaaactgtgaaaaagaaatcatcagaattcaggaggtagatgatgagaaggggaagatattgatcaaaaggtacaaaacttgcaggtataaaatgagtaagttctggaaatgtacaacatgatgacgtaacatagttaataatcatatatgcttgaagtgtcctaaaattattttaaaaatgccaacttttattttcaatacagggggtacatgtgcaggttttttacatgggtatattgcacccaggtagtgagtatagtacccaataggtagctttacgatgcatgccccctccttctccctcctccagtagtcttcagtgtctattcccattcttaggtctatgtatgttcaatgttttccttccacttataaatgagaacatgcagtatttagctttctgttcctgcattaatttgctttggaatgatgaaccctagctccatctagtttgccacaaatggcattatttcattcttttatgactgtgtagtattagatgttgtatatgtaccacattttctttatccaatctaccattgataggcgcctaggttgatttcattatctttgctcttgtgatgtttcatgttcagtgctatggcaatgaacatttgggtgcatgtatctttttgtataaggatctgttttcctttgagtatgtgcctagtaatgggaatgctaggtagaatggtggctctattttaagttctttgagaaatctccaaattgctatctacagtgtctgaactaattttcattcccaccaaaagtatgtaagcattcagctttctccacaccctcatcaacatctgttatagtttacttaatagtagccattctgactggtgtgagatggtatctcattgtggttttgattggcatttctctaattcgtgatgataagcattttttcatatgtttgtgggctacttgtatgtcttcttttgaaaagtgttgatgtccttttcccatttttaaatggagttatctgttttttacatgttgacttgagttcttcgttgattccggagatgagacctttgtcagatgcatagtttgcagatatgttctcttgttccgtaggttgtctgtttactctgtttatagtctttttgttgttgttgtttttgttgttttttttaaatgcagaagctctttagtttaactagctcccatttgtcaatttttggttttgttgcaattgcttttgggaacttggccaaaaattctttgtcaaggccaatgttgataaggaaatttcctaggttttcttctagggttttttatagtgtgaggtcttccacttaaatctttaatctacattgagttaatttttgtatatggtaaaatttaagggtccactttcattcttctgcatgcttgtttatctcagccttgttgaagatcagatggttatagggtgtggggctttatttctgtttcttattctgatctattgatctgtttgtttttgtaccaataccatgctatttggttactgtagccttatagtatagtttgacgttaagtaatgtgatgcatctagctttattcttcttgcttgggattgttttggttatttgtgctcttttttggttccatgtgaattttagaatagttttatttttttaattctgtgagaatgaccttggtagtttgataggtataacattgaatatgtacattgctttgggcgctgtggccatttcaatgatattgattcttctaatccatgaacatggaatgtttttccatgtatttttgttatgtctgatttatttcaccagtgttttatagttcttattgtggagatctttcaacatactactggaagtcttagccagagcaatcaggcaagagaaggaaataaagggatctaaatagaaaaagaataagtcaaactatctctcttctctatgattccatagttagaaaaccccaaagactctgccaaaaggctgctggaacttataaacaacttttgaaagttttcagaatataaaataaatgtacaaaaactcactagcatttttatatactaataacatttaggctgagagtcaaatcaagaacgcaatctcatttacaatagctacaaaaaaatgaaatatctatgaatacagttagccagctaattaaataaaaaatttctatatactgggtctccttatgttgttcaggttggtctcaaacccctggcctgaagtgataccttggcttcccaaagtgctaggaatcacaggtatgggcctctgcacctggccaaatttaaaaaaaaattgattgtttaactgtcatacatgccttgatttcagaagatattttacatttggtgaaaaatgagcaaatttgagctcttcatctgatgagaaattcaatctaatcagaattgtctttttcaattgcaaagtgtaattttctcaaggatcacatattataatatctatattagtaaattactatacacacatttatttaactcattgtcttatgaatgctttattaagattacatttacattgcaagtagagattagttatcctgagagacaaaaatctacaactagatctgactgacatgattaaaaaataacagattgtgttgcttataaaaaaagggtagtgttggcagaataacctgcaacaatgcttgatactttctaacatctttttcattgaaaaaagggatttaacattctataagtattgtagccatgatgtaaatggatacaacataaaattaaggaaattatattttattaaatgatacaacatataagtaaaatgtatttatagatttatgcatacatatttcaattaattttcctatttgatatcaatatgcttctccaaagtaataaattaagtctcactaaaataaacaagatgaagaatttggaacaaaacctcaaagcctctcaagaaattgtttctagattgtgaagtaaatagttgtcaggctgtagctctcatttttattcagctcttatatttgccagcttttgatgttatggctattaacttttatagatgtcatacatttttatgttaatcgttcagctttttgtctggtgagtagctagacttgtgttccttgaacaaattatatgagcaaattaccacatgccttcaacatctttaaaaggttttgtttcctgtttgtcattttagaattgatttttaaaattaagaatatttcaaatacttattgataatggacaaaatatgtttactctttttgtgaggtcatctttaagataatataagagttgtatagttcaaataaactttctcaaatttattagaagacaaataaatgtttatattcatataagtcaaaatactacatcaaattttacatagtaaaatatttatgatttatgtgcaacagatatgttatgtaattatttccctttatctcttttttttctcattatagaacagctgtcatccaaacattttgatggaaacttcacttttattaaggaatatttttaacatatattcttataaatattttagatctagcttctaacataaacataattgcaattatatctcaaacttaaacaaaaatattctagtatattcaaacatttcattagtatttaaactttcaatcttcctgtaagttctatattttataaaatatatattaaatttgaagcatttgttttaaaaggatccaaataaaattttcatattgttagaagttgataggcttaattccatgtgtgtcttttctttttccttggaatgtgtttgttactgaaactgaatagtttgtttttgtagttttctacagtatgtttcagtctgattgcatcactgcaatggtgtttaacatgttccccttttctccctatattacctatttatttgtagttgtagtcaagaaatgaaagaaggccaaatttaattgactttgttttggtttcattttgatacagttatgttataggaagaactggtttgtctctcaaattttcttaacagtactttattcatatgtactttacatattgagcataaacattaaatatacagtcccatgaactgtgatacatctatgtacctgagtaagtaatatccagatcaggatatagatttctattactccacaaagtttcttcatgctcctatccagacaagcccccatctccctgctcactacccccatgagcgaccactatgatttttatcaccatggactgctccttaacttgacatgtattcttttgcatctgacttctttcttccctcaggcttttgagactttcccatgttttaaaagtattgatagtattttttcatcaaattatttccccgtaagaattagatcacaggttgtttttcctgtctcctgttgatgaacattgatgggattttttattttgggctcttatgaataagctgccgcaaatatctttagagaagtcatcttatgtgaaaaacgcattcacttttcttgcagtcaaatgtcctaggagtagaattggtgggtcataggatgacaactgaaaaagaattttccatcttgattgcactgttttagactcctaccggcttcgtaggagagttctcgtcgtaccacactcttggcatcacttgttattgtctgttttcgtaatggaacgtttgggtgggtgggctatctcattgaagttttaacttgcagttcatctataattaataatgtgccatggagatactttcttattatgtgccactcagctatcttcttttataaagtgcctgttaaagtctttagcccaatttttaaaaattgagttattttctctcgcttgtaataatttgtgggtattttcaaaactattttctagatacaatttcttgttcagtttgtgtattgtcaaatatattacattattaacctgcctgtacagagcagtagtttctaatactgataaacttttacctattaatattttttcttgttcttaacacttaaatcttgactaaaaaaaaaaaacttgttcactctgaaatcatgaatatttatgttttcatctagaaatgctatagttttagcttttatagccttagcttttaaatttagatttataacccatccggaattattttttgtctatgatgactgctggggctaacagtttaatccttttgatttgttattatgactattaaaatgtaaacaaatgtaaaacaggttattgaggcaaaaactattttcatggtgtctattcaatatcttcatgaacataagtatccttgagggaattttaaaattgcacccattttgtgaaattatttcgtattctatttatgttttcatttatcattattatcactcctgaattagtaaatgctgttaataatcaacaaacttatacaatcacagtctttgaattctttttttttttttttttttttactttttcctcaagcctttatcctatatcaggtgttgtacttggatttagacattttggaaagtatccaactgtttttgtaatttcggtagtagcagtacaacttgttccctaaaaagctaaatagccacaacaaatgtacaatgatcggttagagtgggactgagaggcaatgtttcccaatatgtagaggagggattcagaaacatttaataatggtgtgatcctgtataacttactttatctccttgtgtatctccttgtttataagataaaatcatgatagtgtctgctgatagggttatggggattaaattaatgttaacatttgtaaagtgtttggaatggtgtcaaccacacagtaaaattatataattgctttactattactattgtaagattttttttgtaaggggacctgagataattttgttttttgaacaaagagaaaacaataaaaaattctaaccaataaatgatacagtgtgaagttcagtctaattagatatacaagtaaaccttatccaaccataggacaatgaattgttgcaaaatgatcatggcttgaattatggtttttttgtttgttttaaataaggaaactataaagccactctttataagcatttataaaactgtggctccataatggtttctcattatttaggtaaagtgacattgaagataaaatacatattttctgcagaatagttaaaaatttctatagcataccaacaattttagatcactttatatgttatgaaattttccttagttgattgaactttaagagaaaaatgtgactaaggaaaataaaaagaaatcttattttcttaaacaaatatgttacattccatatacaagtttggaaattcattatacttaacaaatttaacatgtatgtctgaacccagtttcactctggaaccaataatttgaaatgttccttatctataaatagaaattagttgaattagacagaatggcctagtttcacttatgtgaaaattctcttgtatgatatgttcgatttggaagataatattctgctcattttgttatacagattaaggaagtaaacagatcccctttactttgtaccctgttaaaaataatttcataaaatgaagtttcactcattggggacattttttatcctgaaatttttgatgaaatattcaagttttaccttgtataatgacaataaaattctttttgagatctgtagcattcagtgccttgattcaatagtaccagcaatgaaagttgaagcaatgtctaattcagtccctttatcttaaagagctagaaatatttatagatttgattttattttgaatacatttaaataaatgaggtaggtaattattagtgtgcatacgggtgcatccccaaatactgtaaatcaccaaaagttttcagcagtataagcctcctcatttttattatactattgatctcagtatcttatgtaaaagtagttacatttcttggaatattttgtcacctctccacattatttcacaatgggacacatatcagaagtagtttaatttaataaacaacatacatttatcaagcacttagcatgtatcgagcatggctgttaatgctgggggttgaaagaaacagccgtttctcccttcactgaagttacattctgtctgggtagaaaatttaaaaataataaaaatgccatgttaagagtaattaataagactgtatataaattgcaatggtcaaacaagcggttgataaaggagaagtgtgcccagtaaagcaagggcattgcttgaaatgagttatggaagtataccacaaccattttagtatgatttagagttaaaactttagttcccatttgattattgcacttgattcatttactatatcagttcacatttattccatattaataaatgatgattcatgatgcaaagataaaaattaagttgtcaaattgatttttaaaataaaatatatattatcagatacataaatatgataaatatatttcattatttctttagagacaattatttatgtgtagaactagctgatatagaatatgtagaaattatttcagtgtttacaagtctacaaacagtgttacaagtttacaaatatatatatatatatataatatatatataactaaccactttactaaaagttaactatagtaactacttaactacaaggtgtagctactacttactacttaactactatactaactatatatgtatatagttatatatgaggaagaggtaacgggagagagggaaagattatgaaaatttgccatatgactatggaggtagagaattcccaccagtttaccatctataagctataaaaccaagaaagctcatggtgaaattcaaagtttgaaggcttgagaaccagacgaggcaatgttgtaactccaagcctgagtgtgaaggcacaagaaccatgagctctgatgcctaataccaggagaaatgatagaatttgcccttcttctgccttttttttttcttttcagaccctcaactgattggatgatgcccacccacattggtgagggcagatctttaccccatctactgattcctatattaatctcttccagaaacattctcacaggcacacctacaagtaatgttttaccagctatctgggcattgcttggcccaatcaggttgacatgtaaaattaaccatcacaagtccatcactgggtacccataggtatttccttgaaccatacttaataaccaaataaagacaataacaagatcataattctgcttaacattatacaactatcctgcctgcaaccaaaatggaactaattctttcctctgaagtggaggtaaaatcctggagtaatttttactcttgatatctcgtaacttagaaactaggatgtgaaattaacaataactaagtagagatgctcttcgactggtgatcttatgtctctgtaaactcttcataagttataaatattattaagtcagaagttcacatttgacttaatacgttcaacttacaaagggtttatcagacataactccatcataagttgaggagcatattgaatgcatatcactttcacaccattgtacatttgaaaaatcataagttgaaccatcataagctggggactgtatgtaatgttatgaggtcaatatctattacatttcataatataggagaggggaaaaacaatagatttgcttaatatatgtatatatgcataccaacatatttataacaaaataaggaggaaatattcatgatactggcagttctcattactttagcaagtcattcggttatagctggtatttataacgaccttcttctactacccatttcatattccctttgccttcaacaatcacttccactggtcatggttctttatttggtagggtgacccagatcttcatatctgaatagcctggactattgttagtcctgcttagtttgggttgttgtagttttcaatcaccttaatcacagggcgtgatattactaagagaagttctaagatatcttctgtattccagacatattcattcgtatctacattgagaaatattagtccaatttccctttggtaataaggattaatcaccctagccagtgcaataattcccttctttgcctgttgattcagatacatgagaagtacaaggtatctgagtggcagccttgactcccagttcagtggaattatcattgtgtctcttggtggaagcactcttctttctggaaatgagacctgtaggccagcagagtataaagttatagaaacagggagcacaaatgtagatagtgagtcactagaggtaatgctgagtggtaccactcccatttcttttgcttggttcctggacccataaatcctggctatcagagaaacagaaccacatatagtggatgctgattcagagcctatacagtcttctgtaggaccctgacccaaccccacaaggtattatcaccttgctggaattggaacttgagtcttaaaaaggtcatttcactgttctgtcaaggcagctgcctcaggatgatgggaaacatagttgtaccagtgaattccatgagcatagcccatgactgcatttatttgtctgtcaaagtggttcattgatcagaaacaatgctgtgtagaatatcataacagcaatcaaggaattctataagtgcatagatggtagttttggcagaaacattgtatgccggaaaggaaaacctgtatccagaataaatgtctattgcaataaagataaaacactgccccttccatgatggaaacagtccgatgcaatcaacttgccaccaggtagctggctgatcactctggggaatggtgccacatcagggactcagtgtgggtctctgctgctggcagattgcgtatacaacagtggtcatagcctggtcagccttgatgagtggaagtctgtgttgctcataccatgcctaacttccatccctgcctccgtggccactttgttcataaacctattggatgacgataggagtgcctggggaaagagactgactggtatctatataataggtcatactatccacttgattattaaaattctccactagctaggtcaccctttgataagtattcacatgggactcaaatattattatttttcattctgagaggtcagtccacatacttcctccccaaatttctttgtcaccaattttccaatcatgttccttccaagtcccagaatagccagccaaatcattggctacagcccatgaattgatatataatcacacatctggccatttctccttccaagcaaattcaaaacaggtgcactgcctgaagttctgcccattgagaggatttcctgttacaactgtcattcagctatgtcccagagtggggttgtagtactgcagctgtccactttcaggtcatgtctgcatattgtgcagaaccctctgtaaacaaggccaaagttttctttttctctgtcaactttcatagaacactccccatgaggctagaggtgcaggctgggaaaaagaaggcatgtgtcaggagtggggaccatggctgtttggaccacttcttcatgtacttacttgtgcattcagggcctcctcaggatcaatcacatacgtaccatttccatttgaagatgcagtgcatgcacaactttatggtgtggtgagtcagataacactcagtttattatgggcagaacaagatggattttcccctgcctttttgttctattcagattgtcaatgtattggatgatgcctgcccacactggtgagggcagatcttctttactcggtctactgattcatatgttaatctatccagaaactcccatatattcacagacagaaataatgttttaccagccacctgggcatcctgtagcctagtcaagttgacacataaaattaaccatcacagtctttacttaaaaatcaaatatagccaagcacgatggctcatatataaatattcccagaactttgggaggataagtcaggaggaatgctagaggccaggagtttgaggcttgcctgggcaccattttatgaccctgtctctacaaaaaaaaaaattaaaagttagccaggcatggtgacacatgcctgtagtctcagctacccaggaggctgaagcaagaggattgcttgagcctggaaagttgaggctgcagtgagctgtcattccctccaaactgagtgacagagtggaacactgtcttaaaaatatgtaattttggccgggcgcggtggctcactcctgtaatcccagcactttgggaggctgggggggttggggggtggatcacaagatcaggagttcaagaccagcctggccaagatggtgaaaaaaaaaatatatatatatatataaatatatataaatttataaatatatatataatatataaatacatataaatatataaaaatatatttataaatacatataaatatatatttataaatacatataaatatatataaacatatatttataaatatatataaacatatttataaatacatataaatatatataaatatatataaatacatatatatacttttttttttctaagttggcgtctcactctgtcactccagtccagtggcacgatcactgcaacctccacctcccaggttcaagcaattctctgcctcagcctctcaagtagctgggattacaggcacttgccaccacacccggctaatttttttgtatttttagtagagatggggtgtcaccatcttggccaggctggtcttgaactcctgatctcgtgatccagccccgctcggcctcccaaagtgctaggattacaggtgtgagccatcgcgcctggccaaaattacacacacacacacacatgtgtctgtgtgtgtgtgtgtgtgtgtttgtgtgtttgtaattgttttcaggagctagagaaatttcggttacatacacacaaacattcacttatcttttttctgagtaactgcaatgaatttatcatgaaatatggtaaacttctgtaccactagtttctacttttgttcatcgtctggttttcccctattatcttgggcacatttcctttaagccccatgaaaatagagaatctgttattattgtgttaaactatgtcttacttttctatcaaatatattttggtaaaactaaaaaatgaatttaaatgttcattgattttaatgaggacctattgtatgctgtacttgctggatgttccacagctataaaacaatagtgagccagcagatttgggtgggaacaacatcttcactatttcagacaagtcactaggggcatagcttccattcttacagttcctaaaattatcagtgtgggctcatgcccaagcatattatgaaagctgccctttgtaatatatttgtgacatcttatgtggtcataaattcttgaatactttttggctattaggatggttaacctctgtagcttagatatcctatgtcacaaacatacatgagaactaattttaaggaatagtaaaatacacttcatatgtggaaagaggatggctgacattcttaggggcagaattatccagaaagtttatatagtttgtgatattgctggaccattactccaaagggtaaatgctgtatgttttagtgatcttgggtggctataacaaaacaccacagactgtgtggcttaagcaacaatttatttttcacagttctgcagacccagaaatccaaggttaaggaaatggcagattcagtcttggtgagggcccacttcctgactctcctatcctcacatggcagaaagaacaagctctgatgtctcttcctcccttaagaaggcactaatctcatcacaggacttcattctcatgaggtcatttaaccaaattacctccccaaagccacaccttctaataccatcacactagcagtcaggatatcaacatggatttcaaggagatacaaagattcaatccataacactgcccatacactgaagatttcaaactcatgagtggcattataaaaatttgaagaaggtgacaagtagttatgtagaggagcagtttgagccaatttgagtcaataagagtttccttttctctgcatccttgccagtatctgttattgtttgtttatttaataatagctattctgacttgggtgaagtgatatttcattgtg

SEQ ID NO: 2500 - DNA, 10817 bp, Homo sapiens
attttacatttggtgaaaaatgagcaaatttgagctcttcatctgatgagaaattcaatctaatcagaattgtctttttcaattgcaaagtgtaattttctcaaggatcacatattataatatctatattagtaaattactatacacacatttatttaactcattgtcttatgaatgctttattaagattacatttacattgcaagtagagattagttatcctgagagacaaaaatctacaactagatctgactgacatgattaaaaaataacagattgtgttgcttataaaaaaagggtagtgttggcagaataacctgcaacaatgcttgatactttctaacatctttttcattgaaaaaagggatttaacattctataagtattgtagccatgatgtaaatggatacaacataaaattaaggaaattatattttattaaatgatacaacatataagtaaaatgtatttatagatttatgcatacatatttcaattaattttcctatttgatatcaatatgcttctccaaagtaataaattaagtctcactaaaataaacaagatgaagaatttggaacaaaacctcaaagcctctcaagaaattgtttctagattgtgaagtaaatagttgtcaggctgtagctctcatttttattcagctcttatatttgccagcttttgatgttatggctattaacttttatagatgtcatacatttttatgttaatcgttcagctttttgtctggtgagtagctagacttgtgttccttgaacaaattatatgagcaaattaccacatgccttcaacatctttaaaaggttttgtttcctgtttgtcattttagaattgatttttaaaattaagaatatttcaaatacttattgataatggacaaaatatgtttactctttttgtgaggtcatctttaagataatataagagttgtatagttcaaataaactttctcaaatttattagaagacaaataaatgtttatattcatataagtcaaaatactacatcaaattttacatagtaaaatatttatgatttatgtgcaacagatatgttatgtaattatttccctttatctcttttttttctcattatagaacagctgtcatccaaacattttgatggaaacttcacttttattaaggaatatttttaacatatattcttataaatattttagatctagcttctaacataaacataattgcaattatatctcaaacttaaacaaaaatattctagtatattcaaacatttcattagtatttaaactttcaatcttcctgtaagttctatattttataaaatatatattaaatttgaagcatttgttttaaaaggatccaaataaaattttcatattgttagaagttgataggcttaattccatgtgtgtcttttctttttccttggaatgtgtttgttactgaaactgaatagtttgtttttgtagttttctacagtatgtttcagtctgattgcatcactgcaatggtgtttaacatgttccccttttctccctatattacctatttatttgtagttgtagtcaagaaatgaaagaaggccaaatttaattgactttgttttggtttcattttgatacagttatgttataggaagaactggtttgtctctcaaattttcttaacagtactttattcatatgtactttacatattgagcataaacattaaatatacagtcccatgaactgtgatacatctatgtacctgagtaagtaatatccagatcaggatatagatttctattactccacaaagtttcttcatgctcctatccagacaagcccccatctccctgctcactacccccatgagcgaccactatgatttttatcaccatggactgctccttaacttgacatgtattcttttgcatctgacttctttcttccctcaggcttttgagactttcccatgttttaaaagtattgatagtattttttcatcaaattatttccccgtaagaattagatcacaggttgtttttcctgtctcctgttgatgaacattgatgggattttttattttgggctcttatgaataagctgccgcaaatatctttagagaagtcatcttatgtgaaaaacgcattcacttttcttgcagtcaaatgtcctaggagtagaattggtgggtcataggatgacaactgaaaaagaattttccatcttgattgcactgttttagactcctaccggcttcgtaggagagttctcgtcgtaccacactcttggcatcacttgttattgtctgttttcgtaatggaacgtttgggtgggtgggctatctcattgaagttttaacttgcagttcatctataattaataatgtgccatggagatactttcttattatgtgccactcagctatcttcttttataaagtgcctgttaaagtctttagcccaatttttaaaaattgagttattttctctcgcttgtaataatttgtgggtattttcaaaactattttctagatacaatttcttgttcagtttgtgtattgtcaaatatattacattattaacctgcctgtacagagcagtagtttctaatactgataaacttttacctattaatattttttcttgttcttaacacttaaatcttgactaaaaaaaaaaaacttgttcactctgaaatcatgaatatttatgttttcatctagaaatgctatagttttagcttttatagccttagcttttaaatttagatttataacccatccggaattattttttgtctatgatgactgctggggctaacagtttaatccttttgatttgttattatgactattaaaatgtaaacaaatgtaaaacaggttattgaggcaaaaactattttcatggtgtctattcaatatcttcatgaacataagtatccttgagggaattttaaaattgcacccattttgtgaaattatttcgtattctatttatgttttcatttatcattattatcactcctgaattagtaaatgctgttaataatcaacaaacttatacaatcacagtctttgaattctttttttttttttttttttttactttttcctcaagcctttatcctatatcaggtgttgtacttggatttagacattttggaaagtatccaactgtttttgtaatttcggtagtagcagtacaacttgttccctaaaaagctaaatagccacaacaaatgtacaatgatcggttagagtgggactgagaggcaatgtttcccaatatgtagaggagggattcagaaacatttaataatggtgtgatcctgtataacttactttatctccttgtgtatctccttgtttataagataaaatcatgatagtgtctgctgatagggttatggggattaaattaatgttaacatttgtaaagtgtttggaatggtgtcaaccacacagtaaaattatataattgctttactattactattgtaagattttttttgtaaggggacctgagataattttgttttttgaacaaagagaaaacaataaaaaattctaaccaataaatgatacagtgtgaagttcagtctaattagatatacaagtaaaccttatccaaccataggacaatgaattgttgcaaaatgatcatggcttgaattatggtttttttgtttgttttaaataaggaaactataaagccactctttataagcatttataaaactgtggctccataatggtttctcattatttaggtaaagtgacattgaagataaaatacatattttctgcagaatagttaaaaatttctatagcataccaacaattttagatcactttatatgttatgaaattttccttagttgattgaactttaagagaaaaatgtgactaaggaaaataaaaagaaatcttattttcttaaacaaatatgttacattccatatacaagtttggaaattcattatacttaacaaatttaacatgtatgtctgaacccagtttcactctggaaccaataatttgaaatgttccttatctataaatagaaattagttgaattagacagaatggcctagtttcacttatgtgaaaattctcttgtatgatatgttcgatttggaagataatattctgctcattttgttatacagattaaggaagtaaacagatcccctttactttgtaccctgttaaaaataatttcataaaatgaagtttcactcattggggacattttttatcctgaaatttttgatgaaatattcaagttttaccttgtataatgacaataaaattctttttgagatctgtagcattcagtgccttgattcaatagtaccagcaatgaaagttgaagcaatgtctaattcagtccctttatcttaaagagctagaaatatttatagatttgattttattttgaatacatttaaataaatgaggtaggtaattattagtgtgcatacgggtgcatccccaaatactgtaaatcaccaaaagttttcagcagtataagcctcctcatttttattatactattgatctcagtatcttatgtaaaagtagttacatttcttggaatattttgtcacctctccacattatttcacaatgggacacatatcagaagtagtttaatttaataaacaacatacatttatcaagcacttagcatgtatcgagcatggctgttaatgctgggggttgaaagaaacagccgtttctcccttcactgaagttacattctgtctgggtagaaaatttaaaaataataaaaatgccatgttaagagtaattaataagactgtatataaattgcaatggtcaaacaagcggttgataaaggagaagtgtgcccagtaaagcaagggcattgcttgaaatgagttatggaagtataccacaaccattttagtatgatttagagttaaaactttagttcccatttgattattgcacttgattcatttactatatcagttcacatttattccatattaataaatgatgattcatgatgcaaagataaaaattaagttgtcaaattgatttttaaaataaaatatatattatcagatacataaatatgataaatatatttcattatttctttagagacaattatttatgtgtagaactagctgatatagaatatgtagaaattatttcagtgtttacaagtctacaaacagtgttacaagtttacaaatatatatatatatatataatatatatataactaaccactttactaaaagttaactatagtaactacttaactacaaggtgtagctactacttactacttaactactatactaactatatatgtatatagttatatatgaggaagaggtaacgggagagagggaaagattatgaaaatttgccatatgactatggaggtagagaattcccaccagtttaccatctataagctataaaaccaagaaagctcatggtgaaattcaaagtttgaaggcttgagaaccagacgaggcaatgttgtaactccaagcctgagtgtgaaggcacaagaaccatgagctctgatgcctaataccaggagaaatgatagaatttgcccttcttctgccttttttttttcttttcagaccctcaactgattggatgatgcccacccacattggtgagggcagatctttaccccatctactgattcctatattaatctcttccagaaacattctcacaggcacacctacaagtaatgttttaccagctatctgggcattgcttggcccaatcaggttgacatgtaaaattaaccatcacaagtccatcactgggtacccataggtatttccttgaaccatacttaataaccaaataaagacaataacaagatcataattctgcttaacattatacaactatcctgcctgcaaccaaaatggaactaattctttcctctgaagtggaggtaaaatcctggagtaatttttactcttgatatctcgtaacttagaaactaggatgtgaaattaacaataactaagtagagatgctcttcgactggtgatcttatgtctctgtaaactcttcataagttataaatattattaagtcagaagttcacatttgacttaatacgttcaacttacaaagggtttatcagacataactccatcataagttgaggagcatattgaatgcatatcactttcacaccattgtacatttgaaaaatcataagttgaaccatcataagctggggactgtatgtaatgttatgaggtcaatatctattacatttcataatataggagaggggaaaaacaatagatttgcttaatatatgtatatatgcataccaacatatttataacaaaataaggaggaaatattcatgatactggcagttctcattactttagcaagtcattcggttatagctggtatttataacgaccttcttctactacccatttcatattccctttgccttcaacaatcacttccactggtcatggttctttatttggtagggtgacccagatcttcatatctgaatagcctggactattgttagtcctgcttagtttgggttgttgtagttttcaatcaccttaatcacagggcgtgatattactaagagaagttctaagatatcttctgtattccagacatattcattcgtatctacattgagaaatattagtccaatttccctttggtaataaggattaatcaccctagccagtgcaataattcccttctttgcctgttgattcagatacatgagaagtacaaggtatctgagtggcagccttgactcccagttcagtggaattatcattgtgtctcttggtggaagcactcttctttctggaaatgagacctgtaggccagcagagtataaagttatagaaacagggagcacaaatgtagatagtgagtcactagaggtaatgctgagtggtaccactcccatttcttttgcttggttcctggacccataaatcctggctatcagagaaacagaaccacatatagtggatgctgattcagagcctatacagtcttctgtaggaccctgacccaaccccacaaggtattatcaccttgctggaattggaacttgagtcttaaaaaggtcatttcactgttctgtcaaggcagctgcctcaggatgatgggaaacatagttgtaccagtgaattccatgagcatagcccatgactgcatttatttgtctgtcaaagtggttcattgatcagaaacaatgctgtgtagaatatcataacagcaatcaaggaattctataagtgcatagatggtagttttggcagaaacattgtatgccggaaaggaaaacctgtatccagaataaatgtctattgcaataaagataaaacactgccccttccatgatggaaacagtccgatgcaatcaacttgccaccaggtagctggctgatcactctggggaatggtgccacatcagggactcagtgtgggtctctgctgctggcagattgcgtatacaacagtggtcatagcctggtcagccttgatgagtggaagtctgtgttgctcataccatgcctaacttccatccctgcctccgtggccactttgttcataaacctattggatgacgataggagtgcctggggaaagagactgactggtatctatataataggtcatactatccacttgattattaaaattctccactagctaggtcaccctttgataagtattcacatgggactcaaatattattatttttcattctgagaggtcagtccacatacttcctccccaaatttctttgtcaccaattttccaatcatgttccttccaagtcccagaatagccagccaaatcattggctacagcccatgaattgatatataatcacacatctggccatttctccttccaagcaaattcaaaacaggtgcactgcctgaagttctgcccattgagaggatttcctgttacaactgtcattcagctatgtcccagagtggggttgtagtactgcagctgtccactttcaggtcatgtctgcatattgtgcagaaccctctgtaaacaaggccaaagttttctttttctctgtcaactttcatagaacactccccatgaggctagaggtgcaggctgggaaaaagaaggcatgtgtcaggagtggggaccatggctgtttggaccacttcttcatgtacttacttgtgcattcagggcctcctcaggatcaatcacatacgtaccatttccatttgaagatgcagtgcatgcacaactttatggtgtggtgagtcagataacactcagtttattatgggcagaacaagatggattttcccctgcctttttgttctattcagattgtcaatgtattggatgatgcctgcccacactggtgagggcagatcttctttactcggtctactgattcatatgttaatctatccagaaactcccatatattcacagacagaaataatgttttaccagccacctgggcatcctgtagcctagtcaagttgacacataaaattaaccatcacagtctttacttaaaaatcaaatatagccaagcacgatggctcatatataaatattcccagaactttgggaggataagtcaggaggaatgctagaggccaggagtttgaggcttgcctgggcaccattttatgaccctgtctctacaaaaaaaaaaattaaaagttagccaggcatggtgacacatgcctgtagtctcagctacccaggaggctgaagcaagaggattgcttgagcctggaaagttgaggctgcagtgagctgtcattccctccaaactgagtgacagagtggaacactgtcttaaaaatatgtaattttggccgggcgcggtggctcactcctgtaatcccagcactttgggaggctgggggggttggggggtggatcacaagatcaggagttcaagaccagcctggccaagatggtgaaaaaaaaaatatatatatatatataaatatatataaatttataaatatatatataatatataaatacatataaatatataaaaatatatttataaatacatataaatatatatttataaatacatataaatatatataaacatatatttataaatatatataaacatatttataaatacatataaatatatataaatatatataaatacatatatatacttttttttttctaagttggcgtctcactctgtcactccagtccagtggcacgatcactgcaacctccacctcccaggttcaagcaattctctgcctcagcctctcaagtagctgggattacaggcacttgccaccacacccggctaatttttttgtatttttagtagagatggggtgtcaccatcttggccaggctggtcttgaactcctgatctcgtgatccagccccgctcggcctcccaaagtgctaggattacaggtgtgagccatcgcgcctggccaaaattacacacacacacacacatgtgtctgtgtgtgtgtgtgtgtgtgtttgtgtgtttgtaattgttttcaggagctagagaaatttcggttacatacacacaaacattcacttatcttttttctgagtaactgcaatgaatttatcatgaaatatggtaaacttctgtaccactagtttctacttttgttcatcgtctggttttcccctattatcttgggcacatttcctttaagccccatgaaaatagagaatctgttattattgtgttaaactatgtcttacttttctatcaaatatattttggtaaaactaaaaaatgaatttaaatgttcattgattttaatgaggacctattgtatgctgtacttgctggatgttccacagctataaaacaatagtgagccagcagatttgggtgggaacaacatcttcactatttcagacaagtcactaggggcatagcttccattcttacagttcctaaaattatcagtgtgggctcatgcccaagcatattatgaaagctgccctttgtaatatatttgtgacatcttatgtggtcataaattcttgaatactttttggctattaggatggttaacctctgtagcttagatatcctatgtcacaaacatacatgagaactaattttaaggaatagtaaaatacacttcatatgtggaaagaggatggctgacattcttaggggcagaattatccagaaagtttatatagtttgtgatattgctggaccattactccaaagggtaaatgctgtatgttttagtgatcttgggtggctataacaaaacaccacagactgtgtggcttaagcaacaatttatttttcacagttctgcagacccagaaatccaaggttaaggaaatggcagattcagtcttggtgagggcccacttcctgactctcctatcctcacatggcagaaagaacaagctctgatgtctcttcctcccttaagaaggcactaatctcatcacaggacttcattctcatgaggtcatttaaccaaattacctccccaaagccacaccttctaataccatcacactagcagtcaggatatcaacatggatttcaaggagatacaaagattcaatccataacactgcccatacactgaagatttcaaactcatgagtggcattataaaaatttgaagaaggtgacaagtagttatgtagaggagcagtttgagccaatttgagtcaataagagtttccttttctctgcatccttgccagtatctgttattgtttgtttatttaataatagctattctgacttgggtgaagtgatatttcattgtg

SEQ ID NO: 2501 - DNA, 18861 bp, Homo sapiens
tttacatataaaatcattttcttcagttgtttttgaactatatgtgtggaagcagtgtttttttggtagtggtgatttatttgcttctctttggctgctatttatataggattacattattagttatttatcagtagttagaacagtcaaatttttagggtcaatatgcctggtgtgatggtttgtttcactgatgcatagcagttggacatactatttttcacactttattactaacttcaacattctcaaaggaagcattgaagagaaaattgaggcgggacagtacaatttcttagcatgcctagaaaacaaaagattaaagcaagtaatatatatatcacatggacaaaggaagagtgtactcctggttgtatactaagaagccttgtattgctggattttacagagtgtatccacagacaagttttattaatctttgcctacctgtcttgcattttcacagtgagaatattcaataattcaaagcacattcatatgttgttatctttggagatgagaggaagattgaataagtgttaaaatgtgcactgatttttacagtgaaattcagaaattgataaacattttttaacttcaaatttaaattgagatttagataacgatatatttaaacatacatgttagctcatattattttgctaaatgaaatacctaaatacaaatttaatatcttaggatacatttgatatttttccatggcaggttgttaatataaaagttatttctaaaagcaccacacatacctattaatatgaatagtaaatacaaatccaaatttaaataatctaaaatattattttattgataacattaaaatagtaatatttacatgtatttttaagtaatctcaatttttcatgtcatatctaagaaattagaagaacataaatccattatagtatctaattcacacttggaaatgttcctgctgcatactttctattcagtctcttcttgatttattcattcaacaaatactcattttgtgcctgtaatttgccaagtactgttttaggcatgagaacaaaatgaataaattagacgcagtccatgagctcttgaagcttataatgcaatgaggaagacaggatacaccaaaaattgtgtaagtagataaaagctagtcaggcactgacaggtgtactgactttgatagagtgataaagaaggtatctagaacagtaacttgaatgaattgatggtgcaagcctttagagggggtggggatgacaagcaccaagacagtagggtgctaggtgtatccatggaactgcaaaaccaacgctgcttgggagagagagagagtgccagggtagtaagaaatgagaccggaaagagttccaaaaggtaaattacctagcgcctttataaggaagagtgaaataataaatcatgcgtgattaggcagatgatgaaaccatggagtaccacgatagtagtgagtatgcagagcaaatctaatttggaatctttttttttatatatacgtacgacattttgatatgtgtatacaatttttccattagatcatgtgtaatgatcaaaccacagtaattagtaagccctacattcgctttgggtctgccattactgtcttaaaattctcaataatttttgagcaagggagcctatactttcattttactccaggcctagaaaattaggcctagaaaatgaggtagctggtcctgctttctgctcccacttagaggatctgtaagaataataacatttgtaaatgatgtactttaaaaagtgtgacttacaatttctgaagcccagaaaaattatgaagtgattacttaaggaaaattttcatgcacataaatacaagcagagcaggagaataatgagttaacacagtgatcttattttgtgaagagattaactgagataagtggaatttcttacaattttagattaacattatgttattaatcttcataaatatcacatcctgagttcccattacatggagagggaagcatttttagattattaaaatgaggcatagagcaaataaattataaactctccaaggaagtccctattcaagggttttaaagtaagaaatggcaaatagaaataaagaaaaactttatttttctttaaactttagtactgaattcttggtttaccatcttcaaaaaaaatctgtaataaaaccctaccctttcatctatgaattataactttttaaaaatatatttctttaccaacattttaatacagtagattcactaatatttgttaattttgaatttgaagacatatcgatctaatgcatttccaaatgtgagcttcttaaataataattgttgttccttttattgacatgatatagcagtattacattgtaacactacatgtaattgtgattttggtaatattaaactgtgtttgttttaagattttcctctgtagctataaatgatgaaatagaaagtaccagtaaaccggagtattttttcacactaaaaatatcatatttttaaaagttacaatatttacatttcaagatgagaaagtagggttaataaaaactgctattattagagtaatagtaacaaaatatacaatagcatcaggttttttttaatatttaatgaagtcttcctccaattatttatatgacaaaaatttaattcacaaaaagcgaattattggaatgattgctttgaaaaattgcctgattagcttcttctgcccagtctctcaaaagaaaatgtttaggtataactaacttactgggagagtgtgataaaaataaacatgctttattcatgtgccaggctgctctttcttagcatgcaaataaaactgcatgagggctaacagctgctcttagagtactgcatgtcccagtctgctaggggaacacagctggagaaatgtacagagcattttcatcattgaatcaaacacaaactagaaagccatttagtactacatatgtaatactattactattgaaaagtagagtttctgttctctccttttttctgacacccattttaagctgtgccccagtggttctttacaggaaagtttataaaaatacataactatttcatggtatttcatcttgaatttttttggaatacagaaaactgtattttttccttcctctttccttttctcccgctctcctttctttcctttctgtcttcctaaaagtgtttcttttctacctaccaaattttaaaccctgcttgaggcagtgaggaccgtatggtgaacagttgaggttgatgctcgtagagctgcatcttttttttttttttttctgagatggagtctcactctagtgctcaggctggagtgccatggctcaatctcagctcactgcaacctctccctcctgggttcagtcaattcttgtgccccagcctctggagtagcagggattacaggcatgcaccaccacgcccagctaatttttgtatttttagtagagacaggattttgccatgttggccaggctggtctcgaactcctgacctcaagcaatccacccactttggcctcccaaagtgcggggattacaggtgtgagacaccacgcccagctagagctgcatctttcaagaccgtaatagcatctacaaacagacctcttcaaatggaagacaaatgaaaatttataaaatgaaaaaactttaaacagaaacaaggagagggagaggaatggagacagaggaaggggatgagacagagagagaggagaagagtggtgagaaaaaaagagaggaaaggaatgggaaagagagaagaggaagagagaaaacaaatctcaaagctatttggggaagatgaaaaagaggatgtgaaatttcttgttatgagcatttattgtcatgaaattttaatgactattaaaaaatcctgcacccaattgctttacatgatccaatctccattttttttttttttttttttttgacatggagtctcgctctgtcgcccagactggagtgcagtggcatggtcttggctcactgcagcctcggcaacctccaccttccaggttctagtgatcctcctgcctctgtctcccgagtagctgggactataggcacctgccaccacgcccagctaatttttatatttttagtagagactgggtttcaccatattggccaggctgttcttgaattcctgacctagtgatctgcctgcctcggcctcccaaagtgctgggataataggtgtgagccaccgtgcccggccgtatcatccactctcctacggatataattaaaaatccacaatctttagaacttcagctgtcaataattcttcccctgctgcctgacaccacaagcattttgtaaatactttggctctaaataggtgatatggtttggctgtgttcccacccaaatctcacgttgaattgtagctcccataattcctatgtgtcgtgggaggaattgaatcatggggtgggtctttctcttcctgttcttgtggtagtgaataaatctcatgagatctgatggttttataagggggaatttccccacacaaattctctctcttgcttgccaccatgtaagatgatgtcctttgctcttctgccaagattgtgaggcctccccagtcatgtggaactgtgggtcaattaaacctttttttttttttaataaattacccagtcttaggtatgtctttattagcagtgtgagaactgactaaaacagtagggtaaggttgtaccaactttggggaagatagtagtgacctcttgtaactctacaattgttttggaccatttatatagttgtgaaatagttcaacctgaaaatttgccagcagattctgtgtatctcaatctagccatacttcaagagtagcaagcattataaacagactaacctaaaggaatgtgagaaatttcaagggcaccagcaacctataatttaataaagaagtaaggaaagcacaatctcagtgagacaggagaactttctagaatacctggggaaaactatactcaatttcaccatagctcacaagtcttgtcatcctgtagtttatgattatgaatgcaggcctattttcagctctaggacagccctgataatttcatctcaattataagttatatttcaaacatgaaaatagaaagattcagaggtcagggccaaaaccaaaggatgattttgagctgatttacaggagtcatcagagaaaaaagaagatagaactgaactatctaggtttattttgggcaggatcacaaaattgaatcttgaaacattaatgtgaggttccttttctgggggtatttatatgaacagcagattttttttaaagaaataaaaatatgatattgaatttttgcagagcaacctaaaagcatctttacacatttttctgaattaacagtctcttacctcttatattctaaggaataaaatagggatttcttaactcttatcttaattagaaagtatttattgatgttttctgtcaggaagcaaataaactaatgtcacttgagaactatgttcctgcaaagcaatccaatgcatttattgtctactttgtttttgcagatacagtcacagatgccttttctcttgttaagcagatgtctaaagaagaaaacaattatcatatttaggctgaaaagatagaatgtatacttcacataaattgaaaataaaaatcacatttcccagaaatgaccccaaacaatcaagcaatgaaagtagcctaacacccatgggatacaggacagctgagctacactctatgaaagaacagtatctgtcacagttcaaaaactcattcaggtctttctatcctgaaagctactataattcttatttttcttataaagtgtgatgttgctgttaattgacatcaagaaaatccttacaacttgtgtcaaatgacataaagtaacacagatttttgtgtcaaaaatgttatctaacattgaaatattttcacccaagtatatatactcaatatcacacacaacgatagacctatgcatattaatttgtccctgtggagagtttagcaatctgtgaagttagagggagcacagttcacacaagaccaccctcacttctgacaccaactacaaattcagggttatcccaaaactaccctcatgtttggtgatttgctagaaggactcacagaactcattgagagctattatacccatggttatggtttactacagaaaaatgatatggattaaaaaccaccgcaggaagaagtacctaaggcagactccaagaaaataccaaacatagagtttcggttgtcctcccctcgtgaagtcagaacaatatgactttcttagcatcagtgtgagactgtacacatggagtattgtgaatcaggaaagcccactagaacctcgttgtgcagaagttttactaaggcttctttgtggaggcatgattgctctcatgactgatcttaggaggtctagctatattaaccaaaatctttgccctacataatactgttggtctttctggcatggtcaacacagaccctgaatattatctcttccccttcctctctatctccattcctctcctctctctccttgtttctgtttcaactttttttcattttatgaattttcatttgttttccatttgaagaggtctgtttgtggatgcttttatggtcttgaaagatgcagctctatgagcaatgacctcaactgttcaccacattgtccccactatctcaagcaggtcatttatttattcattcattttatattaacttaccaaacagtttggggcctatgtgcctcatcttactttgactgacattggtcatagaaaaacacatagtcatagaatgttgtgattagtaggtaatcacaatatgaaaaaatatacatccaagatgaatcgtcagctctccctgaagggggtgacttccaagagggagaaaactttgaactgcctttgagctgatctgtctgtcaagctacctactgggttgatgttatatgagtgagtctgccgggctacccaggcaggtgaacaacatagggaaagaagaataaagcaacatgacatatttccagtaacatttaacaacaaaccacatttagacagatgggaagaaaactcagacaaaaacaaaaccaaacaataccacagtggttctcaaataatagaaggcaataatgtgggcaaggcagacagtctgtcatctgttgttacagagttgtttgtacataaaccttgtacgtcagcaccttattttttctaaaactaggctttggaactgcaaaacctgagggattaaaaacttggaatagtaggaaacaagccgacaatagtaagaatccaatcaccttgcacaatacaacgatatttcactctgcctgggaatgctttctcaggtgttatactgcccattgaacacgacttctacacggcacgtctgttgatcttgaactgttttctgtcccaactatgctttcttatatactcaccaacatgtcccaacaagtgtgtgacctttatttagtgcaggctagacattatattacatttcttatttcttccctgggcaaactctattcccctgaatatcaaggcacataactcactttgtccaatgtttcaacagaaaaaaatcaccagagaattttatacacagtatattaaacccaacttagaacataatgaaaaatgtaactttattctagtctcagagtctctccataaactttactcagtgggggttaacttccgttcttcctccatgaatacatggctggccccgtgcgtgttcagcatattcttggacagtatacattctttcagtcgttttaagaaacaacatagtcaccattcagcaaataaacttccagtacacgactacattaaaaaatagaagtagctataaaagaaaatatttcttctctctgtagctcaggtccgtgtgttaaagaaagcctaagctctctcccttcttttaatccctatcactgtctgcttttttttttttttttctgaggcagagtcttactctgtcacccaggctgcagtgcagtagtgccatctaggctcactgcaacctccgcctcctgggttcaagtgatcctcctatcacagcctcccaagtagctgggactacaggtgtgcactaccacgagcatgcctggctaatttttcgtatttttatatgaaatgggttttcactatttttgcccaggatggtcttgagctccttggctcaagtgacaggccctcctagacctcccgtactgctgggattgcaggtgtgatccactgcatcctgcctttaactagttttatcttgcattggttatttattgtttgagcaatgagttacccccacatttagtaggttactacaagaaagattaattttctcattgtttctgtgggtcgcctgcaaactgagcatggcttccctttatcctctagttctaggtcagggtctctcacaaggccataatgaagatataacctaggctactatcctctcaagtactggattgacaaggggaggattcacttccatactcactttgtggctgttggcaggcctcaaatcctcactggctattggtcagataaatcagttctttgccatatggacctctttacagggcagatcacaatgtgatatctggcttctctcaccacaaacaggtaagagagcagagcctgaaatgtaagcatggactctttaacctaatctcaggagtgacattccactactctgtagtgttttactccttggtagccagttattaagcccagcagaatctcaaggtgaaggaatatgacagcctgaatactaggagatgaggataaccagggaacatcatagaggctgccagccacaatctctgtggaccaggaagcttttaaaagttgattctttgcctagttttgatcctttatgatctttgggaaattcctgttgctggagacgtctcacctctggttaccttaatcaggcaatgagtctatatttcggtggtcatttagatttctcccttagcctttgggccaaaaggtggcaataatcttcttataacctaaaacaacctctctcctcctagtagtgtatacatggtgcactgaaaaaaatctatatcccttacctttacagatggtaggagtacaaactgatgccagcacagcaactctccaacttatatagtattaaaaatgagcatttacatatgatgccatataatttagtgtttggatctcctactcccctgccacccatttgtgcactctgtgctcttatttcttatggtaaaacaatcctgtatttcaagtaaacaaacttaatcagtttaatatagaaacaaatactctaggaaaattaagttttattataaacatattaatgaaaatcaaaataatttaaaatataataatggctttcagagaaaagtgtttttgctttcctttattatttttgctaatagtcataaaaagataaggaagttagccaataatgttatcagaaaacacagcaaagcttttagatgcccttaaactgtcaccaaaatcaagtgtaatttactttcttttatgtattactagcaatacttatgtcacatttttcagtgttcccatactatcagggaatgtgtatattccactgagctctgattatttggtagtggtgttacattttaacatagtatggccataaagttgtactaaaaaatagcgaattttttttattctgtatgaggaaataagctatttctccattcttttatctaaacacttgataacataggataaacattaacccttcaattaactaaatataacaattggcaaagaattcacgttaggaaaggtacaaagcagtaaatctacagattgttggtcctaggatatatagctcttctggtaattacagaagtctgtagtatttcttaatttttcagcacagttgataaagataatatggatagacactcaaattgtttttattttacttcgaagatcagcacatttttgaacatttagaaaataccagatttctctggcatgtaatttctctatttaaggataaaaaatctgatgaactctcaagtccctattaccttaaattccaaaattgttttaaaaatgttgagctagttacttcttgaggaaggagaaagaacaaaataagtatattcataaaccttctctattaaagttacacagactttaaagaaaacgtcaccctttgtcagatggatagagtgctaaaattttatcccattctataagttgcctgctcactatgataatagttccttttgctgtgcagaagctttttagtttaatcagatcccatttatctattttggcttttgttgctattgcttgtggtgttttcatcaggaagtccttgcccatgcctatgtcctgaatggtattgcctaggttttcttctagggtttttaaggttttaggtctttcgtttaagtctttaatctctcttgagttaatttttgtataaagtgtaatgaagtggtccagttttagctttctgcatatggctagccagttttaccaacatcatttattaaatagggaatcctttccccattgcttgtttttgtcaggtttgtcaaagatcagatggttgtagatgtgtggcattatttctgaggcctctgttctgttctattggtctatatctgttttggtaccagtaccgtgctgtttttgttactgtagccttgtagtatagtttgaagttaggtagcgtgatccctccagctttcttcttttttattaggattgtcttggctatgcagactcttttttggttccatatgaaaccaaatttaaagtatgaaatttaaagtagtttgtttccaattctgtgaagaaagtcaatggtaatttgatggggatagcactgaatctataaattattttgggcagtatggccattttcacagtgttgatttttcctatccatgagcatggaatgtttttccatttgtttgtttcctctcttacttccttgagcagtggtttgtagttctccttgaagaggtccttcacatcccttgtaagttgtatttctaagtattttattctctttgtagcatttgtgaatgagagttcactcataatttggctctctgtttgtctgttattggtgtataggaatgcatgtgatttttgcacattgattttgtattctaaaaaaaacaaccccatcaaaaagtgggcaaaggatatgaacagacacttctcaaaagaagacatttatgtagccaacaaacatatgaaaaagagttcatcatcactggtcattagagaaaagcaaatcaaaaccacaatgagataccatcttatgccagttagaatggcgattattaaaaagtcaggaaacaggccaggtgtggtggctcacgcctgtaatctcagcactttgggaggccgaggcgggtggatcatgaagtcaggagatcgagaccatcctggctaacatggtgaaaccctgtctctactaaaaaatacaaaaaattagccaggcgtggtggtgggcacctgtagtcccagctactcgggaggctgaggcaggagaatggcgtgaacccaggaggcggagcttagagtgagctgagattgtgccactgcactccagcctgggtgacagagtgagactctgtctcaaaagaaaaaaaaaaggtcaggaaacaacagatactggagaggatgtggagaaataggaatgctttcacactcttggtgggagtgtaaatttgttcaaccattgtagaagacagtgtggcgattcctcaaggatctagaactagaaataccatttgacccagcaatcccattactgggtatatacccgaaggattataaatcattctatgataaagacacatgcacacatatgtttattgggttactattcacaatagcaaaaacttggaaccaacccaaatgtccatcaatgatagactggataaagaaaatgtggcacatatacaccatggaatactatgcaactgtaaaaaaggatgagttcatgtcctttgcaggaacatggatgaagatggaaaccatcattctctgcaagctaacacaggaacagaaaaccaaacaccgcatgttgtcactcataagtgggagttgaacaatgagaacacatggacacagggaggggaacatcacacagcggggcctgtctgggggtgggtggctaggggagggatagcattaggagaaatacctaatgtagatgatgggttgatgggtgcagcataccaccatggcacatgtatacctatttaacaaacctgcacattctgcacatgtaccttagaacttaaagtataattatatatatagtatatatacatacatacgtatatacatgtatatatattacatatctgtcctcattagttggaatacagcaggctttactagtgtatctgaagtaaggaggaaccaggaagtgagctgttttgtaatggagaccagttatatctaacagagggcaacagtgtctataagactgtagcctattggatgggaagctatcttatgcaaatatgatgaatcttttaaattctgagttcaatgcagtctacagctaaactcaaatcccggctcatactaaccttggtccttgggcatgtttatgcttcagttttctcatctgtacatgggttaataacaatactcagcttgacagtaaccatactgcacagtgcctaacacatgtaagtgctcaattaacgtccatttctactttctgaaaatatatggtattagtgtgcaaaaagttgggctacataactcaaatctcctttgtatcttaggtaagaccgcttctttctctggattgtttcttctagtcaaatgcacaggaatttagttgatctcccaagttattttggaccttaaattctgttttattcttgttcattttctatgtagtttagatttagttcattggactgatttatgttctgtgttcttttaaaattcaggaagatgtgtataggatagatagagcaaatatataaacactcaatttcatttactttaatataaaaactaacaagtttctcattagttataataaccttaaaattgatgtgtttgggaagcaacctgcatagtcattaaaagcaggagttacagaatcacaaaaaaaaaaaaagaaagaaaacatcactaacaatgaaagcagtaactaataaatataagttgtttttaattgtgcaaacaatttgagatttgaaaagtatttctggaccaagatggtgacagaaattttagggcatcagtttggtcttgaagtttaacaagatttaattgtcagaagtatactgtaaagtgtattctttttcttcttcccctcttccaaaccacaataatgtaaagggtatgtggttattatcagtaagaacaattagaccagaattcatcagaatggatatcatattaattctgtcctggttaactgtgataatttaagtctttgtgtattttcacttgttcaatgagtcactgggtattttaacaatgaaaaatcggtcggaacagtgttacactgagaataagcactcttgaaatgcccaatacttttgaaataatgaatacctgttgttaggtaagaaattaataattattaagttcaataactcatctccttttagaaagtcccactgtatctgttataaaattttaagaaattttcgaggtcggcgaatttacaaggagctgtatttatggcatctttctggatcctacttttgcattctatctttctggttaagttcattagggtttccagcagtggttatcttggatctgaaacattgtcagagatcatatgaaaacctgaaactgtaaaataagggtaaaggaatggtagcgattgtaaaattaagaacaaaaatcagatttcacacaacagaatttgaaagcttgaaataatagagaattttcagtgtttcaataaataaataaaatattattagtgaagggaattaagagtttgatattatcttgatgaattcaaggtagctgaaattagcaaatctgattttgtttgcatactgatagtgtatcatctagtgggagaatcaggtgaactaaattctcagagactgatgtataaatcaaagtataaaaatattgtgttggtaacttacagggcactgcttagatttcttttttctcacaattctctcttaatgagatcttgcagaatggcgaacttctcacattttttgactggcatattccttctttaaacttgttaataccattacttaggttagtgtcaactgtcactggtttcaaggagtcttacaatctctgaaagttgacatttcagatttctaacttaattcattgagttgtagttaaactcatatgaggggaactttaattcttaacatgtagttaaacttatatgaggggagctttaattcttaacattaacctctcaaatgtgggtcactatgtacaaatgatgaaaactaactcatgttttaaatgatagcaatatgaatggcaaaagactaccttagcatatttttaataaaaactgctattgtgctcaaaactcctgaaaaaatcacattttacataatcagtaatgaaatagttaatatttctattatgaaatattctgatgtgtgaagaattgtactgagtagagccctaacttctacttggttggtgcaaaagtaactgtggtttttggcattactttagtgacaaaaatatacacacatatatattttgttgttgttgtttgtttgcttgttttttgagacatagtctctctgtgtcacccaggctggagtgcaatggcgtggtctcgactcactgcaacctctgcctcccaggttcacaccattctcctgcctcagcctcctgagtagctgggactacaggtgcccgccaccatgcctggctaatttttttgtatttttagtagagacggggtttcaccgtgttagccaggatggtctcaatcttctgacctcgtgatctgcctgccttagcctcccaaaatgctgggattacaggcatgagccactgcacccggccgaaatatacatcttaaaatatatattttaaataatatattttaaatctctctctctctctctctctctctctttctctctctctctctctctctctctatatatatatatatatatacacctatttaacaaacctgcacattctgcacatgtaccttagaacttaaagtataattttatatatatgtgtatatatacatacatacatatatacatgtatatatattacatatctgtcctcattagttggaatacagcaggctttactagtgtctctgaagtaaggaggaaccaggaagtgagctgttttgtaatggagaccagttatatctaatagagagaatcagtgtctataagactgtagcctattggatgggaagctatcttatgcaaacatgatgaatcttttctctctctctctctctatatatatatatatatttctatctctatatttctatctctctctctatatatctatatatatatgcatatatatatgcatatatatatagatatatagagagagagatagagagataaaatgagaaattacattcctagcaactattttagctcattaagacctatgtgaataaatcattgatatttttacatgaaagagaccataccataactttacttcactagatattaggccaagtagccactcttgaaaaaagagcaggcaggcaacaaagagaccagtattgcttactattgcagtaatacagtcatgagattatgagggcctatactttagctgccaattaggaggacatattttagaggagtgaaaaaagaaacaatagtttgagtgtctgattatagaagataaatatttttcccagcagataattcctttatctttgctaggcaagatatcaaggtctgttaatgaataagattaactagcataagagacttgagtataatgacaaagtttcttttatacctattgactgaaaatgaattatggatttagcaattaagtgtttgttggtaactttcaagatcattcagaaatcaaactgcagtttataaagcccagagttaagtgattttaacaatttgatacttgctgattgaccttctaccaggttttagataccattaacatatagagtaaaagagataatccttgccctcaataaacttatagatcataaggaagagatacagacacataaatggtgcaatacgtcatataaaacattacacaatggtgaaaatgtaggaaagagtagagagcacaaagtcagtctgcaatggcttcacagactatggccaaaccatctctaaaaggagaaatacaaattcatctctagaataaggggtggaagggagtttatttccgaaagtgtgatagtaggttcacagaacacataggtttatgtaaaagagcatggtgtgttttcttgaagatgaagtttaaaatgaggagtgatgtgatcaaatatcaaacatgtaattggaatctgcttatcataggtatgcaagagatagaacaatgagaacagttggacacaggaaggggaacatcaaacaccggggcctgtcgtggggtggggggagcggggagggaatagcattagaagatatacctaatgtaaatgatgagttaatgggtgcagcacaccaacatggcacatgtatacatatgtaacaaacctgcacgttgtgcacatgtaccctagaacttaaagtataattaaaaatatatatatataaaaataaaaaaagacaaatgtctctacccttaagtagtttatagttataagtgaagaaaaccttacatgaaaaagtaatgaagaaagtgatagtacaacaagcagtatagtagaagactactgtcttctaaatttccaaaattatttagataactgcagaaaaccaacaagtatttctcaatcttaacaaacctcactcatcaagactttaatcccaaaatgatcctttgatttagacatggagaaagcttcgtagagtttatacaaattgttagaatttgacatcttcagtttatttctcattaggcattgcacaatcttcaagaacagaaacttagaaacgttgttatatctttggaagatatttagcaatttatatattacatttgaaaagaatgggatctcgatgaggtaagatacttttagtttaaaaagcatcttttttttttccaaaaacacttagctaaaggacactattgtccattacgtttgcaaaagagatatttcagaaccacgttcaaatataggaaagaagaaatcttttttaaagaatgtagaataagcatttataaggaataaatgttcaaattgatctgcagtaaagttaaagtgatattagttttgcatcagtcatctatattaatgttgaaaaatcaaagagaaaataggagattttgttattgttgcttaagcaaccataagcattctggttatttaagtcactgtttcttgtacatactttctgagagtaacttgaaagtttttacaaggtgcataagtgatcatttaaatgtattcaagtaataatcatgtagatgataacctcatggcctggaagagattatggcaaccttgtgtatgcttcaggacatttgtgatcatggcaaggtatcattagtgtcctggacatttaaaatatgcagtgtatatcctaaagattcacattggaagctttctgggcattgattatgttatggctttaggacactcagaaaagattttaattaaataaatgctaatgaagattgagagaaaatagctcataatttaagctagtgcactcccttatagttatcaagaaactgtttcttgcatctagctccctgtgttatatttttgtgtaggccatgaagatagatgaacagtgatatttctgggatgctgctgctcataaggcactatacgcaagctggagaaaatctggcagagtgcagaatcgactatgtctaattctgtttcatgtatatagatatctcataattcaaaggttctacaggcaaccccgcagatagacagtaaactcttgccttttgtctagttggccttggtctatgttccctctttatcttttgtcttcatctctctttttgctcctaatactgctttggcttcctggtgcatctgctcatgtggtatctgcctagtttccctcagttttatggttttactcctttgtattatgacagcttaatatttctatatatgtatctatgtatgtattaatttatttttgagaccaaaataactttgctttcatccagttaacaaaggagctttagatattatagaagtttttcacattcccttttatagtaaagaaagaaatattgccatgaaacagaagacaaacaacaggggacatttaaatgtttgggaaaaatatgggggtaataattcaaatataaatacaggcttaaaacttacttttattaacctcactttgcccttggcatcttgtactttgaactggggcctgtccagcatctttctcatttcccactccagcgttacagaccaaaataccattctgtaaatgatttctgcctaccaattgataatacgaaactttattctctcacacttacttttcccactgtgtgtgtgtttataaacattctgaagaaatgaagatcattaaaatgaactgtatgccatgagtagttattttctaagccaagtatttatgggggctgtataatgttctaatgtttaaaatacagtatgatagcagtaaaatcaa

SEQ ID NO: 2502 - DNA, 45723 bp, Homo sapiens
cggcctcccaaagtgctggggttataggcatgagccaccacgcccggcccagaacaagattctaaatcccctttcagttacacagcaatagatgtcccgggagggatgggctccagcattttgttgaaactatctagcaagcctcctgcagctgttaccactgcaaaactaagtgtgtagttagtggagtgggcggggtggtagggatactgtgaaaaattgagtaaatgacaaagtgggacaatgacatcaaaggagagggcaacagacaggacagcaacatgaggaagggcaaaaggcaggaagattcagccagaaaagcaggacgatcttagaaaattctgctacttgtacttccaaaaaagttaagaaaaagaacaaccagaatttgctaaaaatgggaatgaaatagatactaaaacaccaaataaagggctctagagagggaacaggaactctagtgcccaggctgttcccctgtcactgctgtatgcatattcagtatctccctggcctgcactggcctctctgttcaagtgggccctgtccttctctgtgagcaaactgtagccaaaagaatttaagtgctcatttagtcagttatatatgtattatcagagcttagtcttcagcagactgcctccagacactcaggaacttcccactggcaaccagtgttacccgggtctcaccgatcccgggtgaacagtggtaatagggaggaagatgaaggatagaaccattgcacagcagccttttgcaatcatctagtcctttaggaacagttctgctgtgctgtttagtcctcaggccacactgtgagaacaagttacagagcactgtggtgagtgctgaatgagtcagggagtagagataggaagagagagagagaaagggagagggagagagagacctgtaggtacatagaaaaggcaggaagcaacatatgtccttgactcatttgatactgcactttgttccacttcccaaggattcagtcactgcaatttacctttagcattccaggcagatagaatcctgctctacatatgaatctgggcacaaagccatgcaggtgtgagtaagcccatgaaggaagtggcactcaaagactctaggagttcaggccaggtgcagtggctcatgcctataagcccagcactttgggaggccgaggtgagtgtatcacctgagggtgaaaccctgtctctataaaaacacaaaaattagcagagcatgatgacgggtgcctgtaataccagctacttgggaggctgaggcagaagaatcacttgaaccctgggaggtggaggttgcagtgatctcaggtcatgccattacactccagactgagtgacagagcgagactgtctcaaaaaaaaaaaaaaaaaaagactccaggagttctaatatgccccattaggtgggcaccagaatggccccttgtaactttttcctaccttctcctctcctaattctttttctgtggaggaaacaataattgtctctgaatcatccctattcggagcattgaggatatattagaaggtctgggtaaacaagcagaaatattgcaaaagtgctaaaacatcaaacttcagggtcgaatttgtggtttgcttctgctttttctatccactctaaaggtgttcctgatagagaagcttcctcagtgttccctgtgttggtgtgtaagacagaaagaagatggggtaaaagagtgcacgcatcctccactacaaaccagaggctgatagcattagggagaagctagggtttggcctcacacaagcagtttgcactgttgtccaatcccaggtggggtggttgcctcttcatttcctttgatagcaaccgcctgttgcgtgatgtagtgtgggtgtcctcagaggtagctacctaagtttgcatacttcctgactgacagaacactcctgccagtgcctccaggccagggtggtggtgttggtgggaggagtaagtaaccaagtttcacttccttgccttggagactcagagccatagcaggctgctgtctcacagagcgagaaggtgtcaggagcagcccagttgtgtctctctctctacctctgtgaagggcgcgaatgggcagagcagaacttctagaagggaagatgagcacccaggatccctcagatctgtggagcagatccgatggagaggctgagctgctccaggacttggggtaaggcagcagatctcctttcaaagtacctagtgggtggacattgactccgcactcccacctgcatgctttgattaatgactatcttcagtgccttgttgccctctgccacctcaaccatttatttttttccactttattcatttgtatctgttaagtatcttcttgtctggggctaattccattggaaaagcaggcattatttttctagatgtgaaaacaagttggttgagaaaatagggaaaaaaatcaaatgttggacattctttgagaagagggacagaattgggatatagaggtgatgttgcctggcttccttgatgttgctctggtttatgaataaatgcgctgttcaagagtttctagcactgacccagggacagtaaaaggactgtgtttctggtaagataaacagaaagcttaccctactgtaagggagagggactttttcaaaagacagagaatgaggaagttcctgcaacagtctcgcttgtatatttctttctcctgatactgcatttgtgagatttgatatcgtatgtatgtccagagagccaactttgagcctttcagtaccaacaatccaggaagaggataaaatttctgcttcaaacaggtaagcataggtaggtggagtcattggagctctgtctttaagaagggacccagatgacaactcatccgggtatttaataagaaacaagtattacacaagagaggaattggggatttcccagagaaactgcctaatgcactgggaatatcccaatgaaggtggctttgacacctgtgcatgaggagaggcaaaacctttaccttctgcctggacaaatagctctaactcttcatagcaatccaatgacataggagctgttgtcatcttcatcttacaaaggatgaaaacaagtaccaaacaggtttgaataacttgcttgctagtcacacatcaattacatagcaaagctgggcatccaacctaccacaggctatgtccgaaaccaaagaaaaaccaaaatagagttgaaatctctctgtgttaaggctgcagagattgtatctttttatgttgtattactgtaaaagtttattaataattcctgtctttagattataaaactgaggtctcggaattgaactctactttcatttggcaaatcagataaaacacctggaattttcattaaagaaaactccccttattaggaagccagagctctagaatctctctatccctctagattgaatccccaaacagaagaggtaaaaggcccttctgtgagcatccagcacaggtgtcaccaagtccaaaagctaaagctgaactgtggccctcagtgtcttattgaactattaagttacaatgctttacatgttctgttaactgtattcccagcccactgtaatagaaaaccccaaaggaggagatagaggaatatattcaattctggtcctttagttaaacaaacaatcctagaacccagagtctatggttgagtactgtgggaacacacttagatgacaaagatgaattagatgctgtctctgtgccccaccatgatgtcaacagcaagaagcaactacaggtgaaacccacgggtggaataggactgtgtctttcctccatgtgcaaagaatagacattgaatacaaaactgagtcacaccacttccctgcaaaaaaaaaagggtacattcatggccagatttccctatttcagaaggcgtgaacaattaataaacatgaggatgatttctatagcaatgggcaacctgcagttatctgggaaaactgctctacagtcctggttcttgaccttggctgtgctctggaacatcttgacacccaaaccacagacttgacaaatgatttcagtatctctggggatgggtgttttcttgtcaaactctccaagtaattccaaagtgagaccctaggttgatgatcactgcatagaatatgtatctaccaaatgcattaggtaaatgtggtcttgtttttcattttaagtctgttgggtgtgtacttgaatcttaaaattactaataaatgttgatattttgtttgttggtttaggggcatttcgattagcaactttattgaggttattttacatatcataaaatatacccgtttcaagtgtacaattcaatacttttgactaactttacagagtgatacaaccatcaccataaatcagttttaggacatttctgttctcccaaaaagaaccctcagatgtatggcttatttaagcatactcaacagtgtgctggaaaaacagctgggaagagttggggtgtggagaaagccctgatttcaagaatttgcctaattccctggtataaatactcccactatagacaatttcaagctgccaacaatttaacatcatcgaattgaatatttaataatcaacttgtgccagtacttgctcctgcagcacctcactgatacattttttatagataacaatttgagaactcttgacaatgacttgttgcctctgccagaatactgaacataactcgaacattataatgactttttctttgaacctttaaccactggcgagatagaatctctaccaaaccttctgattaatttagtttccaaagacctccttaaaaacaaaatgatttaatgtaatggatagataaaaggtagctggttttaatgacttaatttttcaattatttttaagaggttatttgagtagttagataaatccttacgtttatgtttttgatagacataaacagataagttagtggttaaattacagaaatagcagaagtctttgttcttgggcctctgtttttttcaggctctggaatatgtaaatcctgtaaattgagccctgaactgcagcaaatccatcacttgcctttccaggacatatacaacttgctcagagtacaggtttattattttctaaaatacctaaatcaagcaacacagtgcttttccatgtctcatttatagagtgtcagcctaaaatcattaattttctttcatctaaaatacattaatgtgtccagaagcaaaggagaaataaaaccatcttaaattgttgctcagcttcgcttacacttctcaggggagggtatgggcttagggggaagagaggtgtggggagggcaagaagtgagggtgtggagaatcaggggagaggaaggaggtggaccatgaacgaggagatgggtcaggctgtttgctgcttgcaaaatgaaaatatggcaaaataaaacaagtaacaaatactggagatatcacctaagtaacaaactggtaaagaatagctagttaaattactgaaaattccagcaattctttggctttaacaaaggttactatactatttctacatatagctatatatatgtataaacacaaaagaaataacaaaatgaaagtgttttagcatactttaaaattaaatattcaaatgatctagtcagttgtaactccaagtgagaaacataataaacgttctcttttttaaatactttctcaaatcgaaagttgtataagaaagtgccagtgtttggctggattggccagtgccaaagaactagattccaagctctgaatatttaaataaattgataactaattagtcacatataagagaagtttagagtagaccatggagcagcaaaccttttttttataaagggccgggtaacgaatgttttaggctttgcaggccttacagtctctacctcaactactcacatctgctgttgtgcaaaaactaccagagaacacagaaacaaatgaccgtgatggtgttcaaacaaaacgttatttatacactgaaatgtgaatttcatataatttttatgaatatttttctatttccctcaagcatttcaaaatgtacagccattcttggctcccagtccatactaaaacaggtgtctgacaggaattaaccctcagctggtggtttgctgacccacggaataaatgataataaacaaaatgagtccgtattataaggcaggcattttgtagacaccagctctggtctttgaaaggcactggtattccagctttacacaggaagagactcaagagcagaaaaatcaggttgcctacagtctctgagtgtctgtgttcaaaacccatgctgacttcacaaaccaggttgtttccctgctgtgatagtcctaatttactgaccacctactatgcatcagcaccataccattcacacgcataatgccatttaggcttcacaataacactttcaatacgatatcaccatactcatttcatagacgcaaaaggtgacttcaataagctaagtatacgatccaggtcacagactttgtaagtagtggagctgagagacacacctaggaacttaccccagagctttccactgcatggtgctgctttgtagagcccactggtcaaaggtatgtattctagtaatggcaattagtaattattggatgcttatcatgtgctaagcactagtttaagccctttgcccatgtgaacttgtttaatttacacattgctgtgaggtgggtattattactaatgttgtccccatttatagatgagaaaagtaaagaacagagttttaatcacatgcttaagtttccattctaacataccttcaaatccaagagttttgctccagagccttcatgcttgactgctgatgtaacctcctggttttcatcaaatttctctcatcttactatactagtacatgttcatagttcttaatatgaactgagagaagcaaagaaagttctgtgattataacaaagtttactataaaagacattattctttctattcctcacataatatacatgcacatgtacacaaagccaggccagcattctagttaatcagaacattattgaattttgtgtagaattcattttcaggactagaaaaatttattcagctaagaaacgtaaagtcaaaatttcagtggaacctgtttacagcggtgtgacactaactacagcaatacagcttgttcctcttctgtgcacagctctgtaatcttggattctaaaaacggaaggtggttcttctgtggttgtataattagtatgtaactagtgtacagttccatctcttcataactcaagtgaatttcctcttcagttgtggtgtttttctgttcctccaaagggtgacttccttctacttacaagtggaaatctgtcccacagactgtccatgttgtggggagtcactttgtttcattcattcactcttctactgggtcatagatctatctgttgtatgatgacgccaggcaaggcagcatagaggagactacaataaagaaggcatggctgtgcagagatggaggattcatatgcatgtagagttagaatgcagtgttgtgtgggctgagggctgtgacagtgtctagataaaacaatctcctatggaaggctatcttctccacagtagaagtggagaagatggccttggagctgatatgatttttgtcagttgaagttagaaaaggtgaaattttctacagagaaaatggcctgaataaaggagtgatggtagcaaaatatgcaaggattcagaattgaaaaagctcacatgaactcagacccacccagtccccaagacccatctggtttgtcagcattctggtggtctggttctggtctctacctctatccatctcatcctatgagaagcttcaacttggcttttctcttgtacttctgttttcatgaccatactcttagatattttgttaaaacctgcattaatttctggctcctaccaactcccgtagaggataaattcctattctgagcccatcgacctctgtgtcctactgcctgatagaggcctgcctctaccaagagcacagtgaacactgctgggccttatcagtgttcgctgctcaccacttgcttctttatggtcatgcttcccctgaccctgcccactagcacctgcccccattatctgttgttagaccttctttgtttaaaaatgtttataactttaaaaagtgtaagagtaatcacttgttttaataacagtatgatgattatgtaaaagaatgtcacttttgagagatgcatgttgaattatttagggttaaagtgtcaggatatctgtaatttactttaaaactgttcatcgaaagagtcaaaattaaacgttgtattaaaaatgtggcaaaaggttaaaaattattctacctgaaatatgggtattatttcaatgcagtaacattgatgctatttttctactttccagtatatctgaatttatttataataaatagttgaaaataatagtaatatatattaattatcaaaaattagagagatgaagagaagcatcaaaatataaagaaaagcactaaaatgtcagccatgtactactacctaaaataacattgttcatcttgattctagtttttaagaaatgtttttctgtacacacacacaaacatatatagagattgaattgtaatcatattatatgtataattttgcttttgctttttggtaggatatttttccatcatctccttcttgatctgtctcaaagtaggctcttgcttccctctgaaagcatggatatttaggttgatctagattctggagggcctaaaatagatttggtcaatgaacaatgtggactcactgaaggttcataggaatgtggaattacatagtcatcatgttttgtttttaggtagattaatctgatagttcagcatgatgggtggcaatggggctagagccaagatagtgggttagtgagggagttttcagattggtgagtaggaaactagagtgctaacccgggaatagtcaggaaggaacaagggtagaatccagcaattccattgagctaagcaaaataagcgactcatgtccaaacaaaactagttctgcttttgtgtatgttttcaaaatggtatcaaagaaattttgaaaaccttaatgtctcacaaatatattataactcattgtttgctttatcagtataaatttctaaattttcctgggtttcatgttactgctcctagagttctgacttatacaagttgattgcatgtttgggttgattcaccagatactcttgaaaccattttgcagatgtcagtcctgaggtactaagaggtttagccacttgctttaggctagagcacagtaaactccttttaatggtgaactccttaggagcaggacagtggtttattcatctttgccttctccatctgagcataccacttgataaagagcagatgtttaaatgttgaattgccccaagttgagtcaaggccaagaccagaactcaagcctcctgacttaagccagtgagctttccactgaaccaacgctgatgatgtacttgcattcatcactttcagactcactcagtccccttatgcccagtggtttttactggtggaataaattgacgttggttagaggtatcgcctaaaccatggaatagagaagagataactaatgaaacaagaatctgcctgtattttttttacagaccccaatgtacttatagctctttcctatagctgaagcttcctgaaagtgaccctctctgtctcctacactagcccacaatggtaggttgtcaatggcaaccacagtttgaagacaattaccctgaaccagcactttgtgagggataagttacaagagtaaccatagtaagcccagagtcaagcttgattttacttgaagatgagccctcttaagagaacctctgattttcattccctgcctagtcattctaggccttttcaaggttttttccaatccaaataaaatgttccctgagcctcagttactggagagcagtggtgcttttttggtcttgcagccattcctgtactgtgaaggcttccctggggaccgaacagaaggatctcagtacagtgagatgcagttttcacccctcccgcaagtagtggctctgtccctcaggtctgtccaaatctgacttccctgggtatgttggtccatctctgagtcaggctctgtggatttttctttatctttaaagacatctttatctttcattgttttctctgcccctgtctcctggatcactctttgggtctgcatgtgcattccctaagtctctgtccccatgtgcttctggctatctgtgtgagctggcgagtctatcttggtctcttgagttttgtgtctctatctttctatccgtctgtctgcagctctttgacttttgtgtctctgagactttgtgccactctgtctctgaatctctgagtctccatgtctgtctgtctctgtgttttcgtcttccagagcttcttgcatcatttctcagacttcttcaagaacaggttcatcctgatctcaaactcctacagaattctctcctccctttcagttttgatttccattagctgagccttgactcccaccaaaaaacttgggacctgcctttaactcacagatcaatgagatatttgcatgctccgcctctgtcatcactcaggtctgttttctaaagcctggggcagctggtctcaccatttagctctgctcttagctcatgtaaacatgggcatttagaaaagcaattttgaaagatacagccctgctggttccatcacagaaacgtctctattggagagactctagagaatctttctttggcctcccctgtatatcacactacacctgtctgagaccatgtaagaacttccaaaatcctttataaggcttcggcttgattccctctatttgaacagggtccattgctattatcaatggaaaaataagcccacacttgtgaacatgtgacttaatgggcttgtgtgggcaacaccatctttcttagatatgtcacaacctgattctaatataaattacagcactggtagctcttgagttacataagacaccctaaacccatgatttctaatggcatagagggccaaacactttacctttcacaaaatcaaagtatctagcaccgaccctatgaacaaatgagcatgaatgaaatcagcagccaaggaatcccatggaatagttcaagtggtaagaacagattaaaccttagagtgtgaacgcctaatagattcatctttgttctatcactgttgtgttcagaaagattgtgaggctaagtataggctcagcaagaaagacacatcaattagctgtgccatgtatgaacttagagaaggggtgtggcacatatgttatgcatttgtcatctttggtctagatagttcagaggggtgtcagtgtcatataaaagtgagaacaactttgaaaatgaaataagagaaaattttctaaagaagaatgcttttgttggctgttcaactccagggcattttggctgttttaacacaatcaggagtttttttcccactttgcgttgaaatatatgtcctctttataactctgatgaaacagaattgaggttctatttcatgtatcttttccaggcagggaaaaatatatcattaaatatgtgaataatctgtagacatgagttactaagacattttgtcatcaagaaatatactatctaaatggatgtgtggcatgtgttttaaagtgcaagattgctttctgtgtccaccagttcttccagaattattttgcaccacttcccaacagggaccctgtgctccagctaggcatttggttgcccatgcacaccaagcccatgtccactccagtgcctttgcttatgtcatttctcctctcagaatgcctctcactgcctaatgaatcctatattcattcttcatactgcagtttatcattctcccgctccatgaagttttccctgatcattccagcccactgtgagctccccttcctatgctataatatttactgtccatatcactaagatagcagctatttggtgattcttctatgttaacctgcagatccttctcttttccattctgttggtactgaaaagtcacttagtactttgctttgcccttctcttcaaatgccaaattctgtgaactcaaactgttcacattattgaagtgaattaaagttttcaggcccaagagtccttcccatacatgctcctcaaactctaaagtgcataacaatcacgtgggacttagcaggttgagggaggggcctgaggttgtgtgtggtccatgttggctgctcattagcaactcttttcacttgacacttcccagtagtaaaaagtttcttattgcacctgattttaaaaccatcactcttggctgggcgcggtctgtaatctcagcactttgggaggctgaggcgggcggatcacgaggtcaggagatcgagaccatcctggctaacaaggtgaaaccccgtctctactaaaaatacaaaaattagccaggtgtggtggtgggcacttgtagtcccagctactcgggaggctgaggcaggagaatggcgtgaacccgggaggcagagcttgcagtgagccgagatcgagccactgcactccagcctgggcaacagagtcagactacgtctcaaaaaaaaaacaacaaaaaaacaaaacaaaaaacaccatcacacttataagtgcagatgaaggaaatgacctaattggaagttttaatcaacagtaagtccagtgtgaatcagctatgtgatgcaattgtgaagaaactaatgcattctcgggctgccttatgtgtgcccagcagccagaataagggagctcctgtgctgctttgttttgcaggtcagagtttaacgttaagacagattttttaagtttgaaaggttttcagatgagatgagttctttgggtgataaggtccctggatgataaaggaactgaaagcctgtcataaaaggaaaagctgaagatgatggaaagagaagaaggtgcattctaaatgctttcaactctttctataagtatcatctatgtaactccaagaagtagctctgaaaccatctgctgaaagccatctacacagcaaaaaatggcaattcattgtagcccaagagttttctaaccatgaatcatgaacatatggattaagcttgcctatacaagtactgagttccccatcattagcaatatgtaggcaaagattggataagagtactatagagtttagaaattattcaaacactgttgttgtgcatttctgacaagatcccaggtgatgctgatgctgttggtccatactttaagtagcaaagctttgcactgtggtttaaacatcaggtacaacccgttagtaggcttaaagtgaatttaatgggtcacatcaatattcattcaaaataaagagaaaacaatatattcaagttaatagcctatagaaagataggtgttacgtcctgtaactttttgttttttgtgcgtctttgtgacatatgtatgtttatatatatacagagtgatataaaatgtattttgtactgtgagtcaattcaaaaaatttaaaagcctctcctttaaagaacagaacaaatgaggtataaagttagattagtaaattaaaacagtaaaacccagtgggataagaaactatgaaggttccactattctggagcaattttccagaagattctagctcaaagaggccccagaatgaaaggaaaggaagctgaaccgaggaccagctttctggatccagcctgtccacattctctgtggctgagtttattttctgtatcttactaagaggcagctatgaaaattctttagtgggtggtgtttcctagttttttactgtatcatggaaaggataatatcactgtttccttcaagttgaattgctggttttcataatcttataaacccagtacaaatattcttttggagcttgattagtcttttctctgttgactttatcagacttgagacataattatggcaatgtgtgggccttggggaaaatggagactattaacattctttctaataggagtttcttgctcttttttgcttcttcagggaaaatgagactagaagaattttttttttaagtttcaaaaaatgaacctattcccaactgcataacagtgtgttcctaccactttgcaaatgtctagcatatccataatacattgtttaatttagcaaatctagttttttttctgtaaaagttaaagaattgcataaaaaatttataaaagaagaaaatttttccaatacatgaaaataagaaggttctctggccaggcgcagtgactcatgcctgcaatcccaacactttgggaggctgaggttggcagatcacctgaggtcaggagtttgagaccagcctggccaatatggtgaaaccctgtctctattaaaaatacaaaaatttgccaggtgtggtggtgcacacctgtagtcccacctactcagaaggctgaggcaggagaattgcttgaacccgggaggtggaggttgcagtgagccgagatcacaccattgcactccagcctgggtgacaagagtgaaactccgtctcaaaaaaaaaaagaaagtttttttcctaggcattcttactagtcaccttgatggatgagaaaactgaggttgctacttgccagggggtcacatagtgaataaggtaaaaattgttggagcagatagactacctgagggaacgaccagagacaaatgcatgacctctcctcaccaacaattataaaaacttcattactaatcacattgagaagctgaaaatagcttttctatactatcaagaagtttttaaagtgttctagatgaaagactgaattatcattccattcccccatagaaaattatattattaaattattacatgaagagacaatcaaataccagacagcaaaaatatagagaaaaaaattataaggtttgattcaacagttaattaatacaaatacgttattttctctgtgttgtgatgtttgtgatatttttgtttttaaaatttgtaatttgcgatttctcattttaaataaatattcctttcttttttgtaattttgcataatttgtcttaaagagacctccagattttataagcttcaagaccattgaaatctgcctcttatccctaataactggaatattcaaatttttaaaaattgaatatagttctggcccggcacagtggctcacgcctgtaatcctagcactttgggaggccaaggccgggagatgacctgaggtcaggagctcaagaccagtctggtcaacatggtgaaacctcatctctactaaaaatacaaaaattatgcaggcatggtggcacatgcctgtagtctcagctactaggaaggctgaggcacgagaattgcgtgaacccaggaggcagaggttgcagtgagccaagatcataccactgtactccagcctgggtgacagagcaagactctatctaggaaaaaaaaaaattgaatatagagcaaattatagaaactgtaaggtccatgcaattagattttatgtaatgagctattggacatgcatattaagccacaggcagctctataaacatcagacaaggaactgtcagtattcagtgccacatatagagcctcaatatcctccaccttcatctctcaccattcccaactgctgtccttcatcactcactttgaattctcacatgactacatgatattctgattctcatacacgccttgcattctctcacttctaggcctttgctgctgctattccctcccatgttatatctccctgaacaactgcggatccaaaccccaccagacttttaataggaaaaagccaaactctctctttctctctctctctctttctctttctctctctctctctcaatcttcacctaagtgcctaggccagtccaagtactcaataagcagtagttgaataaatgaaagaatatggcaaattattaataaggttatctctggaagttggattaagtaagaaattagctattttctttttttctaattaaatttgtagctaactaatatagaaatctatttttttcattagaacaagctaaattagaaaaatctgatcaagctaaagtctcctttgaacaaattctggttccttctacaaagaaaatcatacttatgaatttggtgtatatttttaaaactcttattttatgtttttatatatcttaatatgtaagcatatttttgttgttgatattttataggggaacgtgttaaaaccaagtggtaacatttggtgcctgcaactagttcttctaactttacaatatatgttgggatctatcaactttgatgtgtgtgtgtatacacacctatcttcagtgattctcagtggtggggtgtaattgacatcatgaacaagacaattcttggttcttcaagactgtatcatttgtaggatgttaagcatccctggcaccctctcacaaaataacaatagcaccccgactccctgccctcattatctggcaaccaaaaatatgctcacagcttttcaaacacttttggttaactttttacataatctcatccttttagcactccactttatttatcatctccatgtcgatggacatttaggatggctctagatttcttactcttacaaacaattctgcagtgaacacccttgttcatattttcttctgctcatgtatgggtgtttcactaggtggaaactagaagaggaatcgctggtcatatgtggaggttcagttacaccctatgtgctaaattcccctccaacttagacccttatcaacaatggacagtaatagccattgcccaaattctccaatacttaatactatccaatcctttcattataaccgatctggtggataaagaaaaatatcacattattattgtaatctgcatttctctgattaatagtgagattatttatttgaaacacatctttcctcttctgaaaaacacatactttatcttctttacatgtatatattttaacttttactatatatgctttataatcagaataaaaggtaacacaaccttaaaaaaaaaaaaacaggttatatttcaaggcctatacagatgttggctcattcagggaacctgatttcgatctttctttttagaacatcccttgggtactttattctctcttggatatagtttgcaatatgcttgtcttattctcctgactagattaatggttatttgtcacccagtctgaggcttttccatttttgttccctttgacctgcctagcacaatgccttgcacagatttgaagcaatgactgaaggcagaaaaggttgattatgggaaaactaccaacttaactctatttttaacttttatggacacagtcttgaatcatccttatcaaaggtggacatatttctacaaagaatacaaatgtcattaggatatacattcactcccctgaaagaaatgctcatcagaatgttccaggaaaggaatgcttaactcaattaaaaggggaagtttaggtttttgtggaaaagctatttggggaatgaggatccttattgcaccactgacatcatggaatgtaggtggctgcctggaaagctctatactgggcttgcccaggccctggagtctgtaaactcctgaaaaggcaatattgactcaggcaaagctgccaccaaggaattgcagtctccaagaattttccagactgcagcttagtgtgattcttcttgcattatactcaagtatttcttatgtgtttatggtatatagttattgttttttaaattatcattaaaacattattagtaaaaactgttatcaggctataattagacgtcaaaagaattctataaatgttttaaacgcaaacttccaattctattgaaaagaatccaaaggaatgtccaaatcctttaaatgttttggaattttgcgaatcaaatattgctttacataaacaactgttatcaggctatataattagatgtaagaagaattctataaatgctttaaacacaaacttccaattccattgaaaagaatccaaaggaatgtccaaatcctttaaatgttttggaatttcacaaatgaagtattgctttaaataaacaatctgctggctcgaactgaaacttatgctgaaatgtttattataaagttaattattggcaaaatatatctaagtttttataaccttgtggaaatttcacctatcaaaaagaattagaattttggcttcagttgaacttgaactttattattgtttcacttataattcttccaattgttctttgaaagcattttgtagtgaacagatttgaacttgtctgggaatcagttcaatgaatggagctgctttgggtaaatagctctgtgtttattcttataaaatgtgtttcatgccattgctttcagctagcaaatatatttctaatataggatgaaagcatctctgccccaaagataaaatatgctaagaaacatgcattaggaaatgcagatttagaaaataggtatcttggagacctatgtaaaaacttccttccacaggtgcacttaggtttactctttattactcaggctaaaagtttatgccacagggatgtctcagtggatatcagtgtggttcatgacaacaagatcccttaatgccagaatagggctattcctcaaagcttttttacactatacacacctctttaatagcatttagttcatcacactgacattatttgtataattgcctgtctctctttcatcttcactgacctaaactgtggtccctagcagtcagcaactgcctctgctgtctagctttctgttatctgatctaaataaaaagtaacaaaaattctatttgagcaataagaaagtcatgccacagagggtaaattgaaagttacggctttttggatctcaatggcttcctggtagcaattaacgcatactaagcactgctttagttgccaggctttatggagcacatctcatccatgttaatgtgtgcaggactcacaactggcctatgccgtatgcctattagtcatactattttaaacatgaggaaccaaagctcagattggttaagtaacatgtccaaggccatacagctagtaagaggtaccacctggattgggacccaggcaaagcaacccccggggccacaatcctaatcatcacatttcatgcctctatgacatcgtttaaaagaatgtgaatgacctgttattggagaaaagaaagatggtgcagagcaatatgcctagaaaataaaaataataaataatgctcgtatgtttgtagaatcaggagtggaggtacacatccaatgcctctaagtgtgtagactatctcttaagaggaagcacaggaaaatggttaccaaggtgtcctctaggaaaggaacagggagcctgagggcccagggtgaagaaaacatgttttgctatgtctccttttggacaatttgaatttttttttttttaccatagatatatattaccttttctaaaacacaaatatcattttgaatctccttgagcattccctagctcttcagatacttgtcaggctgaaacagtacttggtggcatttacttcatactataattccttccatccagcttcgtttcactcatgacaatagcctttagtattatagcacagaggtttcgccgtgaaaaggtaccacacttgaaaaagagtgtgagagaccaaaaaaagaaggaaattggtcaaagcctattcttatggtattttgacttggactttaaaaaccaattctgattacaaagcaacactgtattagtttgctagggctgctataacaaagaaccacagcctgggcagctgactataagaaatcgattgcctcacagttctgaaggctcaaagtcggaaatcaaggtgtcaacaggattggttccttccgagggccgtgagggagaatctgttccaggcctcttcctgtggcttggaagtgactgtcatgttcatgcgctgttctccctgtaggcaaatctatctcctgattttccctttttacaagaggacaccagtcatattgaattagggcccaccctaatgacctcattttttttttttttgagatggaattgcactctgttacccaggctggagtgcaatggcatgatcttggctcactgcaacctccgtcccccaggttcaagtgattctcctgcctcagcctcccgagtagctgggattataggtgcctgccaccatgccaggctaatttttgtgtttttaatggagacggggtgtcaccatgttggccgggccggtctcgaacccctgacctcaagtgatccgcctgccttggcctcccaaagtgctgggattacaggtgtgagtcaccacacccagccatgacctcattttaacttggtaaagaccctgtctccaaacaaggtcacattttgaggtactgagaggttagcacttcaacataagaactttcaggacacaattcaacccatgtcacgctactattagtcaactctgtgctctcctttcagccccacccagggatttccttgtcctaatgttggggctgagagctgggtctctgggctacttatcttgaagaatgttgctaggtaatctttgcaaggaaaagccagtgcagggggagtcatgccatggtttggcctgagtgaaagcgctgttccctcctttctaggtggtatcacggcaacctcacacgccatgctgctgaagctcttctcctctcaaatggatgtgacggcagctaccttctgagggacagcaatgagaccaccgggctgtactctctctctgtgaggtaaggtgcttcagggctctacgacttcagcatgggctcctctgtcacttactgactttatcatcactcaaattgccagacagcaaaacttcccaattcctgttggaccaccaggttaaaggattccaaactctaaatgatgagggtgtaaaacaacattcctgctccattcattagcaggaaaaaaattgttagagctggaggagacatgaggaattatttgatggaaacctttcatgggactgttgaagaatctgaaacccaaagcggtggaatgtctggtacctcaaaaatcaacaatagaaacagtgccagaatccaaattcctgacacctggctcagtgtccttttcactattctttgatttctctgtaaatgcagaatgatttatgactgtacggctttcatagtcacaacctcaaggaggcaatatacatgtttaaaatttttcctatagtgggctagcttttcatattgagtctctatttctcccaaatggtaagaaagttaatccagtccccaccaggttcatacagccaaatgcagtcattgtccagatctttcaggtcctccccacctcacacccccttctttctgtctggtgccccagatcagagaggctgaccaagcttctggtagtcaggggaggcggctggttctcagtcgcatctgacactctggcttccactgacatgtagcaagtattcttgggtttttaggcgcttctccatggattaggcaggggatgtaaggactccatgaaatttccctcagccacccacccattaagctcaaactgttattgtgttactgttctgatggcacctccatataccctggagagtcactcttcccttcatagtgcagttcctcaagctaatctggcctcagaggctctctcacttctttcccagtctacacggtcactactggtcactaactcagtagcagcattcacattgtctctttgggctctgggccttgcttctatattcattttctatgctacataacaaattatcaaaaacttagggacttaaagcaacgcaactggattatctcacagtttctggctggattctctgtccaggatcctaccaggctgaaataaaggtgttggagaagcttgtggctctgatctggtatttagtgtcttcttccttcattttctcctttcctcttcatcctttttcatccattcccttgctgccgtagaactgaggtcctccttttccttttagctgtcagccaggggccattctcaactcctagacgccacccacagttctttgccacatggcacccatggctgtttaccacatgggtgtttgctttcttgcatgccagccagaacacatctccctgactttttcttctgtgagcagccagagaaaactctgttttacagggctcatgtgattagttcaggcccactcagataatgtccatatcttaacatcaactgacttgggactttatgacctgctaaatcccttcccagtagcatgtagactagtttttgattgaataattgggataaagtgtgtgtactccaggggctgggatttgggatcatcttagaatgctgcctgccacaactcccattcctggaacagtgaaaatctacaggcctacttgaagtgggtgggtgtgcgaaacaggtagagggtgatggggtaagtaggggtcacagaggaaaaacaagcatattcattaacatttctcatgtcaccctgttatattttatttataaattttctgaataacatagatgaaaaaattattaatccaagatggaattctgtttgagtggcaacaagaattgtgctttctctgctcaacagcaaatgttaaaagttcatctaatggttaagttgtagatgctttattgcacacatcagaggtcctcaacctttttggcaccagggacaattttgccacagaccggagcagcggcagatggttttgggatgattcaagtgcattacatttattgtgtgttttatttttgttattattacactgtaatgtataatgaaataattatacaactcaccatcattcagaatcagtgggagccctgaacttgttttcctgctactagatggtcccatctgggggtgatgggagacagtgacagttcgtcaggcattagattaacatcagaggcacacagcctagatcccttgcatgtgcagttcacaatagggtttgcactcctatgagaatctattgcctctactgatctgataggaggtggagctcattgagaatgcaaacaatggggagcaactataaataaaaatgagcttcgctagctcacccatcactcgttttcttgctacgtggctggcagggggatggatggggacccctggcatgaatcttccaaaaatgaaaagttaattaacttttcacctatgtatgtctcatctgagcaattagatcataagctttttataaatcaatgacatacatatttcatatacataaaaaataaagaataaattattgattttcattgcaagcactagagaatgcttattaaaaaaatgaccagcagaggtgacaaaaaccacagactaattcaggagaatgactatttttgttttatgaacaaatattcacttatttgttcattcttttaatgatgaatatttgaaagcatttattctgcaccagccactttggtacgtgttgtagaacagtggtccccaacctttttggcaccaggggctggttttgtggaaaatgcgggttcaggatgaaactgttccacctcagatcatcaggtattagattctcatgaggagtgtgccacctagatccttcacatgtgcagttcccaatagggttcaggctcctgagactctaatgccatcactgatctgacaggaggcagagctcaggcagtaatgcttgctcacccactgctcacctcctgctgtgcggcctggttcctaacaggtacccagtctgcagccccaggataggggatccctgctgtagaagattgaaataccttattttggggaattacagcctcacagagccaaaaagaccacatacaagtaacatactacaaagtagaggttgacaaataacataaaagaaagcaagataagtgtttaggtggttcagaagggaaaaagcagttaacttaagctggaattatcatgtaatacttgacagaggaggtggtacttgaactgcaccttaatgagtggctgggatttctaccagcagagacaaagagaaagaccgtttcaggaaaaaggaacagtatgaactaagggacagaagtggaaactccttgaagagcagtagatccagttggactagggcagctgttctaaaggtgtggtccccagaccaggtgtgtcacctaagaacatgctaggaatgcacagtctcaggccccaccttggatctaccgaatctcaatctgcaggggtggaggtggaggtggcagcaagctgggttctcacaagcccatcagatgattctgaagcatgctaacatggtagcatgggctgcactgagagtaatagcaggaagtgaggctagaaagatagaatgggatcaaataaagtggagaggcagatatatatatatagatatatatagatatctatagatatatatagattagatatctatagatatatatatagatatatatatattgtttaatactctgcctcatttcaaaaatgaagtggaaaatgacaatgtaggaaatttgatattttattcagtaggcagtggaacatgcacgggaggaaaagggctaggctcacgtaactaatcaagcgacagagctgaattctgattgactcccaaacaagcaagggagaaaagcccaaggcagaggagagtgtggtgagggtgtcatatgtcatttctatcattcctattctctgcccttcttaaactcatgccccttagcagcataatgttcaaggactcttttggtaagtctaggagtagatagggagaacagtctcttgtcttccattagagtgaaaagttgaggctgggcgtggtggctaacgcctgtaatctcaacactttgggaagccgaggcaggaggatcacctgaggtcaggagttcaagacaagcctggccaacatggcaaaacccagtctttactaaatatacaaaaattagccaggcatcgtggcagacacctataatcccagatactcaggaggctgaggccagagaatcacttgaatccaggaggcggaggttgcagtgagcctagatcatgccactgcactccagcctgggggacagagcaagactctgtctcaaaatagtaaataaataaatgaattaattaattaataaaagttgaaaagagcaaactctgccaaaagaaactagtgatgctatttaaaactgtcagtggtttcaatgattgcctaattctcagttcttataaagggttaatagtgatgctaacatctgagatcatatttcccttcaacaagatatttatttgttaaataatattaaatacttctttttcccttttagggccaaagattctgttaaacactttcatgttgaatatactggatattcatttaaatttggctttaatgaattctcatctttgaaggattttgtcaagcattttgcaaatcagcctttgattggaagcgagacaggtaagctatgagcagacacttgacttatgaaataatgtttcgggatggaggagagacaaggcagatttcaatttaagaatgtcattgttgtcatttatatttcagcattatcttgaagagaaaacaatgtattttgtataaagtagatattttctcagaatgtgttacttaatggattgattaaaagcacacaatttctttaaaatgggctcaccattttaaaataacatatacaatacacacaaaaagaacaaaggtaaaaatgactttttgattactcataatttcagatataggcagtttgcatatgagtgagacccacagaagtaaattttgagcattttaaaaactaaaattcccacttaaatgttcacagagatcactgaatattgaaaatattaactaggaagcactctcctaagttataaaattctgtttctattgtcacggttttttaaataagattttaagctagacttaactatggctggaaaagtttgaattttcctgtttgaatggttagagaattaaaccagaaaaaaattcatgtgtaaagaaaaaaaacacaaaaaacagtctatcttggcacttgaattatctaagattgaacatcttgtttatttatattattttaatgaagtaaaatatcatccctgtatttgtgatatagaatcacaacacttttgtcctaaataatgataaatcttagttaatcaaagactaggaaattccaagaacctgcggcacaagaggaactcaagacttaataacacaaccagttaccatgagtttgtacatacgtgttttcttggcaaacttgccagtgggctttctgttaacttcagtgtgatgggaagagatggcatcattggcttctgtcttttctgctatttatgtggtgtgggtagtccctgatgtgactcacacagtgtctagtatacatgaagtgcacagcggaaactagaaaatagttgctctgctttatactgaccacaccaagcccaagaaagaataacccaaactacgaaatgaagttataacctttttttccttctttctcctggtataaattctcccaatcaaccctgaaaattacttcaccatttaacaagcagttgttcccatgaacaaatggccagtggaggtgtatttatttccactgctaccttggccttggcaagcatttcagtttctcaaatccctacacttcagtctcctttcctgcttgcatccaattccacacttgattttgttcagttattggtcactggccatgtagaggagatttttaaagccagggttttgttttgtgtacctctaatttttgtatttcatatccgccaggtcctggcccactgcagggcattttgggtgaataaataaatgaatacatggataactatgagtaagaactctttgtagtcttcaaagccactagagttgtcatttttctactttctctttttcttccaaccaaagacagctcccttcttttaaattcttctcctagactctattttcaacttctttgatcattccctgtgctccttcctgggccttctccaagttagggaaaagatacatattctgcctactggcagatttcaaaacatttaagatcaaagtgaaggcagtgctttctggttgaacctttctggcactgatccaatcatcaggcaagaggatcacctaaggatgcgccaaaataaagatgttttgatattgcatttgggacaatgataagcttccttgtaaatacactgttctgagtaaagaagccttatgattgatgcattagggattgtaaggatttgtcatccagacttctacagtagtttctctaaaactcaaacctgctgtattattatcttgactacaattgccattttatttattacaatataactcaggaacctaatatttttatcctctccactgcctctcctctgttctattcattatccaatgaagaatttgctgctgtttgaattcctgctttcggcccctcgtgctgatggatatgcacttgacttgctggcttccagcccttgagttagagtccaccagctttattcctcttatctgtcccagccagatgaagggaaagccatcagggctaggaacaacaggcaaaacccatgacagatgagtgttcaaatcttgcccctctgggagtaataggccttgggaaacaagataatgtgctcaagtcatgatgacttgtaagcccagaaattcctcaaggttacggagtcagcattgcagactataaagaatggtgaatggaaactgacatgccaccttctaaaaataggccttttcttcttgttcatttaagcatgggctcctagtattggctcccagtgatcagaagatcttcaggctaacgatttcatgttcaccttcagatgaagtacagatatttctttctttttttttttttttttgagacggagtctcgctctgtcgcccaggctggagtgcagtggcgcgatctcggcccactgcaagctccgcctcccgggttcacgccagaagtacagatatttcttatagcttatgtttgattaacatcaccaggaaaagcatttgtccacacaatggacaagcccctcccagggctctcaacttcagattaccagaatgacaaggactagaattggatatttcaggccactgctctcagccagaccccacccaggcccagcctcaccctgcagggtctagagggtaagtttattaaagagtgactttcttataatacatttatctactggcacaagtggtattacctttgagggcaacagaaatgatatccaaatagccaaaactttacacttttgccttgcagttatatataatgccttcagtagagtgaaacccagaatatttgattttgggtcgtaagaacatttttgcactcaaaatagataaaagtgttgacctaaggggattaatgctattttaagatatcttttttttctattccctactctttacacttttaggatttctgtttgctaatctgaaaagcaaggatttcctaagcaacatctaagcctcttgacaactttaagagtattttatgataatttccctttcccttgccataatctctatttcatctctctaatctccattaaagtttctgttcactctaatttctttttatcaatacccataaacactcttaagatacttccaattctcaaaacctaataatttcccaagtacatgatagagatatacaatgtactctcttgctttatttttctcaatggcccttttaccttctgacatctataattcacttatgttttttaaaaaaatacctttttttccacactagtgtgtgaactccatgaagaaagggacttttgtcagctttgcttcctgctatgtcccaggacctgaaaaaataagtactgatcatttccacaatatgtcatgctggatgccccatttccaatgcctgcattgcagttttttgcatggcaacatcaaaactagcaaacttgtgacaattttaactttcaaagtttataaaaacataatttgaaatgatattttgtgttgcatgtatgctcagtgatgattaaattcagaatttgcctttcatttgtgatagtgttgcaggacttttccttagttcagctaaagatcgggtccctctccatcccacggccacaaaaatttaggctcgcagacggtttgaagggtgagtgaagcagggttttattggatgaaaagaaagaaaagagggaaacagggaagctagagcgcttcctgcccagcagtttgaattctatgttcctcacaggaagaggaggggccaggctcctccccactgcaaaggacacgaacttcctaaggcttcacctcagtgggcaggccggttggagtttttctgtctcaatagtaggatatcaaataaaacatattcatgtctgtgcatgaactctaaactaaactcaaatagacttgaaaatttgagaaacttttttattagtataaatatgtttggtccattattaattttgtcgtagcctcttgtaattagctaagtttcatatatatagtcttgaaaatgtagacggcatttatctttatgcttaaatgtctaaatatgattagaacaaaaaattacttttaccattaccttttgtttatgtttcaataattcttaacatgaaattgccatgtataatttattacattgtattgtgactgtaatcacctaacaggcatgaaaaaatataatacaagtcaagttctatgtttgtgcttaccctttataataattggttcccaattttaaagatctcatctggttttttggtaaatgtcaaatctccatttctctttttgttttgatatggggattcccaatcttttgacgacagctaccgctattattattttgttttgtgacaccacccaggtgatatttttaaataatgtggttaaaattaattttaatttgagaattgggtggttcttcagaaaacaactagtgacaacttagaatttttccaaacttccttggatgtttgccaaaaatacaaaatgttctcagtttatagatgagttttattcgaaaaaggaaaaagcagctgaggaagggaattaagccaacatttttagagtgtttgctaggttccaggcattcacctacatcaacttatttcatctcagccacccacaataatgcatacaacggtcctattttcagatgaggaaaggaaaactcagaggttttaagtcacttgcccaagttttcactgctggtaaacatcagggctgagattggaatctgggctaatctggttctaaagcatagatgctttccatgcaccttgctatcttttgaaactggtcccacaataacagtacattgttgccatggtacagtgtggccttaaatggatttggaagaactcagagctgagattggaatctgggctaacctggtcctgaagcatagatgctttccaggcaccttgctatctcttgaaattggtcctacagcgacactgcaatacattgctgccatggcacagcatggcctttaataaatttggaagaatttctgctacaataatgtagtagaatgattgtaggatatggcagggctgtaacacatgtcttagtcctatccctcagtctcttctttatctcttctttaaagtctacaataacatgtttggtacatgaagtaaacctattgttctaaagagtgtgaatcaactttaacttctgcctttgtatttattgttattcccattttatttacatgaattgctatttcagaaattataccagaggaaactttaaaacataaaaaggctgaaaagaaaacatccccctaaatatacaggctcatcttagtcatgtgtcttcagcaaggatatcaaacagcctgtctaagtataacaaagtaaaataaaatttacagcttgagagagaaactgaaagaaagggaaaatgagaggtaagatcaaatgacagcaggaacaaagtatttcaaatgaatattgtacatttacaggaagcagtacaagcatttggtaatgaagcttctcgatgtttttttccccttatttgggcctgtatgcttagttagatttacaggatgttagaattgaaagggagctcagggactattgcatttttcctttataaatgaagaaactgaggcctggttagaaatggggaagcaaaaactcacatctcctttctcaagctgcctcctaaagaatcaatttcttcaaactttgatttatacatgtcaactcttgcccacaatacagcacagtatttcacatgccctagaagtttccatggtgactagattgaggctgagaataattatggtataatgagtaaacacacaaattctaagtttcaactccagcctctgccatttgccggctctgtgtgtctcctcaggtaagttaaataatctctctgagcttcagtttcatcatcttatgaaactgattagatggtagtagctcatactttaatgacttattgtgaagattgaatgaaattaggcacataggacatttggaatgattcttagcatagtataagtattcaataattattattcatatttaataaaatgcttttatggttattaattccatcagattctatgcaaaagctgtacgttctttgataaataataaagaattagtttagggacaattgaatttgcatttatcaaatgtttgtgatgtcctcttcaaactttaatctagttccatagtggactcatataagtggtagaatcaagtgagcactccaaaaatagtgacttgacttggatatttgaacagaattttctcctacactgactaactggtatgtctctcctagttcagtgcacttcaccctatgagactggaaattaaatattaaaaccccttcacatgtaaatgaacaaggcttaaagtccatttgcagagcaggtggcaaagaaggaaggaaaaagatcttgaataaccctattctctcccaccaaccccaagaaatctacttctcattggaaggaggggagagaggaactcattatgccagttgcagagcttattttctgaacctgagggcagtaatgaaacacggatggacatgatctgattttaatttaattcaacaaaatgttttgagtgaaatggccctgtgagccactgataacatagaaagataaatcagatattattcttgccttcaaacaccttacaggctagctggggtacctgatgaataagcactgacctcactgcataaaataaatactctaaacaaaagtttttctttaggagttttgtgtaccctgtgctacactctatttcagataccaaaccaatgcctaagaattgagactgttcttactctctttctgagttcctgctggaatacaagataaagggtccttcaatgcaatttcatattattgcatacagttatatatgtaactcttacacataactgtaagttaccattcagtcaaagtaaatggaaatgcctgccttggtccagctctgatcatctcaaaaacatacctccgctaagcatggctgaaaccaggtttcatgtcaaaggcaggaaacaatagtcacctttacgtagttcagaaactgaagtgaaacttatagccaagtttccaaggcctgtggttactggtcttcctcattcttcttgctctgctacccctgcctcctgttgcctttttctaaatctcccagctgagtcctggagttcatttggtctgaatctcagtaacccagggtccctttcttcccgagctgaggcactaacttggaccttggaggcaaagtattaagagtctgtggtagcgacagtagataagtttgtttgtttgtttgtttgtttgtttgttttgagacagagtctcactctgttgccaggctggagtacagtggcgccatctcggctcactgcaacctctgactccctggttcaagcgattctcctgtctcagcctcccgagtagctgggattacaggcatgcgccaccatgcccggctaatttttgtatttgtagtagagacggggtttcatcatgttggccaggatggtcttgatctcctgacctcatgatccgccccctcggcctccaaaagtgctgggattacaggcatgagccaccgcgcccggctgataagtttcttttgattggaaatgacagaaaccagctctggctagctgggtttttttggtcttgtttttgattttgtttttaagtgagtagggtacaagaacagggaacaggagcagaatttttttttttttttgtgatggggtctcactctgttgcccaggctggagtgcagtggcacgatctcggctcactgcaacctccgcctcccgggttaaagggattctcctgcttcagcctcccaagtagctgggactacagacgcatgccaccacgcctggctaatttttgtattttttttagtaaagacggggtttcaccgtgttagccaggatggtctccatctcctgaccttgtgatccgtatgcctcggcctcccaaagtgctgggattacaggcatgggccaccgcgccctgcccaggagcagaattttttaaaaggatattaacaatataccctcccagaatttaagggcaagttgaacaaccaagagacaacaaggaatctgcttagtaatcatggcaagtctgaggctttcagtcaattgatgtgtctgtcttgattcatctctgatcgtctcagaagtgtacctccgctcagcctttctgaaaccaggtttcatgtcaaaggcaggaaacaatagtctacttcatgtagttcagaaattgagttggtggaccttctctctagagaagcaattaagtggatccccaagaagtgaatccaattagtgtgaccaggtcaggtattcgagggccgggccaggtctggaggtataacatggttatagggaacctatctctgtatactgggaggtacaatctctgcagaaggggaaatcattaagcctcacagccatgccaagaagtctgtatattggctcttccttgggcaagaatagtcatctaaggagaactgtcttttaggacaccagatttttatcagtataagttgccgttttataagtactttgtcatcttcatctcacaatttagtttagcctcatttgtggggttactagttaaaatcaatctacagtcagttttactctcttggttgactcaatgccattttcctttgttttacttttgttgaattaaactttagaggaggttttcaaaatagaatttgggttcctccaacagagatttgaaaagttatgcctgcggttattgtcctttcttgcctcaggcctggagaattgtggacctgggaggctggttcatcccaggttctttcttggttcaagcctgcattactgtagcattcattcattaattcattcactcatctgccttcattatgtcagaaactctatcaagtggtagggatacaaagataaatttgactgataggtgcgctgaagaggctcacagaggttggaaatgcacacgttggaaaggcagtggctgtctaataccaagaggtgacagcactgcaggctcaggcagcagcccagcccagagatccttaccctgcagcgcaactggccccggtggctatttctcctccagggactgatactgtggtaggaggataatgcccccacaggacgtccacatgtctccctggacctgtgaatatattgttacatggcaagagggaattaagtttgcagatggaattaaggcagctgatcaaataactttggggtggggagattatcctagatggtctaagtaagaccactgtaattgacagggtcctcataagtagtagggagccagaagggagagaaccagaaagatggcagcaggagaaggatctgactggctgttactggctttgaagacagaggaaaatggccacaagtcaagacatgagggcacctctgaaagctggaaaatgcaaaggaatgaatcctccctagagcctccactaggaaagcagccttgccagttttagactagtgagacccatttcgaacttctgacttccagaattgtaagatgataaatctgagttgttttaagctgttatgtttgtggcaatttgctacaatagcaataaaaaattaggccaggcacagtggctcacgcctgtaatcccaacactttgggaggccgaggcgggtggatcacctgaggtcacgagttcgagaccagtctggccaacatgacgaaaccccgtctctactgaaaatacgaaaattggcccggtgtggtggtggatgcctgtattcccagctacttgggaggcagaggcaggagaatcgcttgaacctgggaggcagacgttgcagtgagctgagatcgtgacattgcactccagcctgggtgacagagcaagactccgcctcaaaaaaaaaaaattaacacaggtattattatgtgaagtgtgtgcctggtcgtatcaactaagtacatctttctggagtgtcatttaaagcattattttcatattaagtattaaatatatgaagtagaatgaaaattaagcatcaactttgaagataaagtataagagttcaaaatgtatctaatttgggagctgctttgatccctaggcttcagttcccctctcctcttctgtaaggtgaaagtgtttgagaggcaccaatttaactatagttaatcacaagtagtgattactagactaccaccatttttattcctagcagaatgttgcgtctaggtcttttttaagatttcaaaatccatgtccccaaagatgcaatcattcaaattttatttaaggatttaaaaatattctgtcaaagaataataatatctaatatgttatcattctcccacaaacatttatttggtgccttctgaaggaagcataattattctcactagtaaggagcagaagcttgtaatggttgtccaaggccgataagtactgaatggcggtagtgacaattgaaccctgttcctctgcctgtgcatccagtgctctttccaagggtccagagtgactatgaagcacatcactgggagtgtttcttagggttgggagccagcgctgaatttaccatgcatctacaatgtgagcactgtgttcacagagcccctgagcctgcacagcagctactcttgatataggtactgctgctttcattctgactgtaaaactgtagccggccccttctcctcatatgactggatctgttcttatgggaagatcacattgacaaaagagagcacaatgtgcaagaatgggacggttctgataatggcaaaatctgtttttcattgtgatcccaatgctgcaatgccaatgagagacagaaagaggaagggccagaggctttcattcttctctgaggtcgagatcagacaccctcttctggcttttctcaacagcttttcattttacagcagcaccttatctgggcccaagtatcaaaagccacagttctgtttttgcagtcagacattgtatgtattcaagtatcatagacaggttttgttttgtgtagttttttttttttttttttttttttgagacagagtctcactctgtcactcaggctggagtgcagtggtgcgatctcggctcaccgcaacccccgcctcccgggttcaagcaatttccctgcctcagcctcccgagtagctgagactacaggtgcctgccaccacgctcggctaatttatttttgtttttattttgtattttagtagagatggggtttcactatgttggccaggatgctctcgatctcctgacctcatgatccacccacctcagccttccaaagtgctgggattacagatgtgagccactgtgcccggcctgttttgtgtagatttatcattaacattagggtgttttttaaccacagaggagacatttttctttttcattttctcactcttactctaattcaggttctatactctccagatctttcaaatcttttcaaagacgcccttcctgatgacccttgtaaaatatcaccctctcccaaccctaccttttctattctctatccctttaccatgccctattcattttttccataacacttctcacacataaaatattttttaaattttttttctgtctcctctacctagaacataagctcgataagagcatttaaactcctttgtgtgctattgcattcccagtacctagacaagtgcctggcagagtgcaaagctctgtaaatattcgttgaatgaattgctgaattctttacatctcttccatgtctggtacaatcttaggcttgctatagaaaagaccctagtaaaattaaaagcaagaaaccatagcaagaagaaaaaaaatccccttaagttgcctctttttgtagttagtttctagtttctgattgactgattgattgagggaaggatttcaagaaggaaatgtcagaaacatagactcagaactgctctgagcccttggaacaaagttccccagccccccatgcctggaccccctgggctgagccctttttctgcctggaggctcccctctccagatggaaggggaaggaggcaatcacttgtgagcaccagcttgttcaggtcatgttcacttagtaatgcaaagactttgcttggttactttcattaattgggtagtatcagagagtagggagaatgctcacttttttgaaatccactaatttgttacacgtttattcggaaactgattgataggaaataagggcaatggaatggatcttcctctaccctagtgcttttgtttagtcttgttctcatggctttcataaagccttcctggaaaacttccagttactacttaagatctaaatcaaatgtcacctcctttatgaaagctgtcctgaatcctttcatggaaaggttcttcaagcagtctggggatgattatcatgctttgctcacacggctgccattggtctcatcaccctgttcatttaaacgaccatatctgttaccagttctgagcaccaggaggccaaggaacatctccatcatgctttatatctcagtgtccagcttaagtgccttatacctaattggtatttgataactgttgagataatgagcgagggaatacatgaaaaaaacaaaagactttccaatccagccacagttatccagttagcatttggaccttccttctgggaacactgttcgattatatatttttcatcttcattcaggcactctgatggttctaaaacatccctacccaagaaaagtggaagaaccctccatttatgaatctgtccgggttcacacagcaatgcagacaggaagaacagaagatgaccttgtgcccacagcaccttctgtaagtgaccttcaacgtgaccacaagctctctccctgtctaaaatcaatcaagttcaataaaagttaataagagtgtatttgttcacataaaaattctagcttggaatataaaacttggaaaggaatgtgagatttgaagcctatgactcagttcatctggtcctgggtagatcataaaaattacaatgcagccagacatggtggttcatgcctgtaatcccaacattttgggaggccaaggtaagagaattgcttgagcccaggagttggagaccagcctgggcaacataaacatctctacaacaaactttaaaaaatattagctgggcatggtggcatgcacctgtagtcccagctactcaggaggctaaggtggaaggattacttgagtcaaggaggttgaggctgcagtgagctgtgattgtgccactgcactccagtctgggttacagagtgagaccttgtctcaaaacgaacaaatgaaagcaatgcaatagtaataggattttaaatacttcgaaaatggaacttaaatctctgtccttagttaaccaaacaacttcaaagtagaatggaaaagagaagtttgcattcacatagttttctaaactgttttctcctacaattttcttatattaagaaaatatatttttttaaatatttcaactatctatggaagacaaatattctccacctttactataaaaactcagggtattattttttctagctttttttcctttactgactgaagtttacagacagaaaacacttgtgcttctttgcaacgtgagccattgttcaatttcagtgcaattggagcactcattgtttgtccaagagtccatttatgtttgttctgtgaactgtgactctgcagaggttcctctccaacacccttttcccttcattattctgaaggcccttctatttgttgtctcttccttgtttgctgaatactcctggtataagaaacctctatttgggcagatgataaagaagataatacccaaataaatatcaagaactaattctggatagtaatcatgacacttgaaaaataatcacttgaagatattcagctacaaattatattaaaataagtgtaactttctatatctgcagtacttttctctacccttgaccagagagatctttcttaaaaagaaggcttgccacatgacctctgctttacatcctttggtgatgccttttgtgttcatggcccacctggaccctgcttgcctctctgtcttcatctcatgctactcccacactcacactgtgaaacctgtctctctcaacattgtgctctttctcctctccctacatctgaaatgctgccaacaccattgctatctactcatccctcaagactggtatcacggatcattatcttccaggaagcctttcttcacccccactagcttcttttacaatgctcctcttctgtgctccagagcaccctctgtttgcctttattctaaaattaccatgctgtgggctaattaccttcacatctctctgccctccccaccagccagaaacatctaagtacatgaatcattgcttgtccttgcagctttacagcctagcctggctcatggcacatcttacatattcattgcagtgctacatctcctcagaaataaaaatcctgaaaattgactgagaaagttattttggctttgttagaagtgggggagaaggcatcaagaactcagaacttgagaaatttaggagtgcaagacaataaatagtccaaaggcagaaaagaccaaagaacaaatcaagatctactctgcaaccaattcttgttttccagttgtccagtcccttcataatttcctctttacccacccttacccttaatatagatcaccagtcacttcaacatctctttcatttgccctgttagtttaacttcacattctcctctgctacacttcccctaaagatctccactcaaggtcaaacaaaccatgtcctattaagcgtgttctttatcggcaataaaatgcagataatacctaatttgtgagattggtgtgagcagaagatatagtatccttatgcagaaataaacctctttaaagcacattctggaaaccttgttacttaccttcttttctcactccagctatcagatggattcacctcttttaaaatggagtttttaaaatagtggtgagtgattggttgacaatgacttgaactcacactatataatgacaagcttatgaagttgattgtacatcactatggacaaaaaaaatgtaaaggtttcctagaggatctgaaatgtttctcattacttctcattggggaatcattggtgactggaccagtatagctgctggggaaagagttctggtctgatcagaatgctcttgtcccttattgaacacaagttctaagccttcatttgctaccccaaatggctacatgatgctgcacctccatctccagcctgagagccctgagggttttcaaacttctgcattttctttttggggtgtagttcttgctcaaggtctagcagtggaggaagagaattaaaagaacttcttgtttgaagcgaaagtgaaagatgccccactgcccagaaatgcagatgactgtgtataactgtttaacatcttttagtaactgcatttggggaaattgctatttatgtcttataaacaacatagcattgagttcccatgataggattaaatttaattaattcatttattaaacaaactttttttttttaaagtgcttccaatacactcagaactgttttaagcactgggagtttggcagtaattttgacaaaggtcctcctcccctcactgagctcacattctagtgaagatcacagacaataatcaatgcagtaatctgataccagacagtaatacatcatgaaaagaaaaagtaggataaggggagaagagggaagcaagggaggcctctgtgaggaggaaccattagtaagagatttcactgaagggaaggagtgactcatgtcaagatgtggaaagagtgctgcaggcagaggaaacagtacaaaggccctggagtggaaacaaaattgaggtgcttcaaaggctaggaaggtcagaattacgggatgaagtgagctagaggaaaagttgtagaaggtgagattattgaggtaatgaggggtcagatcacataaggcaatggagttttcaaagagcagcacctcccagctgagcatttagaaatatgagtgtttctgttggtgcattgctttgcggcactactatcatgcgtgagtgtcaagagccatgaagagtctgactttactctgcttgcaagctaacaagttagcctgctgcagtttcatgtatgctgatggatgacacaagacttctgggtaagcgttgaaaaatagtttgctattcacaggaagagcaacagccaggatatcagtatttatgctaattccctgtgctgagccgaagttcccaaagggcaatattgaaagggccaggtgatatccacaatgggttgccctacaggagaggaaccctgagccttgggaacccaaatcttttctaatgatcagtagacatgtcttttgttctgaagggaaatatttctttattccaaggctgcttgtataagcatactttaaatatcagtctgcagcaaagaactgttaatgccttgctcataagacatttggaaccttgacaagagacccgtggagattatttcccaacagtgatcaggggctaactattcttcaaagagtggtagagaattatcttgcccaaaatctcagtagtaccttttgtacataacatgagaattctttaccttctgagcttgtttaaaaaaattcttgcagatggattgaatgtgatacacgaaagaaagagtagcagagtcatggcagagaagccctgctatttactgagaaggctaactctgcaggaggggtgggttgaggggatgagaaagaagagctctattttggacatgttaaatgagaaataccaattagttgtcttggtagagattgagattaatatagttcaagttcctgacataataggtcctatctaaaatgttagtttccttagcttcccttttgtggtatttgacgtttttaacaactccctccttctaaaaattctgtttccttagctttggcaacatctttctgtctttattccgtaatctttgacacattttatagttcctcttcttggatactttccttgcacgttgcccttttccagtattttgtttttgaaactcttctcaggtttaacattttgttgcttatcctttcagtcttttacttgaaaaaaaaaagtatatgtatgtatatacacacacacacacacacacacacacacacacacataaaataatgagctcttcattgtagagttgtaatattcttgtttaattaactatatatttaaaatttttttcatgtaattacttagttttctggaacaccattaaacaaattccataatattccattatttgagtatatcaatttattcagttaatccactattatgttttaacatgcttttttatttgaaataatgtcaaagttacagaataattgctagaatagtacacagaacttggttttccccaagtcgtttgatagtaaattgcctacatgatgccccatcaccctgaatatttcagtgtgtatttccaaaaataagggcatttgcctgcgtgaccagatagagccttccaaactagaaaattaacattgaggctgtgccactgtttcatccacagatctcattcaagcttcactagttttctcagtaagttccgtcagagtaaaagatccagtcctcaagcacaagttgcacttatctgtcctgtctctggaagattcttcactttggaacacttcctcagtttttccttaatttcgtgactttgacacatctgaaattaaagaccagttattttgtaaatagtttcccaactttggtttatatgatattgaatcatgattagatacaggttttttcatgttggctacaaataccacaaaagtgatgctttgtttgtgcttctcactgtgtcttctcagatggaacacaattgcaatctgtctcataatggtgtgtttgattacttaagtggtgtctgccaggtttcttcactctaaagtcaccatattccctttgttattaaaaaatgtttggggtgaggttatttgagactataagaatattctgttacttattaaatttttacttgccaattttagcatttactgatgtgtcttggctgttttaatcattactatgattgttaccaaacgatgactctctgattttcttattcctttttacattcattggttgtcattctactgtaaggaaaagctttttattcttcaaaattttcaatcatttttatatcaaatggttataatcatgactatcattatttattttgatccttcaaaatttccctgatttggccagtcggggaaagagccctttcaagtggtgtctgtgttcatatgacctcaaaaaaaattttttttttttggagacagtgtgtcactccgtcactctgtctcccaagctggagtgcagtggtgtgatcacggctcatgaagcctcgacctcctgggttcaggtgactctccctcctcagcctcctgagtagcagggactacaggtgtgtaccaccactcctggctaatatttgtattttcatttttttatttttttttgtagagtcaaggtttcaccattttaaccaggctggtatcgaactcctgggtgcaagcaatgctcatgcttcagcctcccaaagtgctgggattatagttgtgagcctccgtgcctggcctggcctcaaaattcttttaagaactttcttactttctgaatagcaagatgatccagacttatcttgttctttctttgtacccagctctagaaccagctatttctccaagaaactctgctctttttccacagaatagtactctagaaatcgacatctaggtactatgtgcttattgttatcaggatgtcactctcccagcccactcagtgagcagagctgggaaaatatgtatgtatatacatatgtacacatatatacttttacatctgtatttatctgtcgattcattcatcgatccatgagttcacaacaatgcttccaataccacaaagttcattctagtgttttcccttctcccacagtgagaaaatatggatcttatcatcctcagtacacttatgtggtgatcaattgaatataagcaatctcccattgctgtttctactactcaacccttaccccgacactccaaccacccagtcatgcttcaatgctcagttccaggccactgctgctcccaccctcactacagatgtccacctagcccaacttggctctgaaactgtgcagtagctgccacctccaccccttcaggcagaagccctccacaccctgccaggcttcaatgcctcgcacacagctgctgctgccactgtcactgccagtgtccacacagaggctccctgtgccctacttgggctccaccaccctgtactaaggtgcttgaaagccctccacacacacatcaatgcctgccttgcttcacctgaactgtgttggctactgacttcatttaaggctggcaggcaagtaggtagtaggatggcaggaaggacagtcctttgtttttgaacatttagatggtaccccaatgggggctcttataaacagcttttctgttacagttcatagatttttaaagataaatgtgctctataattatttactttcttacatctggagaccctgaataaaattaatagtctcattgctttcccatgcagcctttggcttacctatcaaaaccttagaagaatactacacttatagtacattgtttgggtggaggtaagatgggattattccctagcttgattttagtaaataattctatcaggatcttttatacaacaatttactcctagttattttgcctctacagattttaacctgcaacagcccaaaataattactttttgccattcctataacacctgaattcaactgagtcaattcaatttatttaatgttaaaataaatcacaccaattatgagatatcaaattcaccaatattgattaatattatttaagtgaa

SEQ ID NO: 2503 - DNA, 15702 bp, Homo sapiens
gtttttattgtttccactttattgctctagcatggaacttcaggcaagcctggaccttcatcaacatgcaaagaagaggctgagggggtttggggacacaacctggctgagagggaaaactgacaggggaaataccagaacgggggacagggggtggtcaccatgacaccaggagacagcatcagccatgccatctggggtgaggaagggaacagagaagaaatggtgtttcttcccatgtccctaacacccacatggaggccacatttggaaatggactgggagagggaaaggatgaggaaaacagctgcccaggagtctccttctccaccctgggttcatatcagaccccatccctaccacttgcctcttctacccctggaaaatggacctaacaaacagaaggagcaaaataaattaacactctaatgagcatgtatggatggacatatgttcatgtgcaatgggggaagggaagagggggtgacaccacctaaaatgattccccacctcaatctcccagcctactcctttcccccttccccctaaagccaccatccaaccagatagaaaaataaaggtctaattcactcaaaattcttcagtttttacaaaactaacagggcagagtagggagacggggggcaggcagccacaggagtagggctggtggagaggggctatgcttctgtctccacttgagactggctctctgtggtgttgctcttctgctcctccatctctgtgtcagtgagattgtctcctgaggaagcctctgccttggccttgttctcttcctcagccagcctctcaaacgtgttggcgtagagcgtcttctcccaggcaagctgcctgcagatctgctgctggcacacagccagctgggccttggcggcttcgttgttggggtagagctgcaagaccttctggaagtcagcctgtgccagttcaaagtcattcacagccaggtgggcctctccccaatggaagaggcccttctcgttgttgctgcccagttccagggccttgttacagctttcagtggcagcagagaaggcctgtagtttcagatgacacatggccaggttgaggtaagaggccagttgaagggcctgtgccttctgtgtttcctcattggaaaaactagactcatattctacccaggacacaatcctcttatattatagtaaagcttgcttgtatttgccttccttgaagtacacagtgtcccactctttcactgtggtgctctgctccagcttctcttctgaattcatctcccaagactccttggtcttttcaaaactcttgaggtgtaattcatatttcagctaggcatttggtgggatttggaacttttccttcctaacactgccaaaagcatagctgggtttgaggtacacaatggaatgttctcctttctacatgcactgaatggccctctccagaccataaggcagatccagattctcctgatgttcaaagaactagtccttgtagcacccttccagtgcaatctccatgatagcaccctcattgggcctgggatagccttcaccgcaagtctgtaattctgtagatgattccgccatcttcttcttccgtcagatcttctcccttaaactcaaacaactccacctcaaacacgagtgtggcattggggagatctttggaggactgcctgctgcaccgaaggcatattctggtttgcaggtgatatggcacacctcccctgccttcatggctgctatggcaatgtcccaagccttgttgacctccccttttcccaggtcaaaggagaatttgtccttgtgatccagactggggtcaaagtttgtgccatctaacagccagccagtgtagtggacaaagattcagtccccaatcatgggcatctctgtacctgtgccctctctcgatgaccttcagcatgccttcctcctgtttgggcgaatgtccactccctccatgggaagaggcgccaactgtgtcccattctcagtctccttcatctcctcaactgtcatctccacgcagcgcaccctttctgggagctggcaccggcaccagcatactctgagccaaaggcaggggtgctaccttcagggtgtgcaggaggccaggtgctgtggtgctgactgcggaccacatggaggctggagcacctctgccagtctgtagtatgatttgaagtcaggtaatgtgattctctccagttttgttctttttgctcaggatagctttgactattctggatcttttgttgtaccatgtaaattttaggatagttttttattattaatatttctgtgaagaatgtcattggtattttgaaagggactgcaatgaatatgtagattgctttgggtgatattgacattttaacaaaattgattcttcccatccatgaacatggaatgtatttctcttttttggtgtcctcttcaatctcttttatcagtgttttatagttttcattgtagagatcatttctttggttaaatcctaggtgatatggtttggctgtgtccctacccaaatctcaccttgaattgtaatagtctccacttgtcaagggtggggccaggtggagataattgtataatgggggcagttcccccatactgttctcatggtagtgaataagtctcatgggatctaatagttttataaatgggagttcccctgtacaagctctcttgcctgccaccatgtaagacatgcctttgcttcttctttgccttctgccatgattgtgaggccttcccagccttgtggaactgtatgtccattaaacctttttcctttataatttacccagtctggggtatgactttattagctgcatgagaacagactaatatgctacatatctaattttatttgtggctattataattaggattactttcttgatttctttttcacactgttcactattagcatatacaaatgctactgatttttgtatgttggttttgtatcctgcaactttacaaaatttatcagttctaatagttttttggtggcgtctttgggttttcccaaatataagataccatctgcaaacaaggataacgtgacttcttcctttccagttggatgccctttatttcttcctcttgtctgattgctgtagctaggacttctagtactatgttgaataacagtggtgaaagtgggcatccttgtcatgatccagatgggagagggaaggttttcaggttttccccattcagtatggttttagctatgggtctgtcacatatggttttaattatgttaaggtatgctccttctatacgcagttttttgagggtttttcatgaagggatgttgaattgtatcaaatgcttttttaacatctactgacatgatcatacggatttgtccatcattctactgatatgatgtatcacattgattgatttgtgtatgttggaacatccttgcaagccagagataaatcccacttggtcatgatgaatgaccttttttaccatattagtgaatttggtttgctaataccttgttgaggccttttgcatcaagattcatcagagatactggcctgtagttttctttttttgatgtgtctatgtctggttttggtatcagagtaatactggcttcatagtatgtgctgggaagtagtccctcctcctctattttttcagaattgtttcagtaggattgctattagttattttttaaatgtttagcataattcagtattgaagtcattgggtcctgggcttttatttacagggagatttttaattacaacttcaatcatgttacttgttattggtctgttcaagttttggatttcttcatggttcaatcttggtaggttgtatgcatctaggaatttgcccatttcttctagattttccaattttttggcatacagttgctcacagtagccagaaattatcatatgaatttctgcattatcagttataatatctcctttttcatctctgattttacatatttggatcttctttttttttcttaggcaagctaaaagtttctcaattttctttatctttaaaaaaacttttcgattcattgatcttttgtattgtcttcttcatttcaatttgatttatttctgctctgatctttattattccttttcttctactaattttggatttggtttgctcttgcttttctacttctttgaggtgcatcattaggttgtttatttgaagttttttttttttttaatgtaggcacttatagctataagcttccctattagtactgcttttgctgtattccatacaacaaaatggtatgttgtgtttccattatcattttttccaagaaatttttcaatttccatcttaatttcttcatttacccactggttgttcaggggcatattgtttactttccatgtgtttgtatagttttcaaaattcctcttgttattgatttctagttttattccattgtggtcagagaatgtgcttgatatgattaacatttttttgaatgttttaagacttgttttgtgacctaacatatgatctgtccttcagaataatctatatgctggggaaaagaatgtgtattctgcagtctttgaaggaaatgttctgtaactatctattagatgtttctttgttgattttctgtctagaagattgatgcagtgttgaaagtgggatgttgaaatctccagctattattatattggggtctacttctctctttagctctaataatattttctttatacatctaggtgctccagcattcagtgcatatatatttaaaatcgttatatcctcttgctgaattgaaccccttatcattatatagtgaccttctttgtctattcttacagtttttgtcttgaaatctattttgtctgatatgaatatagctgcttctgctcttttttggtttccatggacttggaatatcttttccatccctttattttccatgtgtgttttataggtgaagtctgtttcttgtgggcaacagatcattgggtctcagtttttggggggttttttggtgtgttttgttttgttttttgtttattttttggcttttggctttttttttttttttgagatggagtctcactctgtcaccaggctggagtacggtggcacgatctcggcttgctgcaacctccgcctcctggattcaagcaattctcctgcctcagcctcctgagtagctgagactacagacacacaccaccacgcccagctaatttttgtatttttagtagagacagggtttcaccatgttggccaggatggtcttgatctcttgaccaagtgatatgcccacctcagcctcccaaagtgctgggattacaggcgtgagccaccacacctggcctcattgtttttttattccttcagctactctgtgtcctttgaagaactgtgtccatttacattcaatttatagataagtaaggacttacccctgccattttgtgatttgttttctggctgttttgtggtcttctcttccttctttctttccttcatgtctttctttttgcgaaggtaattttcattggtgatatgatttagttagttgctttttattttttgtgtctccattgtatgttttttgatttgagggtatcatgaagcttgcaaatactacgttataacccattattttaagctgataataacactgtttgcataaacaaactaacaaaaagaaaatttacaaagacttcctgcattaactttgtgcccctgctttaagtttttgttactatttatatcttattgtaatatgtcttgaaaagttgttgtagttactatgtttgattggtaagtcatttaatctttctccttaaataacagtagtttacacaccacatttacagtgctataatattctgtttttctgcagactattactagtggattttgtaccttcaggtgattatttattgctcattaatgtccttttctttcttattaaagtactccctttagcatttcttgtaaaaaaaaaagtctgatgttgatgaaatccctcaactttttttttgtctaggaaagtctttattttttcttcattcttgaaggatattttcaccagatatactattctagcataaaagttctcttcccttcagcactttaaatatttcattccactctctcttggcctgtaaggtttccactgaaaaggctgccactagatgtgttggagctccattatttgtttcttttctcttgctgctttttggaacctttttttatccttgacctttgcaagttgaattaccagatgccttgagttagtcttctttgcatgaaatctgcttggtgttctgtaaccttcttgtacttggatactgatatctttctctaggtttaggaagctctctgttattatccctttgaataaagtttctatgcatatctctttctctacatactctttaaagccaataactcttagatttgcccttttgaggctattttctagatcctgtaggcatgcttcatggttttttattctttttgcttttgtctcctctgactgtattttcaaatagcctgttttcaagcttgctgattcttttttctgcttgatcaactctgctattgaacgagtctgatgatttcttcagcatgccagctgcatttttcaactccagaatttctgcatgatcctttttaattattttaatctctttgtcaaattcatctgatagaatcctgaatttcttctctgtgttatcttgaatttctttgggtttcctcaaacagctattttgagttctctgtctgaaaggtcacatatccctgtttctccaggcttggtttctggtgccttatttagtttattcattgaagtcatgttttcctggattgtctggatacttgtaggtgttcatttgtgtctggccattgaagagttaggtatttattgtagtctttgcagtctgggctctttatacccattcttcctgggaaggctttccagatattcaaaaggacttgggtgttatgatctaagctatatctgctttagagaggacccccaagaccagtaacactatgattcttgcagactcatagaggtactgccttgatagtcttggacaagatccagaagaattatctggattaccggagactctggttctcttcctttactttgtcccagtctctctctgtgctgagccacctggagctagaggtggaatgacacaagcacccctgtagccatcacccctagaactgtgctgggtcagacctgaaaccagcagagcactgggtcttgcccaagccctgctgtaaccactctttggctaccagctatgttcattcaaggccctgaagatctgcaattagctggtgacagagccagccaggcctatgttcttcccttgagggtgatgagtttctccaagcccaagctccaggagggtccagaggtgccattcaggagccagaaactagagtcaaaaatcttagaagtctacctggtgttctattgtactgtggctaagctggcactcaaaccacaagacgcagcgcttcccatgcttccctcccctttccaaatgcagcgagcctcacctcatggccacggccacctcaggcccacagggagtactgccagactaccaccatgttccctttaggctcaagggctcttcagtcagcttgtgttgaatgctgcctggcctgggactcaccctttagagcagtgaggtcccttctggcctaaggcaagtccagaaatgccatctaaaaaccaagtcctgaaatcaggtaccgtgagagcctacttggttttctacccagctgtagggcctaccttatataaactttttatccaggatagctttcttttttgtctttgggacagtattgtaactaagcaaaaagataagcggatttaatttttcttattagtcatttaagatttttatttgccttttataaggagtctttaatttaaaatactgaaatactttagaagcttctgcatatcagtaggcatccatagatgagagtaatttggaaagcttcattttcttttctttttttttaatttcaacttttattttaaatacagggtacatgtacagatttgttacataggaatattgtatgatgctgaagtttggagtacaggttccctcaccctggtagtaagcataatatagtactcaataggtagtttttcaacccacccactcccaagctcgagtagtccacagtgtctatcgttctaatatttatgtccatgtgttctcaatgcttagctcccaattagaaggaagaacatgcagttttgaattttctgtttctgcattaatttgctgaggattatggcctccagctccatccatgttgctgcaaaggccatgatttcatttttttataactgtgtactattccgtggtgtgtatatacagcattttctttattcaatccaccactgatgggcagctaggttgatcccatgtctttgctagtgtgaatagtgcaacaatgaacagaaaagtgcatgtgtctttttggtagaatgatttattttcttctgggtgtaaacctagtaatggtatggctgagatgaatggtagccctgttttaggttctttgagaaatctccagattgctttccacagtggctaaactaatttaaattcccactaacaatgtataagtgtccacttttctccacatcttcaccagcatctgttgttttttggatttttagtaacagccattctgactggtgtgagattttatctcactgtcagtttgatttgcatttctctgatgattagtgatgctgagcattttttcatgtttgttggtgacttgtatgacgtcttttgagaagtatgtgttcatgtcctttgcccattttttaatgaagttatttggtgttttgcctgttgatttgttcaagctccctatagattctggatactaggccattgttggatgcatagtttgcagatatcgtctctcattctgcaggttgtctgtttgctttgttcatagtttcttttgttgtgcagaagctttttagtttaattagatcctttttgtcttgttgttgttgttgttgcaatggcttttcatacttagctaaaaattttttaccaaggctgactttgagataagtatttcctaggttgtcttccaggatctttacagtttgaggaccttcattgaaatctttaattcattttgagttaatttttgtatatggtgaaaggtaggggtctggtttcattcttctgcatacggctaactagttatctcagcaacatttattgaatgggaagtgctttccccatggcttgtttttctcagccttgttgaagatcagattgtggtaggtgtgcatctttatttctgagttttctattctcttccatttgtctttgtctgtttctgtaccagtactaagttgttttggttactgtagccttatagtagtagtgtagtagtaggagtagtagtgtagccttatatagtgtagccttgaagttgggtaatgtgatacctctggcttcattcttttgcttaggatagctttggctattggggctctttttcagttccatatttattttagaatcatttgttctgtgaaaaatggctttggtagtttgataggaatagtgttgaatctttaacttgctttggacagtatggccatttttacgaaactgattcttccaattcatcggcatggaatgtttccccatttatgtcatctctgatctccttctgcaatgttttgtagttctctttgtagagatctttcacctccttggctacctgtattcctagatatttcattttcttttggctattgtaaatgggattatgttcttgatttcactctcagcctggactttgttggcatatagaaaatgctactgatttttatacaatgattttgtaacctgaaactttactaaaggtgtttatctattctaggagactattggcaaagtctttaggattttctaggtatagaattatgttatcagcaaacagggagagtttgacttcctttcctatttggatgccttttatttctttctcttgcctgattgttccagctatgacttccagtactgtgttgaacatgagtggtaagagtgtgcatcttggttctgttccagttctcaaagggaatgcttcaagctattgtccacttagtatgatgttggctgtgggtttgtcatagatggctcttattattttgaagtatgttccttcattgcctagtctgttgagggtttttaacatgaagggatgttggatttcatcaaaagctttttctgcatctattgagaagataatttcatttttgcttttgattctgcttatgtagtgaatcacatttattcatttgcatatgttgaaccagccttgcattccaggaataaagcttacttgatcatgttttactaacttttcaatatgctgctggatttgattttctagtattttgttgaggattttcaggtctatattcatgagagatattggtctaaagtttcctttattaattgtgtctctgccagatttgggtaccaggctgatgctggcttcatagaatatattagaaaggaacccctcctctttgattttttgaataatttcagtaggattggtatcagttctttgtatgtctggtagaattcagctgtgaatccatctgagccagggctttttttggttagtaggttcttaattactgattcaatttcagaagtcgatagtggtctattcaggttttcaatctcttcctgattcagtcttggaagattgtgtccttccaggaatttacctacttcctctagattttctaatttgtgtgcatagggttgtgagccctcattttcaactgcacttcttcaagtgcagtgttgtttctttggaatgttccattgtaattttaaattacctttagtaagattttgctatttctaaaagtgtttgctgtttccagaacctaatacttacacatgtaagtgtgggcataatcagaagatacattactcagttcttaagaaaataaggatcccatttttatcttgaatcttagctttaattctcagatcctcttaatcaacttagccaataattttttcctacctcagcacacaagaaaaacaaaggaggtagaacacaaaaatccctataaatttccaaaaccaaagtttgcatcccctgaaatattgccattttctactggtttctgtctgaaccattcagacataagaggcctgtaactagatccaagccagttaattatcagattctggacccaattcagtttttttgtgacttccaaacctagtttcgatcagaaatttgctcaaacaaactcagaaagctcaaaacacaaatatgtggagctttgaattctgagagagaacttaccatcatccccagttgctgtgaaagagcaatggacacaatgggccctgcaggtacctcgcttggtcacttgatgctcctgggggtcactgaaagctctaattcggatcccacttctgacaccatctgtttaaaaaaaaaaaaaagccttagacaaattaaacttcacagagtttaactgagcaaagaatgatctgtgaatctggcatctggcagcctccttagccagagtaagctcagagagactccagtgcagccacgtggtggaagatttacggtcacaaaaaggaaagtgacatacagaaaatggaagtgaggtacacaaacagccagattggttacagctcaacatttgccttatttgaacatgttttgaacagttggctgcctctgactggccaaaacttggtgactggcacaagagtaggttactgtctatttaaacttccattgaggttactgttcactatgtacagagaaatctttatgccaaacttaaagtatgtaaggaagcaactttaggataaacttgatttaacaatattacatgtgaatatgtgtatatacacatgtgtctttgtgaatataaatataaatctatctatatatattctctaagatattggcacttctaataaagtggttattaaataatatttaaagataaaaacaatgaatttgattagtttagaaagcagagaaagttaacagagcaattctaacacaaatatagttgcttatcattttcagtgtgaaattagagtcaacaaacccatgattttcttagtattcactcactctatatctgtgtacaagtaattggcttattatattaaagttgctttttacttcattttatgttaactctaaaaaactgttaattgtggagtttttaaatgttgttcaatttcttttcattttaataataatattgttaatgttatcattgcttctattttctatgtgcctaacatttctctagagttgagcaggccttatcttccactttatagtgacagtaaattcatttgtgaatggggaagattttcatttatgcagatgggcttgagatagacaaatagatactcaaagagaacaacagagaaatacacaagaatatacacaatatttatactaatttatcatctatttacagaatgatagacattgccattgagttcatatgctagatacattgagtttatctatttatatatcatttaaaaaacagaatggaaatcttcctatatacagtaaacctttccctgccctctaaatcaggatattccacccataatttgcttatctcattgtgctctaatacattgacactcacagaatataggacagttgtatctacattagatggttccagttagtgatgctaatgttcttgttcagcttttcataggtgtttatttcttcaactttagagacagagttcaagatattagtcatttcttgctgctattctctgccagataagtcaatgtagtacaatgtgagagtctaggctttgcatccagatagacctgagattaaatcctgatcaactctttactagttatatggcttgtctgactgtaaagtggagatgataatatccacctccataaggttcttcttataggtgatgacagtacaaatatacagtactggccacctatcgggctttcttttttttttttttttttgagacggagtctcgctctgtcacccaggctggagtgcagtgccgcgatctcggctcactgcaagctccgcctcccaggttcacacccttctcctgcctcagcctcccgagtagctgggattacagaagcccgccaccacgcccagctaattttttgtatttttagtagagacagggtttcaccgtgttagccaggatggtctcgatctcctgacctcgtgatccgcccacctcggcctcccaaagttgggctttcaatagatatgtgtctcttgccactaccctctacaacacccacaacacccaacacccacccacattcatccccttttcatgctttccttcctgtcatctgtgaactgggcaactacataacgaagaagatttgaattatatctaaaccaaaatccagttattataatagaagtatttatttattctgagtgtacactattaattagcaaaacaaagaacataagcctaaaggctaacctatttggacctttaggtgggtaatatttgagatggtccttgaaagttgataggatttagactgaaagacatatgtagagaagcattctgtacagaggaaactgtttcaggcctaaagcacagcatagaacaaggaatgattcaatttatctggaatatagggtgtatgtggtagaagataaaactcaagaatgaatataggcctgttttgtcaaggattctgagcaccaggttaagaagtttaatttgatggaaaataggagttactgatatttcctaagcaaaggacttttgttttaggaggatttctctgtgttagcatttgggatatattagtgctgggagaaacaaaagtgaggaggtcatttagaaagttattagagtggttcaagcaaaaagtaacaaagactaactctcacacattactagtggtaatgtaagtcagtacaatctctatgacaggcaacttggcaatctctaccaacattacaaacgcacataccattttccttagccattccacttctaagaatttatcctcagatatattttcgaatgagtgaagtgatgcatataccaagttattcataatagcataaaaccttaataagaacttgaataacttacagcacattcacagtaacagaattacagcatatatatatataataagaatggggaagtcccttatgtactgattaaaacaatctctaagatgtattaaatttttaaaaattaatatattaaattgtgtaccatttgcttccatctgtgttttaaaaataaaagaaaattctggaagaatacacacacacacacacacacacacacacacacacacacacacacaaattatatctgtggcttcttgttgaatccaaaataaatattaaaagaaataaggcctaaagtcaaagtggtacctataatattggagagataacttattagaagttgatagtgggggaaaatttataaagaaagaatatggacttagaagaacagaaatttgtagaaagcctagtattgaatagtattatgccatgttatggcatgaagcagatgagtgtagatttgcgtgctttaagcagaaagaaaatttaagaaatcatgtttgcagaatataattgtcatcccaattttgccaaacaggcaccaaaatgcttggagatttattgtttcacccaaagtcacacaagtgatgacacagtaaaaacaaaaaacttctttcaaagttttatctaaagctccaatggcatagatatttagacaagtatagacaattgccttcacagctggaagtgccctcttcctccctcaccagttacccatgtaccttccctaacaaggtgaattttcttattcagcaggaaatattccctagacattagtgtttaatgaaaccatttattaaaatccgtgtaattctttcaaaattctaacatatccgaggcttgcctgattctgataataatattcaagcaaagatttttagaaaattttctttaagtcagtatgaaattttgacatttagtcaagattgaatctatggttcagatttcataacctcattaagtctccttgtgcctcttatgtgcagttctgggtacttactattatgtggaagggttaacatttttagaaaggaaacatttataaaccctagttctttttaacaagctgatttagctagttcctaagataatttactttcagaaagtataaccctttactacataacagtattaacttatagattgatttatctatcaataagttatttaagggagttataatttaaagcaataacaaaaaataatacaccaaatgtgaatctaccactgcaaaatttttaatagatacatggtttagttacagtcttttatgaacttctcaccttttatccccagagttagaaacttctatcagggtattattctcactgcagctgaaacagccctccagatgccagcagctttggcagtaggtgtcctctagtgctgactcataaaggtttgaaattttttatatttctggtctttcccccatctctgcagagatgcctttctaggtattttgctttta

SEQ ID NO: 2504 - DNA, 15415 bp, Homo sapiens
ggaaaggatgaggaaaacagctgcccaggagtctccttctccaccctgggttcatatcagaccccatccctaccacttgcctcttctacccctggaaaatggacctaacaaacagaaggagcaaaataaattaacactctaatgagcatgtatggatggacatatgttcatgtgcaatgggggaagggaagagggggtgacaccacctaaaatgattccccacctcaatctcccagcctactcctttcccccttccccctaaagccaccatccaaccagatagaaaaataaaggtctaattcactcaaaattcttcagtttttacaaaactaacagggcagagtagggagacggggggcaggcagccacaggagtagggctggtggagaggggctatgcttctgtctccacttgagactggctctctgtggtgttgctcttctgctcctccatctctgtgtcagtgagattgtctcctgaggaagcctctgccttggccttgttctcttcctcagccagcctctcaaacgtgttggcgtagagcgtcttctcccaggcaagctgcctgcagatctgctgctggcacacagccagctgggccttggcggcttcgttgttggggtagagctgcaagaccttctggaagtcagcctgtgccagttcaaagtcattcacagccaggtgggcctctccccaatggaagaggcccttctcgttgttgctgcccagttccagggccttgttacagctttcagtggcagcagagaaggcctgtagtttcagatgacacatggccaggttgaggtaagaggccagttgaagggcctgtgccttctgtgtttcctcattggaaaaactagactcatattctacccaggacacaatcctcttatattatagtaaagcttgcttgtatttgccttccttgaagtacacagtgtcccactctttcactgtggtgctctgctccagcttctcttctgaattcatctcccaagactccttggtcttttcaaaactcttgaggtgtaattcatatttcagctaggcatttggtgggatttggaacttttccttcctaacactgccaaaagcatagctgggtttgaggtacacaatggaatgttctcctttctacatgcactgaatggccctctccagaccataaggcagatccagattctcctgatgttcaaagaactagtccttgtagcacccttccagtgcaatctccatgatagcaccctcattgggcctgggatagccttcaccgcaagtctgtaattctgtagatgattccgccatcttcttcttccgtcagatcttctcccttaaactcaaacaactccacctcaaacacgagtgtggcattggggagatctttggaggactgcctgctgcaccgaaggcatattctggtttgcaggtgatatggcacacctcccctgccttcatggctgctatggcaatgtcccaagccttgttgacctccccttttcccaggtcaaaggagaatttgtccttgtgatccagactggggtcaaagtttgtgccatctaacagccagccagtgtagtggacaaagattcagtccccaatcatgggcatctctgtacctgtgccctctctcgatgaccttcagcatgccttcctcctgtttgggcgaatgtccactccctccatgggaagaggcgccaactgtgtcccattctcagtctccttcatctcctcaactgtcatctccacgcagcgcaccctttctgggagctggcaccggcaccagcatactctgagccaaaggcaggggtgctaccttcagggtgtgcaggaggccaggtgctgtggtgctgactgcggaccacatggaggctggagcacctctgccagtctgtagtatgatttgaagtcaggtaatgtgattctctccagttttgttctttttgctcaggatagctttgactattctggatcttttgttgtaccatgtaaattttaggatagttttttattattaatatttctgtgaagaatgtcattggtattttgaaagggactgcaatgaatatgtagattgctttgggtgatattgacattttaacaaaattgattcttcccatccatgaacatggaatgtatttctcttttttggtgtcctcttcaatctcttttatcagtgttttatagttttcattgtagagatcatttctttggttaaatcctaggtgatatggtttggctgtgtccctacccaaatctcaccttgaattgtaatagtctccacttgtcaagggtggggccaggtggagataattgtataatgggggcagttcccccatactgttctcatggtagtgaataagtctcatgggatctaatagttttataaatgggagttcccctgtacaagctctcttgcctgccaccatgtaagacatgcctttgcttcttctttgccttctgccatgattgtgaggccttcccagccttgtggaactgtatgtccattaaacctttttcctttataatttacccagtctggggtatgactttattagctgcatgagaacagactaatatgctacatatctaattttatttgtggctattataattaggattactttcttgatttctttttcacactgttcactattagcatatacaaatgctactgatttttgtatgttggttttgtatcctgcaactttacaaaatttatcagttctaatagttttttggtggcgtctttgggttttcccaaatataagataccatctgcaaacaaggataacgtgacttcttcctttccagttggatgccctttatttcttcctcttgtctgattgctgtagctaggacttctagtactatgttgaataacagtggtgaaagtgggcatccttgtcatgatccagatgggagagggaaggttttcaggttttccccattcagtatggttttagctatgggtctgtcacatatggttttaattatgttaaggtatgctccttctatacgcagttttttgagggtttttcatgaagggatgttgaattgtatcaaatgcttttttaacatctactgacatgatcatacggatttgtccatcattctactgatatgatgtatcacattgattgatttgtgtatgttggaacatccttgcaagccagagataaatcccacttggtcatgatgaatgaccttttttaccatattagtgaatttggtttgctaataccttgttgaggccttttgcatcaagattcatcagagatactggcctgtagttttctttttttgatgtgtctatgtctggttttggtatcagagtaatactggcttcatagtatgtgctgggaagtagtccctcctcctctattttttcagaattgtttcagtaggattgctattagttattttttaaatgtttagcataattcagtattgaagtcattgggtcctgggcttttatttacagggagatttttaattacaacttcaatcatgttacttgttattggtctgttcaagttttggatttcttcatggttcaatcttggtaggttgtatgcatctaggaatttgcccatttcttctagattttccaattttttggcatacagttgctcacagtagccagaaattatcatatgaatttctgcattatcagttataatatctcctttttcatctctgattttacatatttggatcttctttttttttcttaggcaagctaaaagtttctcaattttctttatctttaaaaaaacttttcgattcattgatcttttgtattgtcttcttcatttcaatttgatttatttctgctctgatctttattattccttttcttctactaattttggatttggtttgctcttgcttttctacttctttgaggtgcatcattaggttgtttatttgaagttttttttttttttaatgtaggcacttatagctataagcttccctattagtactgcttttgctgtattccatacaacaaaatggtatgttgtgtttccattatcattttttccaagaaatttttcaatttccatcttaatttcttcatttacccactggttgttcaggggcatattgtttactttccatgtgtttgtatagttttcaaaattcctcttgttattgatttctagttttattccattgtggtcagagaatgtgcttgatatgattaacatttttttgaatgttttaagacttgttttgtgacctaacatatgatctgtccttcagaataatctatatgctggggaaaagaatgtgtattctgcagtctttgaaggaaatgttctgtaactatctattagatgtttctttgttgattttctgtctagaagattgatgcagtgttgaaagtgggatgttgaaatctccagctattattatattggggtctacttctctctttagctctaataatattttctttatacatctaggtgctccagcattcagtgcatatatatttaaaatcgttatatcctcttgctgaattgaaccccttatcattatatagtgaccttctttgtctattcttacagtttttgtcttgaaatctattttgtctgatatgaatatagctgcttctgctcttttttggtttccatggacttggaatatcttttccatccctttattttccatgtgtgttttataggtgaagtctgtttcttgtgggcaacagatcattgggtctcagtttttggggggttttttggtgtgttttgttttgttttttgtttattttttggcttttggctttttttttttttttgagatggagtctcactctgtcaccaggctggagtacggtggcacgatctcggcttgctgcaacctccgcctcctggattcaagcaattctcctgcctcagcctcctgagtagctgagactacagacacacaccaccacgcccagctaatttttgtatttttagtagagacagggtttcaccatgttggccaggatggtcttgatctcttgaccaagtgatatgcccacctcagcctcccaaagtgctgggattacaggcgtgagccaccacacctggcctcattgtttttttattccttcagctactctgtgtcctttgaagaactgtgtccatttacattcaatttatagataagtaaggacttacccctgccattttgtgatttgttttctggctgttttgtggtcttctcttccttctttctttccttcatgtctttctttttgcgaaggtaattttcattggtgatatgatttagttagttgctttttattttttgtgtctccattgtatgttttttgatttgagggtatcatgaagcttgcaaatactacgttataacccattattttaagctgataataacactgtttgcataaacaaactaacaaaaagaaaatttacaaagacttcctgcattaactttgtgcccctgctttaagtttttgttactatttatatcttattgtaatatgtcttgaaaagttgttgtagttactatgtttgattggtaagtcatttaatctttctccttaaataacagtagtttacacaccacatttacagtgctataatattctgtttttctgcagactattactagtggattttgtaccttcaggtgattatttattgctcattaatgtccttttctttcttattaaagtactccctttagcatttcttgtaaaaaaaaaagtctgatgttgatgaaatccctcaactttttttttgtctaggaaagtctttattttttcttcattcttgaaggatattttcaccagatatactattctagcataaaagttctcttcccttcagcactttaaatatttcattccactctctcttggcctgtaaggtttccactgaaaaggctgccactagatgtgttggagctccattatttgtttcttttctcttgctgctttttggaacctttttttatccttgacctttgcaagttgaattaccagatgccttgagttagtcttctttgcatgaaatctgcttggtgttctgtaaccttcttgtacttggatactgatatctttctctaggtttaggaagctctctgttattatccctttgaataaagtttctatgcatatctctttctctacatactctttaaagccaataactcttagatttgcccttttgaggctattttctagatcctgtaggcatgcttcatggttttttattctttttgcttttgtctcctctgactgtattttcaaatagcctgttttcaagcttgctgattcttttttctgcttgatcaactctgctattgaacgagtctgatgatttcttcagcatgccagctgcatttttcaactccagaatttctgcatgatcctttttaattattttaatctctttgtcaaattcatctgatagaatcctgaatttcttctctgtgttatcttgaatttctttgggtttcctcaaacagctattttgagttctctgtctgaaaggtcacatatccctgtttctccaggcttggtttctggtgccttatttagtttattcattgaagtcatgttttcctggattgtctggatacttgtaggtgttcatttgtgtctggccattgaagagttaggtatttattgtagtctttgcagtctgggctctttatacccattcttcctgggaaggctttccagatattcaaaaggacttgggtgttatgatctaagctatatctgctttagagaggacccccaagaccagtaacactatgattcttgcagactcatagaggtactgccttgatagtcttggacaagatccagaagaattatctggattaccggagactctggttctcttcctttactttgtcccagtctctctctgtgctgagccacctggagctagaggtggaatgacacaagcacccctgtagccatcacccctagaactgtgctgggtcagacctgaaaccagcagagcactgggtcttgcccaagccctgctgtaaccactctttggctaccagctatgttcattcaaggccctgaagatctgcaattagctggtgacagagccagccaggcctatgttcttcccttgagggtgatgagtttctccaagcccaagctccaggagggtccagaggtgccattcaggagccagaaactagagtcaaaaatcttagaagtctacctggtgttctattgtactgtggctaagctggcactcaaaccacaagacgcagcgcttcccatgcttccctcccctttccaaatgcagcgagcctcacctcatggccacggccacctcaggcccacagggagtactgccagactaccaccatgttccctttaggctcaagggctcttcagtcagcttgtgttgaatgctgcctggcctgggactcaccctttagagcagtgaggtcccttctggcctaaggcaagtccagaaatgccatctaaaaaccaagtcctgaaatcaggtaccgtgagagcctacttggttttctacccagctgtagggcctaccttatataaactttttatccaggatagctttcttttttgtctttgggacagtattgtaactaagcaaaaagataagcggatttaatttttcttattagtcatttaagatttttatttgccttttataaggagtctttaatttaaaatactgaaatactttagaagcttctgcatatcagtaggcatccatagatgagagtaatttggaaagcttcattttcttttctttttttttaatttcaacttttattttaaatacagggtacatgtacagatttgttacataggaatattgtatgatgctgaagtttggagtacaggttccctcaccctggtagtaagcataatatagtactcaataggtagtttttcaacccacccactcccaagctcgagtagtccacagtgtctatcgttctaatatttatgtccatgtgttctcaatgcttagctcccaattagaaggaagaacatgcagttttgaattttctgtttctgcattaatttgctgaggattatggcctccagctccatccatgttgctgcaaaggccatgatttcatttttttataactgtgtactattccgtggtgtgtatatacagcattttctttattcaatccaccactgatgggcagctaggttgatcccatgtctttgctagtgtgaatagtgcaacaatgaacagaaaagtgcatgtgtctttttggtagaatgatttattttcttctgggtgtaaacctagtaatggtatggctgagatgaatggtagccctgttttaggttctttgagaaatctccagattgctttccacagtggctaaactaatttaaattcccactaacaatgtataagtgtccacttttctccacatcttcaccagcatctgttgttttttggatttttagtaacagccattctgactggtgtgagattttatctcactgtcagtttgatttgcatttctctgatgattagtgatgctgagcattttttcatgtttgttggtgacttgtatgacgtcttttgagaagtatgtgttcatgtcctttgcccattttttaatgaagttatttggtgttttgcctgttgatttgttcaagctccctatagattctggatactaggccattgttggatgcatagtttgcagatatcgtctctcattctgcaggttgtctgtttgctttgttcatagtttcttttgttgtgcagaagctttttagtttaattagatcctttttgtcttgttgttgttgttgttgcaatggcttttcatacttagctaaaaattttttaccaaggctgactttgagataagtatttcctaggttgtcttccaggatctttacagtttgaggaccttcattgaaatctttaattcattttgagttaatttttgtatatggtgaaaggtaggggtctggtttcattcttctgcatacggctaactagttatctcagcaacatttattgaatgggaagtgctttccccatggcttgtttttctcagccttgttgaagatcagattgtggtaggtgtgcatctttatttctgagttttctattctcttccatttgtctttgtctgtttctgtaccagtactaagttgttttggttactgtagccttatagtagtagtgtagtagtaggagtagtagtgtagccttatatagtgtagccttgaagttgggtaatgtgatacctctggcttcattcttttgcttaggatagctttggctattggggctctttttcagttccatatttattttagaatcatttgttctgtgaaaaatggctttggtagtttgataggaatagtgttgaatctttaacttgctttggacagtatggccatttttacgaaactgattcttccaattcatcggcatggaatgtttccccatttatgtcatctctgatctccttctgcaatgttttgtagttctctttgtagagatctttcacctccttggctacctgtattcctagatatttcattttcttttggctattgtaaatgggattatgttcttgatttcactctcagcctggactttgttggcatatagaaaatgctactgatttttatacaatgattttgtaacctgaaactttactaaaggtgtttatctattctaggagactattggcaaagtctttaggattttctaggtatagaattatgttatcagcaaacagggagagtttgacttcctttcctatttggatgccttttatttctttctcttgcctgattgttccagctatgacttccagtactgtgttgaacatgagtggtaagagtgtgcatcttggttctgttccagttctcaaagggaatgcttcaagctattgtccacttagtatgatgttggctgtgggtttgtcatagatggctcttattattttgaagtatgttccttcattgcctagtctgttgagggtttttaacatgaagggatgttggatttcatcaaaagctttttctgcatctattgagaagataatttcatttttgcttttgattctgcttatgtagtgaatcacatttattcatttgcatatgttgaaccagccttgcattccaggaataaagcttacttgatcatgttttactaacttttcaatatgctgctggatttgattttctagtattttgttgaggattttcaggtctatattcatgagagatattggtctaaagtttcctttattaattgtgtctctgccagatttgggtaccaggctgatgctggcttcatagaatatattagaaaggaacccctcctctttgattttttgaataatttcagtaggattggtatcagttctttgtatgtctggtagaattcagctgtgaatccatctgagccagggctttttttggttagtaggttcttaattactgattcaatttcagaagtcgatagtggtctattcaggttttcaatctcttcctgattcagtcttggaagattgtgtccttccaggaatttacctacttcctctagattttctaatttgtgtgcatagggttgtgagccctcattttcaactgcacttcttcaagtgcagtgttgtttctttggaatgttccattgtaattttaaattacctttagtaagattttgctatttctaaaagtgtttgctgtttccagaacctaatacttacacatgtaagtgtgggcataatcagaagatacattactcagttcttaagaaaataaggatcccatttttatcttgaatcttagctttaattctcagatcctcttaatcaacttagccaataattttttcctacctcagcacacaagaaaaacaaaggaggtagaacacaaaaatccctataaatttccaaaaccaaagtttgcatcccctgaaatattgccattttctactggtttctgtctgaaccattcagacataagaggcctgtaactagatccaagccagttaattatcagattctggacccaattcagtttttttgtgacttccaaacctagtttcgatcagaaatttgctcaaacaaactcagaaagctcaaaacacaaatatgtggagctttgaattctgagagagaacttaccatcatccccagttgctgtgaaagagcaatggacacaatgggccctgcaggtacctcgcttggtcacttgatgctcctgggggtcactgaaagctctaattcggatcccacttctgacaccatctgtttaaaaaaaaaaaaaagccttagacaaattaaacttcacagagtttaactgagcaaagaatgatctgtgaatctggcatctggcagcctccttagccagagtaagctcagagagactccagtgcagccacgtggtggaagatttacggtcacaaaaaggaaagtgacatacagaaaatggaagtgaggtacacaaacagccagattggttacagctcaacatttgccttatttgaacatgttttgaacagttggctgcctctgactggccaaaacttggtgactggcacaagagtaggttactgtctatttaaacttccattgaggttactgttcactatgtacagagaaatctttatgccaaacttaaagtatgtaaggaagcaactttaggataaacttgatttaacaatattacatgtgaatatgtgtatatacacatgtgtctttgtgaatataaatataaatctatctatatatattctctaagatattggcacttctaataaagtggttattaaataatatttaaagataaaaacaatgaatttgattagtttagaaagcagagaaagttaacagagcaattctaacacaaatatagttgcttatcattttcagtgtgaaattagagtcaacaaacccatgattttcttagtattcactcactctatatctgtgtacaagtaattggcttattatattaaagttgctttttacttcattttatgttaactctaaaaaactgttaattgtggagtttttaaatgttgttcaatttcttttcattttaataataatattgttaatgttatcattgcttctattttctatgtgcctaacatttctctagagttgagcaggccttatcttccactttatagtgacagtaaattcatttgtgaatggggaagattttcatttatgcagatgggcttgagatagacaaatagatactcaaagagaacaacagagaaatacacaagaatatacacaatatttatactaatttatcatctatttacagaatgatagacattgccattgagttcatatgctagatacattgagtttatctatttatatatcatttaaaaaacagaatggaaatcttcctatatacagtaaacctttccctgccctctaaatcaggatattccacccataatttgcttatctcattgtgctctaatacattgacactcacagaatataggacagttgtatctacattagatggttccagttagtgatgctaatgttcttgttcagcttttcataggtgtttatttcttcaactttagagacagagttcaagatattagtcatttcttgctgctattctctgccagataagtcaatgtagtacaatgtgagagtctaggctttgcatccagatagacctgagattaaatcctgatcaactctttactagttatatggcttgtctgactgtaaagtggagatgataatatccacctccataaggttcttcttataggtgatgacagtacaaatatacagtactggccacctatcgggctttcttttttttttttttttttgagacggagtctcgctctgtcacccaggctggagtgcagtgccgcgatctcggctcactgcaagctccgcctcccaggttcacacccttctcctgcctcagcctcccgagtagctgggattacagaagcccgccaccacgcccagctaattttttgtatttttagtagagacagggtttcaccgtgttagccaggatggtctcgatctcctgacctcgtgatccgcccacctcggcctcccaaagttgggctttcaatagatatgtgtctcttgccactaccctctacaacacccacaacacccaacacccacccacattcatccccttttcatgctttccttcctgtcatctgtgaactgggcaactacataacgaagaagatttgaattatatctaaaccaaaatccagttattataatagaagtatttatttattctgagtgtacactattaattagcaaaacaaagaacataagcctaaaggctaacctatttggacctttaggtgggtaatatttgagatggtccttgaaagttgataggatttagactgaaagacatatgtagagaagcattctgtacagaggaaactgtttcaggcctaaagcacagcatagaacaaggaatgattcaatttatctggaatatagggtgtatgtggtagaagataaaactcaagaatgaatataggcctgttttgtcaaggattctgagcaccaggttaagaagtttaatttgatggaaaataggagttactgatatttcctaagcaaaggacttttgttttaggaggatttctctgtgttagcatttgggatatattagtgctgggagaaacaaaagtgaggaggtcatttagaaagttattagagtggttcaagcaaaaagtaacaaagactaactctcacacattactagtggtaatgtaagtcagtacaatctctatgacaggcaacttggcaatctctaccaacattacaaacgcacataccattttccttagccattccacttctaagaatttatcctcagatatattttcgaatgagtgaagtgatgcatataccaagttattcataatagcataaaaccttaataagaacttgaataacttacagcacattcacagtaacagaattacagcatatatatatataataagaatggggaagtcccttatgtactgattaaaacaatctctaagatgtattaaatttttaaaaattaatatattaaattgtgtaccatttgcttccatctgtgttttaaaaataaaagaaaattctggaagaatacacacacacacacacacacacacacacacacacacacacacacaaattatatctgtggcttcttgttgaatccaaaataaatattaaaagaaataaggcctaaagtcaaagtggtacctataatattggagagataacttattagaagttgatagtgggggaaaatttataaagaaagaatatggacttagaagaacagaaatttgtagaaagcctagtattgaatagtattatgccatgttatggcatgaagcagatgagtgtagatttgcgtgctttaagcagaaagaaaatttaagaaatcatgtttgcagaatataattgtcatcccaattttgccaaacaggcaccaaaatgcttggagatttattgtttcacccaaagtcacacaagtgatgacacagtaaaaacaaaaaacttctttcaaagttttatctaaagctccaatggcatagatatttagacaagtatagacaattgccttcacagctggaagtgccctcttcctccctcaccagttacccatgtaccttccctaacaaggtgaattttcttattcagcaggaaatattccctagacattagtgtttaatgaaaccatttattaaaatccgtgtaattctttcaaaattctaacatatccgaggcttgcctgattctgataataatattcaagcaaagatttttagaaaattttctttaagtcagtatgaaattttgacatttagtcaagattgaatctatggttcagatttcataacctcattaagtctccttgtgcctcttatgtgcagttctgggtacttactattatgtggaagggttaacatttttagaaaggaaacatttataaaccctagttctttttaacaagctgatttagctagttcctaagataatttactttcagaaagtataaccctttactacataacagtattaacttatagattgatttatctatcaataagttatttaagggagttataatttaaagcaataacaaaaaataatacaccaaatgtgaatctaccactgcaaaatttttaatagatacatggtttagttacagtcttttatgaacttctcaccttttatccccagagttagaaacttctatcagggtattattctcactgcagctgaaacagccctccagatgccagcagctttggcagtaggtgtcctctagtgctgactcataaaggtttgaaattttttatatttctggtctttcccccatctctgcagagatgcctttctaggtattttgctttta

SEQ ID NO: 2505 - DNA, 13470 bp, Homo sapiens
gtcattgaggcccatcaccagaacaatacaaggctgctctaaacagtacatcctgcctatgaattctactgaccttaatctataattttttgttactactaggtttgaactgaggtatgattgaaagagatgggagtcagtgagctactgctgcttttgaaaatgatagcttctgtaatatttctttattcatttatttcaatgtttaaaacccaactactttgtagttcgtcaacttcacatggaattcttgagagcaggatcaaatgtcatgcagacttttaccttttctgccagtgaggacaatatggaaagcaaggtaaacggcaatggctgggtgtgggggagggagtcatctattaaaaaataacctcttcatgggaagctatggaattgattatgtgttactatactttattacaaagtccatataaatatgtattaattttcacgtgaagatatatactaaataggtcgggcacagtggcttacacctgtaatcccagcactctgagaggccgaggtggacagaccacttgagcccaggagttccagatcagcctggacaacatggtgaaaccctgtctctactgaaaatgcaaaaattagctgggtgtggtggcaggcgccagtaatcccagctacgcaggaggttgaggcatgagaatggcttcaacctgggagatagcattgagccgagatcacaccactgcactccagcctgggtgacagagcaagaccccatgtcagcaaaaaaaaagaagttaatatatactaaatgaattagctttctcttcccatttaggtagaggaggggtcaggactaggggtaaaataaaccattggaagggcatggctgtcttcttgtgctattttttagagagaaagcacttcatagatgctcttttcaccttctcatttcacacttttctcttctggagacagggaggccctaaaaaacaatactggagtagaaatgagaaaaaacgggtttgatatccagcattgccacctattggctgtgtggctttgtgtaagacacctacctgcattgagcattggttttctctctgtaaaatggagacaacagtagtgcttaaattcatagacctgttgagaagagtaagtaagaccaaggatgtgaaagtattgtgaaatattctgcaaatgtaaaatgttaatacgtgtaaatgttaatgcccattaattcattcaaccaaccaacatgtactgagtatctgttacagtccattctctatgttagactcaaagttgatacaaaggcatagaccctatctggaggtgcaaggtcaagtatgggaggcaaacaaatagttattaaaatccaatgtggtaagtacaataatggaaatataaggtcatggtaacagaggagattgtacccaactctgctggtcttttctgcttgcattgaagagagtggcttatactcatcttacttgtttattgtccctttagttatcttttatattttaccttcaaactgctaggctcactatctgaactcttgctctctaacctcagtgggaagatgtaaatgctgctgcctgtgacctcgccagggaagtggctggcaaaggtgatgctttggtagcaggggggatctgccagacatcaatatacaaataccagaaggatgaagctagaattaaaaaactttttcgacaacagctagaagtttttgcctggaaaaatgtggacttcttgattgcagaggtgaggctagtattggaggaaaaggattgaacctattttgcaagcataactgcagagtcttcacatttcatgagggtattggacaacattctgccctcatttcttccatgtggatggtcaaaggtttatttaaatgcatggtagtcaaggccaacattccctcattggtatgctaggttctcttagagccaaaggacagacccaagagaggcctgaccatagccttttatcttctaaggtctgggtggctgcagaagctgacttgggggactctacaacctataaggaagcatagggcacagtgcctccgggagcaccctctccagagggagaatccacacaggagggcactgcatgtgtgggctggggactgagagagcaaggcctggaaggtggtggctatccaggctcgtctaggccccaccaataatgctcagcacccagtagtttccatagccttctccatccatgtcttgctcttcttgcctctctgctttcactcaagctatgacatgtgaattacattttgaagaaagaatcagtaagaattggtcattgattggacatgaaggcccagaacattctctttcctccacttccaaaacgaaagtcctcattccccatttcccaacataactgctactgcctggggtcatgccttcaacccacaactttactccaaacaagagaatatcccctggcttggcgcggtagctcacacctgtaatcccagcactttgggaggccaaggcaggtggatggcatgaggtcaggaatttgagactaccctggtgaacaaggtgaaagcccatctctactaaaaatacaaaaattagctgggcatgttggtgggagcctgtagtcccaactactctggaggctgaggcaggagaatggcttgaacctgggaggcggaggttgcagtgagccaagatagggcaccactgcactccagcctgggcgacagagtgatactctgtctcaaaagagagagagagagaatagccgccaccattattccccctagtgaccccactgaactctactgaaaaccttgcctcatcctcctgcccacgcctggccaaccccactgggaacagtcatctgcagggacaagcacaaattccaccctctgtgctttccagatggatgatgacaccactctgtttgtttaagaacccgtcttttgattctctcataattcctcacactgcttctgcagaatttgtttctaactcaagagggaagaaacaggaagatttctggcttttctttagttgccttaaggtcagcttttcagctgtggcactgaaggggcttcctgggaagcacccaagaaaatgacatgggtttaccagacaagatgtcctgtccaccactggcaaagacagggagtagctatttctcctatgctgtgcctcaatcttctcacccggggaaatggtgcttcccttcctactttatggagcacttatgaatatctaactagaagtgaatataaaagctctttgaactataacacatgataagctactcattgtttcagagattaccccagttttataagagatgaatctaaaatttattagcaaaacttttcctccttcaaaattacaaaattatgattttaaatactcaattactttgaaaacctctgggtgtgttttcttcttttttactaataggcatcatctcactgaatcaatgaaccctgaatgaaaaactatatgttattgttataggaatgaaaatgtttactcagaaaggtattctttagtcagtctgatagacacacattccttagcaagttttattatgcatatgtttatattctatttggtaatttttataactgttttgctatatttacctttaccattcaaaatctgctttatgtttggaccagtagaaaaagtgacatttctcttagtattttgagcacgttgaagaagctgtgtgggctgtggaagtcttaaaagaatcagatagacccgtggcagttaccatgtgcataggcccagagggagacatgcatgatataacccccggagaatgtgctgtgaggctggtgaaggcaggtaatttggacccataccgtgatacacagctcagttgttgcttacgaaatttaacaaagtgtgcttgatattgtgagagcagtttggaaatagaagaatgaactccaatcagttttcttatctgtaaattgtgggaggtggaggggaatggctaacctctaaggtaccttccaactattaaaaaaaaagaataaacaaataaataataaaatgtaagtgttatttctttgcacaggggcttccatcgttggcgtgaactgccgctttgggcccgacaccagcttgaagacgatggagctcatgaaggagggtcttgagtgggcagggctgaaagcgcacctcatggtgcagcctctggggttccacgcgcctgactgtggcaaagaggggtttgtggatctcccagaatatccctttggtaagctcaggtgcatagtagaggtccttgtatttctcgtgacaaaatccaaatggctataataaattgtggcccagttttacaataagagactgcatatgacaaaacattcagagttaaccaaaaatgagctatcagaagaatgcatcatctaaagtttatagtttttttaattggaaaaactgctcattagagcatccatcatttgaaaatgagaacagtaacagaaatgctgttaactattgtgattcaggactggagtccagagttgccaccagatgggatattcaaaaatacgccagagaggcctacaacctgggggtcaggtacattggcgggtgctgtggatttgagccctaccacatcagggcaattgcagaggagctggccccagaaaggggctttttgccaccagcttcagaaaaacacggcagctggggaagtggtttggacatgcacaccaaaccctggattagagcaaggtaagcatttttaaattaacattcttattattttcctttaatctcattttatttattgttgtaaatgtcatgcatgcacatgacaaaaagtatagaaatgtataaagtgaaaagtaaaaattatccccttcctgataccagctccattcccaaaattgtctttagtccatttgggctgttagaacaataccataaactgggtggcttatacacaacagaaatttctttctcagttctggagactgcaaagtccaagatcaaggtgtcagcagattcaatttctggtgaaggccttagagatgataaaggccatctataaggaagcaggcattccttatagatgataccttcttgctgtgtcctcacatggtagatggggcaccacagctccctggggcctcttgtcttttttgtttgtttgtttgtttgtttgtttctgagatggagtctggctctgttgtccaggctgcagtgcaatgacacaatctcggttcactgcaacctctgccccccaggttcaagtaattctgcctctgcctcccgagtagctgggattacaggcgcccaccaccacatccggctaatttttgtatttttagtagagacggggtttcactatgttacccaggctggtctcgaactcctgacctcgtaatccgcctgccttggcctcccaaagttagagtggggcctcttttctaagggcactagtcccattcatcagggatgcatcctcatgacccaatcacctcccagtggctccaccccctaatatcatcacactggtgactaggtttcaacatgtgcattgtggggacacagacaatcagaccatggcacagaggaaacctgtttgtcatttgtgttttgaaatcttgtacctctatttcttttgtcatcagttttaagtggtaactattgataaccctttatgaaagctgagggatttaaatcacataggcttccccttttccccgttctcctttttccagttttgattcgttacacttttatttcttctgttggatatctttttaagttaaaattatatatttaaccacctgtttcttagttcatcaatataaggcaggaatctcttgactccactctctgtaaaataagaatagattcccctctgcttctttccaccttccctctctcatctaccccttggtgtctttaagttttaccatactttactatcatcaaggtttataaccattttgttctattctatagttataattgtctttcaagctttctctgtaggttgatcctaaaaatataaaatcagtgaataacatttacaatattattataattgttatattaaacaagcaggactcatgagacataattagaattcacttttatttttgtctccctctatccctttaaacctactcaatgaattccttcgtttgttcctacttgaaaatactgaccagctctagaacttctctgggtgctcttaggcaatggaaagttccataatcactttatttcacagatagtctcagttcagtaattaaaagtgtttaggactgggcacagtggctcacgcctgtaatcccagcactttgggaggccgaggctggtggatcacctgaggtcagcagttcaagaccagcctggccaacatggcaaaacttcatctctactaaaaatacaaaagttagcctggcgtggtggcgggagcctataatcccaactactcgggaggctgaggcaggagaatcgcttgaattcagtggggtggaggttgcagtgagccaagattgtgccacttaactctagcctgggcaatagagcgaaactccatttcaaaatgaacaaacaaaaaaaccccaaaaataaaaaataaataaaagtgttcaggttcatgtcaaatcaaaactcagagcatgtttgaaacttgaagcttctccctttgtccagcaacagccttccacagacaggaaaccaggagaggccagcgcgctgcttctctttctctgttatgctcccaaacttcccttcccatcttgctaccatggtttctggcctcctcagattcaaagtaagaagaaagaggatggataaaggagtaagactgttgttgcttgcctggcaccctgataggaagccggcatcctctgaccctggcagatctttgtgagcacgctcatgggtcttcagaggctcccactggaaacttttgtctgtacttctcatgccacaggcatttttctgactgtgacttctgcctcagacagtggctttttcaaccaggtcactccagatatactctgatttgggggtcctgttgtcctccccggtaattctcttgggccagattttagatagttcaggctggctctctcactctcattaggctcaaaacagctttcaccctttctgcagacaagccatgagagtgtggtctgaccccaatttaacagcaccccttttgcccacaagcaaagtagctggcccattgttctcttgtggtccagattttccaggggacagtcaaatgagtcatctggctggttcgtggccacctccttttaacttctgtgcagtgtctgtcttgcaactccccttgatacctaaaatccatcatgccttggtgtttccagtcaaacttccaatctaatactctgttgcaggaataatagaaaattgttgcatttagaaaaacgttcactgcagaacaaagtagtatgcatgggaccatggataaagagaaataatcctatttacaaaacttgagctacttgttggagaatgttccaagcatcaaggtcaaatgaattttcttctcttgcattcccgtggatatattgtccaaatccatgccatatttcaatttgcttcatacttggtctgactttctttgtatagcctttggttttctagggatttctgattaacttccttttccattgttgaaagaaaaataacagggcttcactttccctgaggtcttataatttctaaattatattgtttgttacagtaagtcactttattattgaaggcatttttcttggggcctcaagaaaattactgttctgttatggatcattgtatttcacacacacacactcatactctgtctctctctatctttccatatagataatcttttgtgtatgtatgtgtgtgtgtgtgtgtatatatatatatatatatatatatatacatatgtatgtatatctgttgatataattccatcccccttccatcttctagaactagtcacaatctctgctgtcttctctctgttcagtactctcatgtacttcacccattttgtgcttatttattcatttcagtgggatttgaaagtcttcatttttgaactggaaaaatttgcctaatgcaaatttacttaggttgtaaaagtaggcaagaatcacttagccaaagctttcttctaggagatatggatatttaccagagaagatgttttgtatatgtgtcatactttttaaaaagtattaaatataaatataattaaaaggtgaggaaaacatactttggtgatgattaaaatagtttaaataagtgagtagtttatttaattatcatctgctaggaatccttaaaattcattagctattagaattaaaacattattctgtagaccaaagcaagaagacaccctttttaccctgactcccaaacctactgatattcacagaaatttatgattacacaataaacactagatttctgacatctcatcatccaaaaatattgatttattcattgttttgtaagtaaagtggaaaaaacaataaaaatatattcatcagaaagggctacgaccagggacctttgtactcttcttcctttgtctaacaacaagaaacaaatattggtaaagtaatttgtattattttcttagttactttttggagaattatactttgactcattacattaaaaactgttctcgtattcttctcattacattaaaatattgatagagttagaaggactctgttagaaatttcagaataaatataattcataaaagtatgtgaaatgtaaggctgggcatggtggcttacacctgtaatcccagtactttgggaggccaaggcagacggatcactggagctcaggagtttgagactagcctgggcaacatggggagaccctgtctctactaaaaatacaaaaattagcctggtgtggtggtgcacgccagtagtcccagctacctggggggctgaggcaggaggattgcttgaatccaggaggtctaggctgcagtgagccaagattgtgccactgcactccagcctgggcaacagagcaagaccctgtctcaaaataaaaagtatatgaaattgaaatacgttgtctttttctgaaaggtggtatgaaacctaatgattgttattgaaatgtaagaaaggcccctggcattaatggatatggacacagttttccgtctgtatgttaaaacaaaagttctgctttagcctgattatccaccaagttttgactgtgtgtgtgtgtgtgtgtgtgtgtgtgtgtgtgtgtgtggttatatacatatacatacatatatacatatatgacatattggacttataggtaagacttttaattaattaattatgtatatattgaaacacagggctcgaagggagtattgggagaatctgctgccagcttcaggcagacctttctgtccttcgctgtcaaagccagacttctaaggagtagtgaaagaaaaccctgaaataatcgaacaggaaaaagttgccctcaagcctgacctggaaccgttcctcaccttcatcctcaccatgccctgctatctccagctgctgagcagctgaggtgctgcagccccttcccttccagcccacaagtgtgtgcatattgagctcctgctgtggttaagcactgcaacagactctaccagagatgcaaagagaagcgagagaggcaccttgttctccaagaacttactgtccaatcatgctgtggtgcattcctttgaagatcatgaagaatagccaaacttgtctttgagggtgaatttgacactttaaaataatcagaagtcactgagacccaaagctagtgaataattcaagtgactaagctagatacttgaggatgatagagcaacactaaactaaagcaatgagtctgctttttttaatgatttatacaatgactccaaaggcaatcccaaagaaaagatgtaaagaatgttttgagcaatggtagcattattgaaataaatgtttaactatccaaagtgattactttcaaagatgatttttacttaaagatattaggtctggccaggcgaagtgactcacacctgcaatcccagcactttgggaggccgaggcgggcggatcacctgaggtcagcagttcaagaccagcctgaccaacatggtgaaaccctgtctctaccaaaatacaaaaattagccgggcatgatggcgggtgcctgtaatcccagctactcgggaggctgaggcaggagaatcgcttgaacccaggaggcggagcttgcagtgagccgagatcaggccattgcacttcagcctgggtgacagagtgagactccatctcaaaaaaaaaaaaaaaagatattaggtcctagaatttttaaaatgtgtcttcataatcataggtagctaggttataaactatttaaagacaagatcacgtgataagcttataatcttctcataattccccttacttagcattgtgttagacatactaataggtgcacagtgaaatacttattgttgattgtttaaaaataaagttttagaaaaccttttcaaaagtcagagtttaggccaggggcacaggctgacacctataatcccagcactttgggaggccagggcgggcagatcacttgggtcaagagttcaaggccagcctggccaacatggcaaaaccccatctctactaaataaaatacaaaaattatccaggcatggtggtgcatgcctgtaatcccagctacttggaggctgaggcatgagaattgcttgaacctgggaggcagaggttgcagtgagctgagatcgccccactgcaatccagcctgggagacataattcaaatctattttggtcttatatcttcttatgtttgtgttatttcatgtgtgccagtttctctttttttcacaacaatttatcaatttgtggcaataaaaatgatttaccttttatagtgtttgaatgtcgaaaatgtcatgaacattctttggaataatactagcaaatatttattactcactatgtcgcagtctttgttctaaagatgatctcatctacatataccccccaacagggattcaaaattagatagtgtttaacacagtagtttacaggtaaggaaactgaagtttaaggaggctaggtaacttgcctgaggtcacacaactagtaaatgtgaaattagtaaatttggatttgaacccatggggctggctctagaatccatgcccttagctactgcactacacggcatctgtcatgcacacagctgctgctttttgtcaaaaatctatccaaatttttctgtcgctggattcaaagtattttttatcaactttccttattatgaattaactcttcaaacctgccatgactgtttctgtaatgttgacaacctggaatttatttgatatagccactttacccataatacacaaccccaccctgctggaaattagaaagtgaatcatttactattatctcaaggcctttggggtccttaagggtgactaatccaaaccaccaattaaatacctgaatatcctcgccagcatcttcatcaggaccatccagtccctgtttgaatcccttaaatagtaactcactacctctcgagatcacttactcctttttaagaaacacttcattctctggaaagttattccatgtattaactagaaatctatttattaatgaccctcacctgcagacttggagcacctaaagtgcaaatttataatttcttccatataactctttgaaatttaaagatagctgtatggctttcctatacttacttgtcctcatttccttcaactaaaaggcataggctaagatgtgctttgtcaaatctacctgtgtgacactgtacagttacttaagctttatgccttaatttcctcatctgtaaaatgagggtaaaatagaaccatccttattagggtgctatgaggattaaatgagataagtttcttagaaacagtgcatgtcgtataacaggcattcattgcacattatatagtataatataattatgttgacttggtttccaatcccctcatcctcatggtgactgtcttctgggaacactctggtaccaaagcctctgcttatttttagtatgtagtcctgaacaccacattccaggggaggaccgtttacacaatatctcctgcttgcttcatagattttgtggagagggcagtgcaggacatcatgagaatagcaagagtgaagaaggtacattaggagggagagatgtctccacaccgaatcccttccttgggtctgcaccagcacaaacaaaggcttttatctagttactgtacagtttaggtgtgctaaactgtataggagtttgagaccagcctgggtaacatggcaaaactctgtctctacaaaaaaatacaaaaattagctgggcatggtggtgcatgcctatagtctcagctagtcaagaggctgaagcttgagcccgggaggtcgaagctgcagtgagctgtgatcacaccactgcactccagcccgggtgacagagcaagaccttgtctcaaaaaaaaataataaaataaaataaaataaaaataaaaattaagaaagaaaaaaagataaattttaccatataaaaactttaaatgtatgaacactcacacaaaaatactctaaacaaaggcaaaggcaaataggaaaactgtgtaacagaggtcagaaaccactcttccagtaaaggggtcttgagctgcttttgttcaaacctccccgaacccaaacagatgttgtgaggggggctcgcctatgtgattggcattcagaaccccactccactccattttcttgggcttacaggtattatgagaggacagtgtacccagctgggaccaagcaaagccttggggtcagcactagcatcaacaccatcagccatgttgatggtcactgtttcaggtgtaggatatgaggttgtggatcaggtgccccaggaagcacagtgcacctcgtggagatgatgtgagggccaggtcgttggatctacaggcactgacacagagctcggacagtttctgagcattcatatgttatcccgtaacatggtacctgccagccccacttgactctttccttcccaagaagcaggtcctctcccttgttgggcaacttctggggattgatggtcagctcctgtgcgcccccacgtgcactttgtactgcctcctccccacctccctcaatccccacaactatgtaaggttttcagaaaaactttcttttcttcatatgttattataataggacatcactccaaaagcaataggaaagtgaagtcctcttttctcaatggcatccttattagaggtggggaaatatttgccttatatctttccagtgctgggaaaaaagggtggggggaacagaataacacaatctgagtactaatatcctgccacacatatttgcatacatttgataagctaagggatagtttccttaatctat

SEQ ID NO: 2506 - DNA, 15318 bp, Homo sapiens
aatgctgctgcctgtgacctcgccagggaagtggctggcaaaggtgatgctttggtagcaggggggatctgccagacatcaatatacaaataccagaaggatgaagctagaattaaaaaactttttcgacaacagctagaagtttttgcctggaaaaatgtggacttcttgattgcagaggtgaggctagtattggaggaaaaggattgaacctattttgcaagcataactgcagagtcttcacatttcatgagggtattggacaacattctgccctcatttcttccatgtggatggtcaaaggtttatttaaatgcatggtagtcaaggccaacattccctcattggtatgctaggttctcttagagccaaaggacagacccaagagaggcctgaccatagccttttatcttctaaggtctgggtggctgcagaagctgacttgggggactctacaacctataaggaagcatagggcacagtgcctccgggagcaccctctccagagggagaatccacacaggagggcactgcatgtgtgggctggggactgagagagcaaggcctggaaggtggtggctatccaggctcgtctaggccccaccaataatgctcagcacccagtagtttccatagccttctccatccatgtcttgctcttcttgcctctctgctttcactcaagctatgacatgtgaattacattttgaagaaagaatcagtaagaattggtcattgattggacatgaaggcccagaacattctctttcctccacttccaaaacgaaagtcctcattccccatttcccaacataactgctactgcctggggtcatgccttcaacccacaactttactccaaacaagagaatatcccctggcttggcgcggtagctcacacctgtaatcccagcactttgggaggccaaggcaggtggatggcatgaggtcaggaatttgagactaccctggtgaacaaggtgaaagcccatctctactaaaaatacaaaaattagctgggcatgttggtgggagcctgtagtcccaactactctggaggctgaggcaggagaatggcttgaacctgggaggcggaggttgcagtgagccaagatagggcaccactgcactccagcctgggcgacagagtgatactctgtctcaaaagagagagagagagaatagccgccaccattattccccctagtgaccccactgaactctactgaaaaccttgcctcatcctcctgcccacgcctggccaaccccactgggaacagtcatctgcagggacaagcacaaattccaccctctgtgctttccagatggatgatgacaccactctgtttgtttaagaacccgtcttttgattctctcataattcctcacactgcttctgcagaatttgtttctaactcaagagggaagaaacaggaagatttctggcttttctttagttgccttaaggtcagcttttcagctgtggcactgaaggggcttcctgggaagcacccaagaaaatgacatgggtttaccagacaagatgtcctgtccaccactggcaaagacagggagtagctatttctcctatgctgtgcctcaatcttctcacccggggaaatggtgcttcccttcctactttatggagcacttatgaatatctaactagaagtgaatataaaagctctttgaactataacacatgataagctactcattgtttcagagattaccccagttttataagagatgaatctaaaatttattagcaaaacttttcctccttcaaaattacaaaattatgattttaaatactcaattactttgaaaacctctgggtgtgttttcttcttttttactaataggcatcatctcactgaatcaatgaaccctgaatgaaaaactatatgttattgttataggaatgaaaatgtttactcagaaaggtattctttagtcagtctgatagacacacattccttagcaagttttattatgcatatgtttatattctatttggtaatttttataactgttttgctatatttacctttaccattcaaaatctgctttatgtttggaccagtagaaaaagtgacatttctcttagtattttgagcacgttgaagaagctgtgtgggctgtggaagtcttaaaagaatcagatagacccgtggcagttaccatgtgcataggcccagagggagacatgcatgatataacccccggagaatgtgctgtgaggctggtgaaggcaggtaatttggacccataccgtgatacacagctcagttgttgcttacgaaatttaacaaagtgtgcttgatattgtgagagcagtttggaaatagaagaatgaactccaatcagttttcttatctgtaaattgtgggaggtggaggggaatggctaacctctaaggtaccttccaactattaaaaaaaaagaataaacaaataaataataaaatgtaagtgttatttctttgcacaggggcttccatcgttggcgtgaactgccgctttgggcccgacaccagcttgaagacgatggagctcatgaaggagggtcttgagtgggcagggctgaaagcgcacctcatggtgcagcctctggggttccacgcgcctgactgtggcaaagaggggtttgtggatctcccagaatatccctttggtaagctcaggtgcatagtagaggtccttgtatttctcgtgacaaaatccaaatggctataataaattgtggcccagttttacaataagagactgcatatgacaaaacattcagagttaaccaaaaatgagctatcagaagaatgcatcatctaaagtttatagtttttttaattggaaaaactgctcattagagcatccatcatttgaaaatgagaacagtaacagaaatgctgttaactattgtgattcaggactggagtccagagttgccaccagatgggatattcaaaaatacgccagagaggcctacaacctgggggtcaggtacattggcgggtgctgtggatttgagccctaccacatcagggcaattgcagaggagctggccccagaaaggggctttttgccaccagcttcagaaaaacacggcagctggggaagtggtttggacatgcacaccaaaccctggattagagcaaggtaagcatttttaaattaacattcttattattttcctttaatctcattttatttattgttgtaaatgtcatgcatgcacatgacaaaaagtatagaaatgtataaagtgaaaagtaaaaattatccccttcctgataccagctccattcccaaaattgtctttagtccatttgggctgttagaacaataccataaactgggtggcttatacacaacagaaatttctttctcagttctggagactgcaaagtccaagatcaaggtgtcagcagattcaatttctggtgaaggccttagagatgataaaggccatctataaggaagcaggcattccttatagatgataccttcttgctgtgtcctcacatggtagatggggcaccacagctccctggggcctcttgtcttttttgtttgtttgtttgtttgtttgtttctgagatggagtctggctctgttgtccaggctgcagtgcaatgacacaatctcggttcactgcaacctctgccccccaggttcaagtaattctgcctctgcctcccgagtagctgggattacaggcgcccaccaccacatccggctaatttttgtatttttagtagagacggggtttcactatgttacccaggctggtctcgaactcctgacctcgtaatccgcctgccttggcctcccaaagttagagtggggcctcttttctaagggcactagtcccattcatcagggatgcatcctcatgacccaatcacctcccagtggctccaccccctaatatcatcacactggtgactaggtttcaacatgtgcattgtggggacacagacaatcagaccatggcacagaggaaacctgtttgtcatttgtgttttgaaatcttgtacctctatttcttttgtcatcagttttaagtggtaactattgataaccctttatgaaagctgagggatttaaatcacataggcttccccttttccccgttctcctttttccagttttgattcgttacacttttatttcttctgttggatatctttttaagttaaaattatatatttaaccacctgtttcttagttcatcaatataaggcaggaatctcttgactccactctctgtaaaataagaatagattcccctctgcttctttccaccttccctctctcatctaccccttggtgtctttaagttttaccatactttactatcatcaaggtttataaccattttgttctattctatagttataattgtctttcaagctttctctgtaggttgatcctaaaaatataaaatcagtgaataacatttacaatattattataattgttatattaaacaagcaggactcatgagacataattagaattcacttttatttttgtctccctctatccctttaaacctactcaatgaattccttcgtttgttcctacttgaaaatactgaccagctctagaacttctctgggtgctcttaggcaatggaaagttccataatcactttatttcacagatagtctcagttcagtaattaaaagtgtttaggactgggcacagtggctcacgcctgtaatcccagcactttgggaggccgaggctggtggatcacctgaggtcagcagttcaagaccagcctggccaacatggcaaaacttcatctctactaaaaatacaaaagttagcctggcgtggtggcgggagcctataatcccaactactcgggaggctgaggcaggagaatcgcttgaattcagtggggtggaggttgcagtgagccaagattgtgccacttaactctagcctgggcaatagagcgaaactccatttcaaaatgaacaaacaaaaaaaccccaaaaataaaaaataaataaaagtgttcaggttcatgtcaaatcaaaactcagagcatgtttgaaacttgaagcttctccctttgtccagcaacagccttccacagacaggaaaccaggagaggccagcgcgctgcttctctttctctgttatgctcccaaacttcccttcccatcttgctaccatggtttctggcctcctcagattcaaagtaagaagaaagaggatggataaaggagtaagactgttgttgcttgcctggcaccctgataggaagccggcatcctctgaccctggcagatctttgtgagcacgctcatgggtcttcagaggctcccactggaaacttttgtctgtacttctcatgccacaggcatttttctgactgtgacttctgcctcagacagtggctttttcaaccaggtcactccagatatactctgatttgggggtcctgttgtcctccccggtaattctcttgggccagattttagatagttcaggctggctctctcactctcattaggctcaaaacagctttcaccctttctgcagacaagccatgagagtgtggtctgaccccaatttaacagcaccccttttgcccacaagcaaagtagctggcccattgttctcttgtggtccagattttccaggggacagtcaaatgagtcatctggctggttcgtggccacctccttttaacttctgtgcagtgtctgtcttgcaactccccttgatacctaaaatccatcatgccttggtgtttccagtcaaacttccaatctaatactctgttgcaggaataatagaaaattgttgcatttagaaaaacgttcactgcagaacaaagtagtatgcatgggaccatggataaagagaaataatcctatttacaaaacttgagctacttgttggagaatgttccaagcatcaaggtcaaatgaattttcttctcttgcattcccgtggatatattgtccaaatccatgccatatttcaatttgcttcatacttggtctgactttctttgtatagcctttggttttctagggatttctgattaacttccttttccattgttgaaagaaaaataacagggcttcactttccctgaggtcttataatttctaaattatattgtttgttacagtaagtcactttattattgaaggcatttttcttggggcctcaagaaaattactgttctgttatggatcattgtatttcacacacacacactcatactctgtctctctctatctttccatatagataatcttttgtgtatgtatgtgtgtgtgtgtgtgtatatatatatatatatatatatatatacatatgtatgtatatctgttgatataattccatcccccttccatcttctagaactagtcacaatctctgctgtcttctctctgttcagtactctcatgtacttcacccattttgtgcttatttattcatttcagtgggatttgaaagtcttcatttttgaactggaaaaatttgcctaatgcaaatttacttaggttgtaaaagtaggcaagaatcacttagccaaagctttcttctaggagatatggatatttaccagagaagatgttttgtatatgtgtcatactttttaaaaagtattaaatataaatataattaaaaggtgaggaaaacatactttggtgatgattaaaatagtttaaataagtgagtagtttatttaattatcatctgctaggaatccttaaaattcattagctattagaattaaaacattattctgtagaccaaagcaagaagacaccctttttaccctgactcccaaacctactgatattcacagaaatttatgattacacaataaacactagatttctgacatctcatcatccaaaaatattgatttattcattgttttgtaagtaaagtggaaaaaacaataaaaatatattcatcagaaagggctacgaccagggacctttgtactcttcttcctttgtctaacaacaagaaacaaatattggtaaagtaatttgtattattttcttagttactttttggagaattatactttgactcattacattaaaaactgttctcgtattcttctcattacattaaaatattgatagagttagaaggactctgttagaaatttcagaataaatataattcataaaagtatgtgaaatgtaaggctgggcatggtggcttacacctgtaatcccagtactttgggaggccaaggcagacggatcactggagctcaggagtttgagactagcctgggcaacatggggagaccctgtctctactaaaaatacaaaaattagcctggtgtggtggtgcacgccagtagtcccagctacctggggggctgaggcaggaggattgcttgaatccaggaggtctaggctgcagtgagccaagattgtgccactgcactccagcctgggcaacagagcaagaccctgtctcaaaataaaaagtatatgaaattgaaatacgttgtctttttctgaaaggtggtatgaaacctaatgattgttattgaaatgtaagaaaggcccctggcattaatggatatggacacagttttccgtctgtatgttaaaacaaaagttctgctttagcctgattatccaccaagttttgactgtgtgtgtgtgtgtgtgtgtgtgtgtgtgtgtgtgtgtggttatatacatatacatacatatatacatatatgacatattggacttataggtaagacttttaattaattaattatgtatatattgaaacacagggctcgaagggagtattgggagaatctgctgccagcttcaggcagacctttctgtccttcgctgtcaaagccagacttctaaggagtagtgaaagaaaaccctgaaataatcgaacaggaaaaagttgccctcaagcctgacctggaaccgttcctcaccttcatcctcaccatgccctgctatctccagctgctgagcagctgaggtgctgcagccccttcccttccagcccacaagtgtgtgcatattgagctcctgctgtggttaagcactgcaacagactctaccagagatgcaaagagaagcgagagaggcaccttgttctccaagaacttactgtccaatcatgctgtggtgcattcctttgaagatcatgaagaatagccaaacttgtctttgagggtgaatttgacactttaaaataatcagaagtcactgagacccaaagctagtgaataattcaagtgactaagctagatacttgaggatgatagagcaacactaaactaaagcaatgagtctgctttttttaatgatttatacaatgactccaaaggcaatcccaaagaaaagatgtaaagaatgttttgagcaatggtagcattattgaaataaatgtttaactatccaaagtgattactttcaaagatgatttttacttaaagatattaggtctggccaggcgaagtgactcacacctgcaatcccagcactttgggaggccgaggcgggcggatcacctgaggtcagcagttcaagaccagcctgaccaacatggtgaaaccctgtctctaccaaaatacaaaaattagccgggcatgatggcgggtgcctgtaatcccagctactcgggaggctgaggcaggagaatcgcttgaacccaggaggcggagcttgcagtgagccgagatcaggccattgcacttcagcctgggtgacagagtgagactccatctcaaaaaaaaaaaaaaaagatattaggtcctagaatttttaaaatgtgtcttcataatcataggtagctaggttataaactatttaaagacaagatcacgtgataagcttataatcttctcataattccccttacttagcattgtgttagacatactaataggtgcacagtgaaatacttattgttgattgtttaaaaataaagttttagaaaaccttttcaaaagtcagagtttaggccaggggcacaggctgacacctataatcccagcactttgggaggccagggcgggcagatcacttgggtcaagagttcaaggccagcctggccaacatggcaaaaccccatctctactaaataaaatacaaaaattatccaggcatggtggtgcatgcctgtaatcccagctacttggaggctgaggcatgagaattgcttgaacctgggaggcagaggttgcagtgagctgagatcgccccactgcaatccagcctgggagacataattcaaatctattttggtcttatatcttcttatgtttgtgttatttcatgtgtgccagtttctctttttttcacaacaatttatcaatttgtggcaataaaaatgatttaccttttatagtgtttgaatgtcgaaaatgtcatgaacattctttggaataatactagcaaatatttattactcactatgtcgcagtctttgttctaaagatgatctcatctacatataccccccaacagggattcaaaattagatagtgtttaacacagtagtttacaggtaaggaaactgaagtttaaggaggctaggtaacttgcctgaggtcacacaactagtaaatgtgaaattagtaaatttggatttgaacccatggggctggctctagaatccatgcccttagctactgcactacacggcatctgtcatgcacacagctgctgctttttgtcaaaaatctatccaaatttttctgtcgctggattcaaagtattttttatcaactttccttattatgaattaactcttcaaacctgccatgactgtttctgtaatgttgacaacctggaatttatttgatatagccactttacccataatacacaaccccaccctgctggaaattagaaagtgaatcatttactattatctcaaggcctttggggtccttaagggtgactaatccaaaccaccaattaaatacctgaatatcctcgccagcatcttcatcaggaccatccagtccctgtttgaatcccttaaatagtaactcactacctctcgagatcacttactcctttttaagaaacacttcattctctggaaagttattccatgtattaactagaaatctatttattaatgaccctcacctgcagacttggagcacctaaagtgcaaatttataatttcttccatataactctttgaaatttaaagatagctgtatggctttcctatacttacttgtcctcatttccttcaactaaaaggcataggctaagatgtgctttgtcaaatctacctgtgtgacactgtacagttacttaagctttatgccttaatttcctcatctgtaaaatgagggtaaaatagaaccatccttattagggtgctatgaggattaaatgagataagtttcttagaaacagtgcatgtcgtataacaggcattcattgcacattatatagtataatataattatgttgacttggtttccaatcccctcatcctcatggtgactgtcttctgggaacactctggtaccaaagcctctgcttatttttagtatgtagtcctgaacaccacattccaggggaggaccgtttacacaatatctcctgcttgcttcatagattttgtggagagggcagtgcaggacatcatgagaatagcaagagtgaagaaggtacattaggagggagagatgtctccacaccgaatcccttccttgggtctgcaccagcacaaacaaaggcttttatctagttactgtacagtttaggtgtgctaaactgtataggagtttgagaccagcctgggtaacatggcaaaactctgtctctacaaaaaaatacaaaaattagctgggcatggtggtgcatgcctatagtctcagctagtcaagaggctgaagcttgagcccgggaggtcgaagctgcagtgagctgtgatcacaccactgcactccagcccgggtgacagagcaagaccttgtctcaaaaaaaaataataaaataaaataaaataaaaataaaaattaagaaagaaaaaaagataaattttaccatataaaaactttaaatgtatgaacactcacacaaaaatactctaaacaaaggcaaaggcaaataggaaaactgtgtaacagaggtcagaaaccactcttccagtaaaggggtcttgagctgcttttgttcaaacctccccgaacccaaacagatgttgtgaggggggctcgcctatgtgattggcattcagaaccccactccactccattttcttgggcttacaggtattatgagaggacagtgtacccagctgggaccaagcaaagccttggggtcagcactagcatcaacaccatcagccatgttgatggtcactgtttcaggtgtaggatatgaggttgtggatcaggtgccccaggaagcacagtgcacctcgtggagatgatgtgagggccaggtcgttggatctacaggcactgacacagagctcggacagtttctgagcattcatatgttatcccgtaacatggtacctgccagccccacttgactctttccttcccaagaagcaggtcctctcccttgttgggcaacttctggggattgatggtcagctcctgtgcgcccccacgtgcactttgtactgcctcctccccacctccctcaatccccacaactatgtaaggttttcagaaaaactttcttttcttcatatgttattataataggacatcactccaaaagcaataggaaagtgaagtcctcttttctcaatggcatccttattagaggtggggaaatatttgccttatatctttccagtgctgggaaaaaagggtggggggaacagaataacacaatctgagtactaatatcctgccacacatatttgcatacatttgataagctaagggatagtttccttaatctataaattaggaaataattaccttaatccattaaatatagaaaaagataaacacattcaaaattaggtaaatgcacagcaaagtgacgagataccttttttcacctatcatcaactaggatcaataagtggataatatgtcaatgagggtgcaggggaaaagactttctcatacatatgctttttgtagaagcataatctggtacaaactatttggaaagtaattggtccatatttacaaaatttagaattcacatgcccttggatgagcaattttacttctaggaatataatctgcaattatgttcatatatatgcaaatatgtatgtctggaaaccacctaaatatccatcaatgacatattagtaaatgaattatggaacatctacaggatgttaaagcatggcatcattacaaagagtacattatatcaatatgtgctaagatggaaggatctcctccatatattgttaaatgaaagtatgctcccattgtgtgtacatagaatatttcaggaaggaatatctccctcctaggggagaaagactggtgatagaaagtgtggtgtaggaggaagacttccttttctctgatgcccttctttagtgtctacatttgttaatatggtttggtattactttttctacaaaataaattagttttaaaacatatgtcaagatttctgattccaaggggaaaaatcagataacatgagtttcctgttgtgatacagaatgggaaacgctacattaccaatgatgtacaccagccagaagtgcctgggggaatctaatcaagcctttagatttcacttccagttcagtgaaatcaagggatataggaacaaggtaaacaccacaatcaggtgaatcctatattctacaggctggctggcctggtcttttccacaggtcattgtgttggagttgctcatctttatatgacaaaccaatgcaatgcatggtcctggttgagacaaactggctataagaggtcttttgggaacaactgggcaaatttgactaaggaatcaggttaattttggcaatgcaggaaaatgttcttaatttctggaaataatgcaattttttaaaatgcatactaaatgttgattactatttataatttatgctaaatattttagaatataaaaaggaggcgtttttaaaaggcaagatttccacaggttttgattttgtagggggaaattaaggagaaggtaattgtctgccaaaaaaaaacagtgcaattaagaaaaactggcttgaactagctctttccagttctacagcagatgtttgctgtactggagttatcaagaagagcagatggccctctgataaaccctgctgtgcatagactcagcaatgcagaccagcaaatagctggcatggaaaccaactgaaagggatcgaagagatttgttgaaactaggggcgagggtcagctggaaaaacaattcctgctttgcaatgatcacagccatgatttgatactttatgcaaaatcataaacaaagttaagcaactcactttggctgtacagtcagctgccttgaaggtgagcacatattttatttaatcagtaatgaaaatcctgaaaagagttgcagaagggtgcaattttgcctcatatcagtgttgttttgtgaaaggattttgagaaaagtagatggggcatgctagtggtgctattgctggcagtcacgtttcatttataacctccattatttatctggagcacagaggtgggaagaggagagaaagagaaataaaagttgtattttccatgatacaggtgcagatgagcccgcctttcaaaatagtgaagttggaggagaatcttttcatctggtggtggcaactcacctcgagggttctgtgctttcataactaatcatgttcaaccattttttaatttattcactcattcaatcactcattcattcactgttcaaataacatttatttagtgcttgactatgatagtcactcttatatgttccatagtaccctatatttatcattaataagttcaatgtagtttttgcttatttgttttggtttttttgtttgtttttgagacagagtctcactttgttgctcagactggagtgcagtggcaagatctcagctcactgcagcctccgcctcctgggttcaagtgattctcctgcctcagcctactgagtagctgggactacaggcgcccaccaccacatctggctaatttttgtatttttcatagagatgggtttcaccatgttggccaggctggtcttgaactcctgagctcaagcgatccacctaccttggactcccaaagtgttgggattacaggcatgacccaccatgcccggccagttcaatgtagttttaatactcccttggtcattcctgtttacttgcctattccctactcaacaggacagtgaaaacatcttgttagttgttgtattctcagcatccggcacattatagaactcaaaaaaaaattgttgaatgaatgaataagtaaatgaatgtacaaaccatgctaaggtcaaaggatgcaaagatgaataagccactctcttatgttgccttgctgaatcctcttgtcaaaagtattttgaagaacacgcacatggtgtaggacagaccagcatcagattgtgctcttttaaagaagctgaagttgaagagactggaaggaggaaatggggggcatcagaaagtgaaatggcaggctgtgcaaacagaatggctcagggggcaaccctgagaaggcccagaccagagtagatgaggaagcatttaggacagaggagagagttaggactcagggtcattagcaatagacaaaagtgcacattcaaaaatgcatcattggctgggcatggtggcttatgcctgtaatcctagcactttgggaggctgaagcatgtggatcacttgagctcaggagtttgagaccagcttgggcaacatggcaaaacctcatctccaccaaaaataggaaaaattagtggagtgtggtggcgtgtgcctgtggtcccaggtactcaggaggcttaggtgggaagatcgcttgagcccgagaggtggaggttgcagtgagccaagattgtaccactgtactccagcctggataacagagtgagactctgtctcaaaaaaaaaaaaaaaaaaaaaaattaaaatatgggaaccattttaatgtcttaaaaaagtaaaaccaacacaagcattttaactgttcaactaaaacatgagtgtgggatacactatttcaaaccgcttttttttaaaattattattattatactttgttttagggtacatgtgcacaacatgcaggtttgttacatatgtatacatgtgccttgctggtgcgctgcacccactaactcgtcatctagcattaggt

SEQ ID NO: 2507 - DNA, 8487 bp, Homo sapiens
cagtgctgagatcatggctcactgcagtctcctgggatcaagcaatcctcctgcctcagcctctcaaagtgctaggattataggtgtgcacaaccacgcccagcttatagcagtttggtttctataaccctataggaacagaggtcaacaaggattatttttattaaaaatatcaaaagaagagatggacaggtataagtaaagtggttaagtctgaaactgtagaacatagaacttctgggtaaaatccttagagtccactgatggaggtatgttagaaggctaacagcttcaacttcgcatctccaattctataattaccaactgaaatagatgggcaaaccaccttaactttgtataaagtactcatgacacacactgtgcagtgggagaagtaaagaaaatgttagcctgagagtaactttgtatttgtctacaaacccaaatcttatctcctccaccttttaactgaaagggtcaagagagaaaaggctgcaaaggcaccagggaagctggggaaatcctgaaggataatgaacaaccacaccacgttaggccactccacgtggagacagcctctgcacgatggttcaaacatcaacttaatgaagagagagtgggcataaggggttgaattcatccaactttggatcctgactatctaagctgtctctaacatgaggtcccaattctctagtaatcagaggggttgagagggtgaggaaggagagttgtaaatgggagtggacttactttatgcagtcaaatcttaacaagacacaagccctagaggaaacaactctatggacctgaaaactgcaaacacacacacacacaccatacaaattgttctgaccagcaaagaaggcatgaacacttgacttcctaacaagggtccacaggcagagaccatctatcttgtttgaaattcttaaaatcctggttacatgattctaaaattcctggacacatgatgtcccaaccaacaggagattagaagtagcagattgaaaggctagagaaagctacacagatatcagcaagaactgacagctgacaaaaaggtaagaaagagaatcattattctcaaaagtgagcatattttaaaactcagcagtctaggagcattgagaggaactaacagctttacaaacttcaacctctcttgagtcattgccatccccaggcatgtgaaaaataattacaagtgtaggaaagaaatacagcatagtagcataacatattaaagagatttaggaattctagttcacactaaattcattgagaatgaagcgtgctgtagcatgacactctgcaatcttagggtatagtaacagaggccatataaggaaatgaatgaggaggtcacccctccttcagtaagttgaattctggattccttaatttgagaagaaagagcaattaagtgtatattcagatgagagccaccaagaccctgaggagatctgaaaacaaggactgtatgatttttttttaagtgcaatgacagtggcattgaggggcaacaatgcataaacctagtttgtgggactgactgagagctgctgctgaggcagcatagaggtccctgggatttccggggtattaacatgcctgtgcggcaatggatccttgcaactactacaggtgatctgaccatatctacacagtatccctggctcagtctttcagccctgcttctcacacagggaaatccagagcgtgggtggcaggggacgtgccagcaggaacttgaaaacacagtaagtgcagctccaggggctatagacacattttgtttgatttgcagtctcccttacaccccctcatttgggcctgttttaaatatgaatgggtttgatataaaaatgtgtttctgaatttcccaaggcccgcagcagccatggcgacaatgaactagaaatgcggtcagcctccctgtttggctactgccttccaaaattaacaccacttatttttcaacaaaaacaaatcaaacctcctagtctacttcatctatttaacctgccctgcctggcacttgagtgtgtaaagcctgccctacagcagcacttgatgtaaatgcaacttaaaatatttttatatttaagatcaacacatatattagagaataaagcaaaacacatactagagaaaacatctacctattagccctgggatgtcgaaaaagcttcaagcctatgtaccttttcaagggtcaccatgggcactttgcttactgaggggtagaagtttcctatcttgctttatttcagagcagtggttctcaaccacatgcaagtttgttcccaaaggacatttgggaacaatgtctgcagacatttctggttttcacaaccgggggaggatagggggagctactagcatctactgggtagagcccagggatactgctaaacatcctacaataaacaggacagcccccacaacaataattatctggcagaaatcctactttagcagaaatcctactttaggaaagttttcaggaagtgctggcctataagatacaggatactttgaggctcctcaacatctgccccaaccaaaccattccaaactcatttaaactttcacctcctatagtttatcctccactcctcatatgccccatcactactagcagtttttttcaactttcacctcccaggttcaagcaagttcaagcaattcttgtgccccagcctcctgagcagttgggattacaagcatgcgccaccatgcccagctcatttttgcatttttcgtagagatcgggttttgccatgttggccaggctcattttgaattcttggcctcaagcaatccgcctgcctcggcttcccaaagtgctgggattacaagtgtgagccacagcacccggcctcctctgtttccttttaagaagatgaggctaaaagcactgtcaactcactgggttgttctgaggatcagaggaacccaggatatttcagggcttagtcaagagttttccatgttctggggctcccaaacttaccctagaaaagaaagctgtaataaaacatactgtgaaaccccgtctctactaaaaatacaaaaaattagccgggcgtggtggtgggtgcctgtagtcccagctacttgggaggctgaggcgagagaatggcgtgaacccaggaggcggagcttgcagtgagcccagatcgcgccactgcactccggcctgggcgactgagtgagactccaactcaaaaaaaaaaaaaaaaagaaagaaagaaaacataccaacaaaagcaaacacatgcacctgtgaccaaaatagaacatcaaagactctctcacatcacaaatgtgagccatactttagacagaacccacgttacaaacaaggtcccttacagttctagtgcatgctcagaacaaattgaggggcaaagacctaacaagaggggcatcaacaaatctggtatgtggccctgctcaagcatgatcctgttatcattctagaaaggggaaagcagaagtaaaccaagccataaatgagcctctctcactcccggggtttttgaaaaggggatgtaaaagaggccatgtattatttacagccgaggaagcaaggacctcagatggtactgaaacaacgaatatagcctatatcaatgccagcttgtccacattacatgcaagccttgtggttgtctctggatgccccattgtctattacaaattcatcacaaccatgattggatactgtcaagcttcacaaaaagacaagagccagctgtcaaactaaattcttctcattgtttaccaaaaggaggcaaaaaagattctaattattctagccccacgaaacaggtaaataagaaacacagagtcacatgttctgccatagaacaactcacagttagaatttattctgcttccaaggacagccacagtgactgcaggggtatggctgcaaagttcatattatttaataagcaaattggatcaagaggctgaaggctttatgttttcatatttattaagtaaagatgtattcaaaacacaaaagcagaaaggggaagggaaaatcatggttgagggcacacatgcttttcagaggagtatggtataaagagaccagcccacatctaacctgaatgtcacctgtgatgtagtatgcacacatcaccctgtttaatcatgatgtaggcctttaaagtagatgctgttgattcttctcatcttacaagtgtgatataactgagtctcagaggaagaataatgtgcccagggccacacagctggtcagtggcagagccaggaattgaggtgtctacctgactccacagtttttaatttagataaactctaagcttatctaactacaaaaacagagcaaagagtattaggaagccagtattagctaacataaatgagaaatggatactaagcaagagaaagtaaatgtgagaaggggaacccttgttactctgtgagacacagctgaccttggtgcagcaagttttctgaatgcaaagcccagagacagcttcaccttggaggagtgaggccgtctaccaagccctgtgaaaaggagcacctgaacagaaccgagacaacctcagacttgcttcaagcccgtgttcacaaaataatccaatgggtgcactgagcccagtgacagcggctgccctcaccttgccctacatgtcctctttggaagagctggcatcttatatcacaactcgacagtcagctgccccttaaacagtgagactctcagttatggctctgggggaaggacttactacagaccatctccatagtttcataggtcagaagaaagcacctttgaagtgttagcccaattttacagttaaacagaagagaatgctgcttgaaggatcagatgatcaaagcagagattgaccatgctggtctgcaaaagtatgccctttaggtgtaagcccattttacaggtagcaaaactgagtccgagaatttaactggataggccatccaggttcactatgacttgcttaaaagcagtgttggactcaggtgactctaagcctcacagtctatcactaggttgcactatcttacccctttatagtcacacgatacagaataaataaaagtgaatcaactgagcggatcaaaataaaaacagaagtaaatcacttgagcaagcaggaggctggctccaagtgctcagagtctagtggaatcactgtttaacctttgaaaaaggaagtaggttaaatttaaggacatggatggatactaccaaacttaaattaaataggcaagttcactcacttttaattagccacaatcttaattaagcagccacctataaaaagcccagtaaccaccattaccagtgaagctatataacattcctgcaggagaagatccaggcttggctcttggatgtaggttatctagagagcctcattagtccactgagatcccactggctaatggaccactcaggggcctgtgtccgcctgaagtacccagcctcagtctcagcctagccacctgcagcccaacacccctcaacctacagtcttctgttagcatctgattaggtgttaaggtgtctataaggtccccttatttcctgcctgggcagctgctataacagtcttggccaaactgcagttgtaaagtgaactaagtccatagctaataggtcaggtgataagatgtgagagaactagctgtcttttgcttgtgttcacagcctgctctaaactggtagggctctaacaagccacttgatctatttccccaaggaactaaaaggtctaccggaaaggatgataacaacaaataggggtggcaggcaatcgcgcttccctagatccaggctctctggcctacatagcaaaggcaaaatcacatgcggaaggaggggctataaggattctccaagtgttaggaagctttaaatgatgcacaccaaaggaggagcttaaaataccaaggagaaagtctccagattaaaacaaagaaaagccctaattctaagggggaaaacttgttcctgaatcacagctaaagaatgtagagctattcagtattagtgtcccttctgctgaaaaaaccaaacagacaaaacaactacaaaacttagaatggggtggggtgaagagcaggagctagcacaacaatacagagatatccgaatggtttcagaatctgagcatgtcgagctgcaaaaaggtggtgccaggagaacccagggcaggggcaagaggaagtgtatgaaacatcctctgagtggattcccttactgggtgtggggaacaagggattgtctaaatctaagaggcagagaaaaataaatgtctctcaagtttaccatctcttgaacacagccccattaccatgtgcatggccatctgcaggaccaaggcaagtactctgaagtgggcaaggaagatggagtggagggcagagcatggtgcctggcacgaagcaggcatgaccctgatagctggatctcagcagcaggctggaagggcccatcctctctggattatatagatgacttaaaatgaacagaaatcatcaaatccaaaaacgataatcacctccttttagcattctccattacattcaagttctcaagcatcaccgagcagaaggtaggaggctgcttacctgcctttgctcctggtctcttcccatccaatgttagaagtgggaaaggctggtctcccccatctgcctccgcaccagtactccacatttttctgacccttcttcttcttcttgggtttgtgagcctgggctttccttctgtcattctcttcttctatctcttcataggaataagaggaggtcccctcactttttaacatctctccttctggccacagcctaaccaggaacatcgttggtcattgtggggaaactggccctggaggcccatcctaggcatggccctaccgaatccagagggcaggcacctagaagccttcctgctgggccatgttcctttagacaggtggaagccctcagctgagcaaaggggagaaacaggagtgcaagggaactgaagatgataatcatggggctctctgacctcacagtgatgcaggcagaggtttcctcgccacatctccgtacatcagagaacagaaggaagccaggtcatggggctgaggatgggcgacttgatttttaagacagcaggatgcaacagtttcttttttctaggacagttaaaatgacgcaattgattatagaacagcgatgagaaagagcagcccccagtgggccaccactccccatgaaggccaaaggctttaacaccttgatttaggtgtagtgtcaagttgttgtttttctctcttctatgggacaatgttggactttaactgattcaacagaaaattctcaagaatgtctgcatgtgctaagtactgtacaagccctggataagttaggttaccaccatgcacacctacctgctggatgcctagatttctttatgacgtatgcaagacagattcagtcatttgtcaaatatgaccattttttgttttccccccactacagaactagaagatgatgtttatgtcactttttgagcttagatctcattccagtgtgctggggctagtgccacatgccccttccttcaccatggcacccacccaccaggctctaaggaagcacccacacctgagagtaaccaaagacaatacctgaaatgttttggtaaggccaagctattagatcaaggtcaccctttgaaaacacctttgagatgtgcagtctagaaggctttcccttcagaaaagaacattctctggacaaccttgttgtcaacgttgataaactgtgaaacacaaggcactgttctttcactaagaaattttccctcttctcaacatgggattacatattgtctgtaggaaatttgtgagttaaaaaagcatatgcagaaaatagcacctataccccctacctttttataattagcatatgtcttcgtgtgtacttgtatatgtggattaaagacacacatgcatgggctttggatcgggtgtgccagaaagaatcctagctctgaaactaacagtgtgatgtgcaatttaacaagcttcacagttcgcttattattaaaatgggagttacacctccttttccataagtttgtaaggactaagagatgatacatgcaaagcacacaacacagtccaaacaaggaagaacctgctaagcctccttatacctccttctccataggtttatcaactaagagatgacacatgcaaagcatacaacacagttcaaacaaggaagaacctactaagtagtagatgtcagtatgaaagtttttccattaggccttgggattgttttctatggctgctgtaacaaatacatgaacttagtggcttaaaccaacacatgtttattgtctacagctctggaagtcagaagtctaaaaccatttcgttaggcctaaatcaaggtgttatcagggccaggctt

SEQ ID NO: 2508 - DNA, 25834 bp, Homo sapiens
ttatctagacattgctatttcattcaggaatttatctctgctgtatctagaaaatgaaacttctgttacgttttatgttttagaatacttacatatgttactactcagaatccataacattataatttatactagcattatttcctggtaatacaaatctttgtagaaaaaatctatcagaaaacaggcagtacatctttcccactgcataccctctttaccagactcttaaaatatctcatattgctttacccatagttttatgaatagggcttagattacactgagttttgctgctgctttgtggtgacttggtactaaattcagctaagctggaaccacattccccagagttctctttcttgtatggttctgtatggccatgagagacattctgtgtgaaatccagaaggaagaagtaaagaagtcatactttttatgctctgaaacttggtacagagttactgtcgtagtctgttttgtgctgctatcacagaatatctgaaaccgggtaatttataatgaatagaaatttattggcttatagttctggaggctgggaagcccaatattaaggtgctggcatctgtcaggtgacttcttactgtgttatcacatggtgaaagagtgcaagggcaaggagaaggtgagagaaaaagaaagagagagagacagggagtgggagagagagagaggaacctgtccttttaaaatggcaccaatcccacccatgagggtggagccatcatggcctaatcacctcttaattgtcccacctcttaatactgttataatggcaaaaaaatttccatatgaattttggaggggaaaacaaaccatagcaggcactatgcaccttgtccacttgcacacattattgctaatctgctgcttaactacttggtgtaccaggcttgcagtaattctaattcactaaatctcctccttcagcttctctgagtcctgggccaagtgtgtgtgcaggagacacactgcaggagatagtgccagtttctcctgcaggtcacccgcagcatcaaggttggacatggtaagacacagaagagggttccagtttgtcctcaatggtcccattggtcctcatgagttctggtttgtccctactctcctatacatctagctttccctcttaacagctgatctgacaaacctatagtaacttcaggctcagcactagacacagaaccaatagtcttcatagattgcatcaccagctctcacatttgtgtaaggtctagcccttaggataataaatctcttattctgtataatgtgtggccattttgctacttcgataaaaccatggctgctgtaagtatctgtgtacaacactgtcttgttgcctttgcattgtgaacggtatgttaagcctcatggtatccactgtcttaggtagaaggagaagactggtgattggtggtagaagaaaaggaagagatgcttagaaaggtaaaaagcttatgtaggaatctctcaggaaatcctcaatgctaaaaatgtctgtgctagttatcatttgttgcttctcatctccaaatccagctttctttgtcctgttttgtggtcttggagctggaccatgtaaacatttctcctttgtcaatagagggtgctggagggacactgtaggaagaagggaactcagcttgactctcgtggcttgactgctgtgctctcccctgctagctcttgtggtgggtaggcgccagcagcataggacatctagtgactcaccctattaagttttagtggcagtatttgggggacttttcagtgggtttgccaccactccagcaggcagcttcccagtgaatccctctggcacctcggaggacacctcagtgatacctgatgagtcttgcagatgccccaatgggtggtataccaggaggctggacgaaggttcagaagtttggtttcctgcttgccagccctggcctgcaacatctcagggaaattctctgcaattcagtgggctgcagactttctttgaaaggggtctgaatcagccctgggtgaggggagggccctcttccaaatttgttccttctttggtactctttccttgggaacagccttaggggtagtggctgttcttcgtatgtgctattcctgtgttcagtacggttttctttacccttagtaggtaatcctctgctactagttaataatcatttatattaaactttccctgtgtgaattactgtgtgctttctgtctcctaactagacactgataaaatgccttttgctcttagtagctatttaaaagaaaaataataaaacttaattttattagttcaagatttttccttagaagggacataaattacttttaatgtgattatataaataaagggattgcccaaatgtgcagtttcaagagactatttgctttctttggccacctgggaagggtatttctcaaatcgggctctacagacccttctgagtagaccctgagtcactatggctatgaaacaaactaccgcaaacacaatggttaaaacaaccatcatgtatcactctcacgtatctgacagaaggactctagagttgcatgacaaatggtgaagacacaggacaggatgaagaactggggcccaaaatgtactctaccacagggtccaagggcattaaaaatgggtctgtgaattcaaatggtatttttaaagttttacttttccatttggtgaggaaataaatagtgtaatcatagtcataggacttcagtgcctgcatttgcattcatggttcagttcttgccaagggatcgccttaagtgagtgtgcagaggaaatgttaggcagtgttccctcatttctaaagcttaaccagtaaagtaaaaagagggtatgtatatgactgtggggtatgtgagagctctctgtgccttgactcccctgaagagccaacttagagaacctggctgtgggaaccccaagggctgagctggcctccaatcaggagagacaggagaacagaaatcagtccaggaggttactggagaagctgggaaccacagagtcatacagagataggaaacagccaactcccacagttttcaatagcagatttgctgcagaaaactggtcggccatgaacctggaaccctccagagaaggtaccatcaaattttgatctctgtttaacactgatttctgctataacccatcctgttatggcaatgtctgtcttgagaaaaggctgagctgatatagtacagaggagggttcaacttgctgcaaattatttgaagcaggcatagcctaagtccaggcctatgccagagaaagatgacatattcactgataatcgcctaatctcctgagcacataggagggcaagattaggatagttagagttctactcaaactgtgcaagaatgtccttgaagtgtggccaagtgacaaacagtgcaataactatgaatgtttttacagattttatgagacattatcataccctagcagtgactgtgcatgtttatatgtttttaataaattttttattttataatagttttaggctaaggcgggtggatcacttgaggtcaggagttcgagaccagcctggccaacatggtgaaaaccctgtctctactaaaaaaaaaaaatacaaaaattagccaggtgtggcaggtacctgtaatcccagctacttgagaggctgagacaggagaattgcttgaacctggaaggcggaggttgcagtgagccaagactgcgcaattgcactccagcctgggcaacaagagcgaaactccatctcaaaaaaaaaaacaaatagttttagacaaaatttgcaaagacaggagagagagtaatcatataccccacaaatagtttttcctacttattaacatcttacattattttggtatactagtcataataaactgatgttgacacactattattaactaaagtccatattttatctaggcttccttagtgtgtgtgtgtgtgtgtgtgtgtgtgtgtgcgtgcatgtgtgttttactgtaatgtcctttttttctgatccaggatcccattgaggatatgcattccatttagttgtcgtattttcttaggcttctcttagctggacagtttctctttattagactttccttgtttttgataaccttgacagttttgaggagttttggttacgtattttgtagactgtcatttaattgggatttttctgatgattgtattttaattattgttgccatatttacaattgctagttccttcaaacatcccaccaaaagtgtcagaattagaaagtgtgcctcaaacacagagtttgaaaaccactggtctacatcaaagcagactgtaaatatgcataagtcaaggttattgagatgcttagtctaccatttgaacttcagtttcaaaaagccaggtaggcttttagacctttcccacagtggctgcatagcaatctcaatttgtactgtctgcatgtcacccaaaatggccaggccatcggccacccgcctcatttggcagccctgacttagaagagaagacaatagctctttgcccaaaggtcgctttgtagtgactcaccttgaaggaaaaaggaaggtaaattacacataatggccttctaagttgtcccacagttttcaacagaaaatactcttaaagtataaccagaaacaagaaaccttcaatgcaatattttcctttttgttttccaaataagtaaagtccaaattaggaaacagaagcaagtatatcctattaatttgtaatgtctagaaccatagaagtagtctagttatggaagagctgttgtgcatcttctagtaattaaacctgtgcaagttacagccttaatcaaaacaccttttaggagtctactctggtctccatgagagtgaagtccctaagtgctggcaactttggaacactaaacattactggcaatgctggaaatggtacaatatttaccgcaataaagaagacaatacccgatatgtcccctggagcacaaaattaaaatatttgtattggaatacagacaggccgaaatatgtattccatgaaccaaaaagtactcactgtgttggccagctctagatagcttcctcctacagagttgccaatgtgcggggactgtgtgagcagtttgtggagagcagcctgctgatgcaaagagcttccgccatactcgagcagcttctggagggctgactggctctgcacatccgggctctggaggtccctggcaccagagtcgtattcccagctctccctggctgctgataaggcacctaagtccgagagaagcagagaaaatgaaaagacatttccttcattagcctgtgggtggccaataggcaatgatttggaacctcctaagccttccatgtgccagcatctcagaacacatgtgatgcccaggctgcatgctaagcgctttctctttcaaactgacacatggggagcctggagataaaagcaatttcaggcaaagcattcaaaaacaactgtcccatgaatatgtgctccctaaacagaaatgcttagcaaaaaaagcactggagagccaagtaaagggaatccagatcagagtcacatctgtgatttgcacagggctactacattagccttagcactggtcattctttctcccaactgaggaaaaaggaagcaagaagaatgacaggaagttaacatatggcactttatcatgactctctttttctccttccttccttcctttccttccttccttccttcctctctgtctctctttctttctctgtttctttctttctttctttttttgaggcagggtcttgttctgtcatccaggtgggagtgcagtgttgtgatcacggctcattgtagcctcaacctcctgggtcaagtgatcctcctgcctcattaaaaaaaattttttttgtagacctcatttctatactatgttgcccaggctggtcttgaactcctgggttcaagaaatcctcctgccttggcctcccaaaatgctaggattacaggtgtgagccactgcaaccgacagtatcatgactttctactgttgatgtactcttacctgaaggaagctagactgtattttccagttagggatagcaatgaagctgagttctgggcaatagaatatgaacagaaatgataagcatcactgctggaccttgcttataaagccccacagtgtgtgattctccatgccctttgccttctggcctggttcagatgggaatggtacccttggaaaccatgtggtacagatggtggagccacaaggtagatggaagatgcctggattccagaatcatcacttgcagaagaggtgtctgctcatcctaagtaccctattttgccctaacatgattagaaaagaaaacttttttttacatgttttttatttcataggtttttggggaacaggtggtgtttggttacatgaataagttctttagtggtgatttctaagactttggtgcacccatcacccgaacagtgtacgctgtgcccaatgtgtagtcttttatccctcacccccccactcacactttcccccaagtccccaaagtccactgtgtcactcttatgcctttgagtcatcatagcttagctcccacttatgagtgagaacatatgatgtttggttttccattcctgagttacttcacttagaataatggtctccaattccatccaggttgctgtgaatgccattattttgttcctttttatggctgaatagtatttcatgatgtatatataccacattttctttatccagttattgattgatgggcatttggtctggttccatatttttgcaatagcgaattgtgctggtataaacatgtatgtgcaagtatctttttcatataatgacacttccctctgggtagataaccaggagtgggattgctggatcaagtggtagatctacttttagttctttaaggaacttccattgtttttgattcactacatacttttggtttgttgattagagcagctagtattaccttaattattacagacgattagaaggtaataaaacatgctaatagttataatacaaatgggaaagtgcaatgaaaaagtagaactaaaggaaggatatctaactcagtccatctggagatgaatggggaatgttcagggaaagcttcctggaggagaaagcctgatgcttgagttgtcactctttccagaaaaaaatagatttgaggtaaacctgtttccttgtgttgttcacttcagaatggaaatgtcttgtgggtgcatctggttggtgaagcctaggctgcatgcctctagctgcaaggaaagctgggtaaatgtgttttctggttttactttagagaggtagtattgataaggtgagacatttcctaaacagaagggtgctcaaaaggcctaggcagccacaacacaaacaacggtctatgcacaggacgtgtactgggtcctggggatatagcagtaagcatgagaaattatagtccctgcctgcaaagatctcattctggtaggtctttaatacatggcttttaatgacaaaaaaaaggacacaaaatgatccagtttgtactatgaaatgagaacatatacagattactctataatttacttgagaataattacatacagcaaactgcagtttgtgtacagtgagttctgatatgaatgtccagtctcctcttatcaggtattgatgaatttaatcaatgtgaataggaaaactgtcttcagatggtttccccttactgttctggctctactgatcctctccagtcggtctaacccaacattctttttatacagtgcctttatagctgggatgcatcaactgttttgtatcaaagcaggcaattctgtcactatatttgcaattgctccaagtttactttaatgttaaagtctattgattgtattgcaaggcaggttcttctttccttaacatagactgccaaatgcctgctctccctccccttgttcctctgaacactgtctgttatctgcctaaatgcctcagggcctctgttctggctccagcaacatgtggcaagaagactaacagaggtcagcgttgaaaagtggagtccccacattggactgagtcacagacggacttatatctcatacataagacaaacagacagagggctgggccttgccttatatgttcaccacagtactctcagcaccgtgcacatggcctgtgacatagatagcatttaataaacatttattgaatggattgctgaattatccatggttgtagtaccctacagtttcactttttaacctagaaatacaacatgggaattaagtcaaaataaattatacatttaaactttttctttatgcaaacatgaagcctcattctcaaacaggaaaatataacagttctgaggtggagcaagatggctgaatagaagcctccaccaatcatgcccctgtgcaggaataccacattttaacaactacctacacataaaaaagcaccatcataagaactaaccatcaggtaagcaatcacagtacctggttttgacttcctctcactgaaagaggcactcaagaggtaggaaagaccgtcttgaatcaccaacaccactcctcccgtactctccagcagtggttatgtaccatggagaatctgtgcttatgggagagggaaagcacagcaagtgggggacttggcattgaactcagtgctgccctgtcacagcagggagccaaactgtgaagacctcagtcattgcccacccatggagggagcatttggatcagccctagccagaggggaattgcccatcccagcagtcggaacttgagtttctcagcaagccttgccaccgtgggctaaagtgctctggggttctaggtaaacttgaaaggcagtctaggacacaaagactgcaattcttcctaggcagatcctagtgctgggctgggcttaggtggactagggcagcatatgacctgtgagacatcacccgggttggctaagagagggcttgcattaccccacctcagtaaccccaggcatcacagcttgcagcaaagaaagtgacttgttccttctgcttgaggagaggagagagaagagtaaagaggatttggttttgcatcttggaaaccagctcagccataacaggacagggcaccaggcagagtcatgaggccccccattctaaggtctagcttccagacatttgtagacataccctgggccagaaaggaaccttctgccttgaaggaaaagacccatttctggcaggattcatcacctgctgactaaagagtcattgggccccgaataatcagtagtagtagccaggctgtacttgccgtgggccttaggtgagactcagagctatgctggtttcaggtgagtcctagaacattcctacctgtggtgtctacagtgaaagactccttatatttgagaaaagcagagaggaaagtaaagaggactctgtcttgcaccgcaggtaccagctcagccacagtggggtagagcaacaagcaggctcttggacagcatttctggacctgccccgggccagaagggagcccactgccctgaaagtgagtcccaggcctcacagcattcaccaaaagctgactgaagagcctttgcactttaagggaacattgacaatggcctggcagaactcaccatgggtcagtggtggtggccactgagagaggctcctctgcctatggaaaggggaagaaagagcaggaagaactttgtcttgtggtttgagggccagcatagccatattagaatagagtaccaggtagattttacgttttttttttactccaatccctggctcccagacagcatttctgacctgcccagagcctgggggagctcactgccctgcaggtgagcacataatcctggctggtttcccaaactgctgactataaagccctagggccttgagtgaacataggcagtagccacatagtggttacagtgggccttgggtgagatccagtgctgtgcagacttcaggtccgactcagtgtagtcctagtggtgggaaccacaggggtggttgcatcaccacactcccagttctatgtgtctcagcacagggaaagagaggcttcgtatgtttgggagaaagtaagggaaaagaacaagagtctctgcctcgtaatctggagaattcttccagatcttatccaagaccacaaaggtggtacctctaagagtctgaaaaatacacagtattattgggcttggtgcccaagtccctttggatactggaaggccttcccaagaaggacaggcacagacaagcccagactgtgaagactacaataaatacctaactcttcaatgcccagacactgaataacatctacaagcattaacaccatccaggaaaacatgacttcacccaaagaactaaataagccatcagggactaatcctggagaaacagagatatatgaccttccagacagagaattcaaaataactgttttgaggaaactcaaagaaattcaaggtaacacagagaaggaatttagaattctatcagataaagttaacaaagagtctgaaataattaaaaggaatcaagcagaaattctagagttaaaaaatgcaattgacctactgaagaatgtatcaaacagatctctctccctgtgctgagccacctggagcttggagaggggtgacacaagcacagtcagaggagacaaaagaaaaaagaataaaaaaaatgaagcacgcctacaagatctagaaaatagcctcaaaagggtaaatctaagaggtattggccttaaagaggagatagagacagagataggggtagaaagtttattgaaaggaggtggggcacagtggcttatgcctgtaatcccagcactttgggaggccgaggtaggtggatcacctgaggtcagaagttcaagaccagcctggacaacatggtgaaaccccatctctactaaaaatacaaaaaaaattagccaggcgtagtggtgggcacctgtaatcccagctacttgggaggctgagcaggagaattgcttgaacctgggaggtggaagtcgcagcgagccaagatcatgccattgtactccagcctgggcaacaagagtgaaactctgtctaaaaaaacaaacaaacaacaacaacaacaacaacaaaaaaaacaacaaaaagtttattgaaagggataatatcagagaacttctcaaacctagagaaagatatcaacattcaagtataagaaggttatagaacaccaagcagatttaacccaaagaagactacctcaaggcatctaataatcaaactcccaaaggtcaaggataaagaaagtatcataaaagcagcaagagaaaggaaacaaataacatacaatggagttccaatatgtctggaagcagacttctcagtgtaaaccttacaggccaggagagagtggcatgacatatttaaagtgctgaaggaaaaaaaaaaaaaacccttttacactagaatagtatatctggtgaaaatatccttcaaacatgaaggagaaataaagaccttcacagacaaacagaatctgagggatttcatcaacatcagacctgtcctataagaaatgctaaaggatattctttaatctgaaagaaaaggatattaatgagcaacaagtgctcatctgaagatataaaactcactttcaatagtaagcacacaggaaaagacagaatattataatactgcaattgtgatatgtaaactactcttataagtagaaagactaaatgatgaaccaataaaaaataatgactacaacaactttttaagacataaacagtaaaatgagacagagagaaagaacaaaaagttaaaaactggggggaagatgttaaagtgtggaatttttattagttttcttttcgtgtttttttgtttgtttatgcaatcagtgttgttatcagttaaaaataatgggttatgtatacatatgtaacaaacctgcacattgtgcacatgtaccctaaaacttaaagtataataaaacaaaacaaaagtaatgggttgtattacttgcaagccttgcggtaacatcaaatcaaaaaacatacactgaatacacaaaaaataaaaagcaagaaattaaaccacaccaccagagaaaattaccttcaccaaaaggaagacagaaaggaagaaaaacaggaagagaaggccacaaaataatcagaaaacaaataacaaaatggcaagagtaagtccttacttaccaataacaacattaaatgtaaatgaactaaactctataatgaaaagacagagtgcctaaatggataaaaaagcaagaccaaatgaccaaatgacctgttgcctacaagaaacacgctttacctataaagatacacacagactgaataaagggatgaaagaagatattccatgccaatggaagccaaatagtagctctacttgtatcagacaaaatagatttcaagaaaaaactataaaaagagacaaataagctcattatataatgataaaggggtcaattcagcaagaggatataacaattgtaattatgcacccaacaatgaagcacccagatatataaatattattagagctaaagagagagagagatctcaatgccataattgcttgagactttaacaccccattttcagtgttggacagatcttccagatagaaaatcagcaaagaaacattggacttaatctgcataatagaacaaatggacctaacagatatttacagaacatttcttcaaggtctgtaggatacacattcttctcctcagcacacagatcattctcaaggatagaatatattttaggtcacaaagcaaaagtattaaaacattcaaaaaactgaaataatatcaagcatcttctttgaccacaaaggaatacaactggaaatcaataacaagaggaattttgaaaatcgtacaaacacatggaaattaaacaatatgctcctaaataaccagtgggtcaatgaagaaaataagaaagaaatggataaatttctcaaaacaaatgataatggacatgcaacattccaaaatctatgggatacagtgaaagcagtactgagggaagtttatacctaccaatgcttacatcaaaaagtagaaaaacaaataaacaacctaatggtgcatctaaagaactagaaaagtaagagcaaatcaaacccaaaattagtaggaaaaaataattataaagatcagagcagaaataaataaaattgaaataaacgaaacaatacaaaggatcaataaagcagaaagttgggtttttgaaaagataaataaaattgacaaacctttagccagactaagaataaaaaaagagaagactcaaagaaatgatatcagaggtgaaaaaggaaacattacaactgatactgcagaaattcaaagggtcattaggtggctactatgagcaactatgccaataacttggaaaacctagaggaaatggataaattcctagacacatacaacttaccaagattgaaccatgaagcaatccagaacctgaacagaccaataaaaaatcatgagcgtgaagccataatgaaagtcttccagtaaagaaatgctgggacccaatggcttcactgctgaattctaccaaacatttaaagaactaatgccaatcctacccaaagtgttcaaaaaaatagaggaggatagaacacttccatactcattctatgaggccagtattatcccgataccaaaaccagaaaaagacacatcaaaaaaacctacaggccaatatccctgatgaacactgatgcaaaaatcctcaacaaaatactagcaaattgaattcaacaacacatgataaacttcattcatcatgacaaagtgggatttatcctgtggaagcaaggatggttcaacatatacaaatcaatcaatgtgatactcatatcaactgaatgaagcacaaaaaccatatgatcacttcaattgatgccaaaaggtatttggtaaaattcaatatcccttcatgataaaaatcctcaaaaaactgagtatagaagggatatacctaaacataataaaagctaaatgtggcagacccacagctagtatcatactaaatggggaaaaattgaaagtcttttctcaaaaatctggaacatgacaaggatgcccagtttcaccactgttattcagcatagtactggaagtcctagctacagcaatcagataagagaaagatataaagggcatccaaactggaaaagaagtcaaattatcctagtttacataggatattatcttatatttggaaaaaactaaagactccaccaaaaagttattagaactgatagacaaattcagtaaagttgcaggatacaaaatcaacatacaaaaatcagtagcatttctatatgccaatagtgaacaatctgaataaaaatttaaaaagtaatcccaagtataatagttacaaataaaattaaatatctagaaagaaatttaactgaagaagtaaaagatatctataatgaaaactataaaacactgatgaaagaaattgaagagaacccccccaaaatggaaagataatccatgttcatggactggaagaaccaatattgttaaactgtccatactacccaaagcaatctacagattcaatgcaatccctttcaaaatactaatgacattcctcacagaaatagaaaaaacaatcctaaaacatacgtgaaaccacaaaagacccagaacagccaaagctatcctgaggagcaaagagaacaaaactggaggaatcacaatacctgacttccaattacactacagagctaagtagccaaatggcatgctactgacataaaaatagacatataggccagtggaacagaatagagaacgcagaaacaagtccacacacttacagtgaattcatttttgacaaaggtgtcaagaacatacattaaggaagagagtctcttcaataaattgtgttgggaaaactggtatcttattcagaagaataaaactagacccctatctctcaccatatacaaaaatcaaaatagattaaagagttaaatctaagatttcaaactatgaaactataacaagaaaactttgaggaaactctccagaacattggtctgggcaaaaatttcttgagtaataccccacaagcacaggcaacaaaagcaaaactggacaaatgaggttacatcaagttaaagagcttctgcacagcaaagaaacaatcaacaaagtgaagagacaacccacagaatggagaaaatatttgcaaactacccatttgacaagagaatagtaaccagaatctataaggacctcaaacaaatctaaagggaaaaaaatccaataatctgattttaaaaatgggcaaaaaatatgaatagagatttcttaaaagaagacataaatagctaacaggcctatgaaaaggtgctcaacatcattgattatcagagcaatgcaaatcaaaactacaatgagatatcatctcatcccagttaaagtggattttatccaaaagacaggcaataataaacactagtggggatatagagaaaagggaaccctcatacactgttggtgggaatgtaaatttgtacaaccactatggagaaccatttggaggtttttcaaaaacctaaaaatagaacaatcataggatcctgcagtcccactgctggatatatacccaaaagaaaggaaatcagtatattgaaaggatatctacactcccatgttcattgcagcactattcacaataaccaaggtttacaagcaacttatgtgtttatcaatagatgaatggatgaagagaacatggtacataaatacaatgtacattttttattcagccataaaaaagaatgagatcctgttatttgcaacaacatggatggaactggaagtcattatgttaaatgaaataagccaggcacagaaagacaaatttcacatgttctcacttatttgtaggagctaaaaattaaaacaattggaactcatggagatagaggataaggatggttaccagaagctggaaagggtagtgggggaagtagaggggaagtggggatggttaatgtgtacaaaaaaatagttagaaagaatgaataagacctactgtttgctagcagaacagggggactgtactcaataatttaattgtgcatttaaaaatgatgaagagagtataactggattgtttgcgacacaaaggataaatgcttgaggggatggataccccttttaccatgatgtgattattatgtactgcatgcctgtatcaaagtatctcatgtaccccataaatatatatacctaaatgtacccacaatattttttaaaaatacaactgttctggggtaagacagtcaaaggaagcttcatttgaaatttattatgccatgttaacagacctaaacccagtttctggcagaatcacttaattaggttagccaagctctatattaatcagcaagatttaaagaccttcatattattaccataacaatttttgctgaagtgatgctgaaaatctcagatcttctgctatggagccaaaatcagtcataatagcttccacataaatggaccatataaagggaagtggacttttaaaaaaactatagtagactgttcccattactctcttttaatctgtcttcatgttaaattttttctcaataaaaaccaacattcatgagacaaaaactagtcatttaattgtgatgatgtcactgaaaaactttgaaaatgcaggtctggtaaccatcttccttttgccctttgaagcatgatggtacctgatggctcatatgcagcctcttgacagcctgtgttcacctccttgtgaacctcaaattggttcctgtgctccaggcaaaaataaataaataaataaaaggcttactatcttcccatattttttcctcttccctctctttctcctgtcttcccatcctttctgcttgcctgccctccaacagattttgagaactcactaagtaatagattctacaagaaatactagaaatattaattcaaagctaagacaaaaatctttgctgtaaagagctcaccatctggtggaagggtagaaagttctatgacttttctgaagcattcaaattatttccttttttttccccctgcatcagcacggggggcagtgggagaaagggttcatgaatgcactctctcaaatttcacttttatcagatctatagtaagagatgaggaaggggctcctttttcttctcaacatttgaatcggtatttgtgttaacatgaatgttctttccttaatgttcaagtgattcttcgtcagaagaaactttgtaaatacatcatcaggttacaaccctcaactcctgcttaatattgagtactgtaagtgaaagaaaaattaagaatgtaattttaatatgatttgggttttgtctgacatctgcacgttaggtcaatggtctcatgagccctcttgtaacatggcttttcatatgcctgttccccacagggttatggctctgctttcttctccttgacatggacaccactgtgtcaatgtctcctggctcacgaggttccagccaggctgaccttctgtatcttctgacatgatgggtgctttcaaggcagaggcctttcacgtgctgtttttgtgctggaaatgctgctcctcacattctttgctgggctcaggtctcagacttactgagttctcgaacaaatgacaaggccattgttaggagcactcctagcactctctccactctcaggccagacacaggagggtctgggggttcatgagcactagctttggctttgggctttctgcatttgagtcccagccatgtccttagcaacagtcatgagaaggtaatgagaaggatgacagtgtttatcactgtcattttatgtcattttatttgtttatgaaaaaaataaagattatacatttaaacctctctctttatggtctctcaatactacttaaatgtcagttccctttttgttagcaggcttacacacataaattgcctactaataagcaaacataagtggtcccacagatatacgtaaacatttaaaccaatatagaattgataacctgtgaaagcctccttaaatattcaatctggtctagagggtcacccgtaggattctaaacattgatcagtctacacatggttaggctccctataccagtctatactggtcagttagcaaagtgcatgaggcactttagacatgttgtgatatttttatttttagctgaccgtatgaagatagatacctatcaactgacatagccacatgcacaggactgttttctacaatagctagagtggacaatggagaattctttaatcatttttcttttcaggaatggtatgaagacaactgacaaaggtcacttctaggaactaatttcttcaaaagcttaccactgttccattgtccactgagagtcaatatcagcaatttgccaatataattctattgattaggacaagctagattatgctgcagtaatgaaaagaccccttccctccccaccaaatctcagtggcttaaacataaaagacttatttctctgcacactgccatccaagggtcagcaaggcctctgctcattgtaatcactcagcactatctgtcactgtctagcagacagagagtattctagagggtctgacactggcaattgaatgctctgttgcacaagtgactcacatggctcataacccactggccagatatagtcatatagcccaaccctaccctgaagggatcccagtcacgtaatcttactaagtgtccagaaggggcaaaactggaaacatctggtgaattacaagaacagagtttaatattgattggatttttatattatctcaaatatgataacatctgagggattcttttcctttttctttttttttttctgagacagagtcttgctctgtcggacaggctggagtgcagtggcacgatctcggctcactgcaatctccacctcctgggatcaagcgattgtcctgtttcagcctccggagtacctgggattacaggcatgcaccaccacacccagctaatttttgtatttttaggagagacggggtttcaccatgttgaccaggctggtcttgaactcctgacctcaggtgatctgcccgcctcggcctcccaaatgctgggattacaggcatgagccaccgtgcccggcccctttttcttttagactttttattgtactatgatcaaccatataccctgtattattattattattattattattcaacatccagaattaatggccttattaagaccttattcttggcctgttaatgcaagaatgtggcaatagcactttgttcttacgtagaaaaatatttagaaaaaaagatagtctttttttctgtctcaatattcttattgagaaatctctgtacatgtatatatgtatgtatacacatatatatgatatagatatgtgtatgcagatgcatatattccagcttttatattaatgactgaagaaggaaatactatgttaaaaaatagtggcataagaaaaaaatcctaattcgcattttgcctgtattttgacaatcaaaaaagaactataaaaataaatgctgaccaacctcaccttagttaaagcatccagagaaagatcaggtgggttggtcaaaggaagtgcaagacatgccaacctcaaagggcaccaacaaggaccttttaccaaagctagaggatactcttgggtttgggaatttgccttctttcaacattatttctattaccttttaaaactgtaatttcatctcacccctattgtgcatttcataggtcatctcctaaagagctaaaacaaagagtcaaacagagtactaataggtaggcagggctcactcataccagcactctcttcttatgctggttttgcttaaaggctcctcaatgaagagataaccactatattagtctgcttgggctgtcataacaaaataccaaaacttatgtggctgatgcaacagaaacatattttcttgcagttctggaggctagaagtccaaaatggggtgccagcatggtagggttctggtggggttctggcgagggctgtattcctggcttgtaagcagctacctcttgctgtgtcctcacatggtaagaagagagggcaaggtcaagctctgcagtgtctctacttataagggccctaatcccatcataaggctccaccccacgatctcatctaactttaattaccttccaaaggccccatctccaaatgccatcacactgggggttagggtttccacatacaaatttgggcaccgggacacaagcattcagttcataacagccactaagcagtttctctccaggccagtaaggaagctgcatggcatctggcatccctgtaagtagacatccaaagcactccctgtgcccagaggtggtctctgcacaaacagaagcaaaggaggccatcatatctgccactacaacaactattgggtcctttgaagtgacaggcaaggtgtattttttttttttttttagagacagggtcttgttctgtcacccaggctagaatgcagtggtacaatcatagctcactgtagcatccaactcctgagctcgagtccaggagtgatcctcctgcctcagcctctcgagtagcctggctaagttttttatagagactgggtctcactatgttgtcccagttggtcttgaactcctggcttcaggtgatcctcgtgcctcgacctcccaaagtactaggagatatatatagcatttatatatgcatttatatataatatgccagcaaaatatatattctaatagataatattatatattttatataaatatatatatcaagttttaaaatatatatatatataatttttaactggaatatttagtgtttgaaggtagcagaccacaaattctaaatgtttctttcacttatctaaatagcacaggaaacaagtggcaatttgacatatttgtaaaacataccactgggaaaatcctgctctcagagagaatgctagaacagaaaaacctgccggacactgagacatttgccctgctgggtacttggcagctacaagttagtactttaatcccatcttcaaagtgccacccaggtttggcttcaaggcctacaattacagagcttatttaccaaaggcactatgcaaccttcccagcaggccaagactcctgtgagaatgagacaagccaaagcatctggaacacctaaaatttaccttaaggttggtaacaattctgacagctaacagctattcaaagtccaccacactaaggaccagatactgtactaagcatttcacatatattatctttggtcctaccaatagcctatgaattgccacaacatttttcccatttttagaagaggacattttctctctttcagcttaatttcatagacattgctcatttgcatagaatagtggttaagaactggggttttgtagtcatgctgcttagtatcaggtttaaagacaccataaccagctatgtgacatcaagcaagttatttagcctcagtttcttaatgtttaaaatagggataataaagtgtactttcatgaggttgttgtgagaattaaagttaaaatatgtacagcatttaagacaatccctggcatatggtaaactgatcaacaaatgttagccattatctgatcacacttcataattacttatttggaatccattttagataatagaaagcaaatatatagggaaaatgtacactctcagcttctgaaaggtaacaattatgattaccaatttaaaaatacaaaacaattgacacccaaccagtgcctaaaattttaaacaatagttttgttacagtaggtagtcaggcatgagcagggcagaagagggccccccacctaccaggaatgtccggtgaccatcaggtgatggtcaggcagttgttaaaactgtctctttaaaataataattggtcacagcaagtaccagggaaaggcagtctcccaatagacagaaaaaacctgaaactgcagatcagcagcttcccgataagatctcaggagttggggcaagtgggctcaaccatgtgcactaaggcaaaatggtggagcttaactcatatatgaccttctaggaacactactggtaacggaagaacgcctgaagtgagcatgtgtacaacgtcagtaaatacactatgcttgcagcccctcccaagtgctagcaggccactgagcatgtggatagcccaaccaaagggaagactcaggggagaagtaatgcaaccacagaagcatgccattgtttaagacccaaagtcagaggtcaaactgcacacttgaatctctcaagttgcccactggccttcttccaagtgcactttacttccttttgttcctgccctaaaattttttaaaaactttctaaaaaactttcattcctgctctaaaacttgcctccatttctcactctgccttatgccctttggtcaaattctttcttcttaggaggcaagaactgacattgctgcagacccatatagactcacccactgctaacagttttattccagcattattgtaaagaaaatgaaaatagccaatcatgtcagagccaaagttacatttctctgagtatggaatattccattagtaagtcagtctttggttactgggtttgacagacttaacttccctattctacttggccagctctaatcttgagaggacattggccctcccaaaacttgtggccagcaccatgaggaaatctgcacttcctggcagcagtaatgacttaaaagcagagtaggcatgatttattaattagatctgtgctctggccacccctctgttttctacctttagcttcttttccatccttcatttgagcactgggctctttcatcacaacaaaggcagatgaaaatgcagagtgtttaggggatcctgagacctgtattaacagtatcttatgatattgtctatgtttagtggccctgtatctttcagttatgtgggttctttagagtacattgcctaatttattaccctccatgtcaagaaggaaaataatcctttcaatataccagaagcagctacctttatgaatttaaagctaccacattgccacaagaagcatgggataattttaacaaattggctgccaggtgtcagctgtccctgtcacagcatatttactatttctagataatactgacatcaacagaagcagcagtaaatcgcttagtccacaacagaatcaccatgagtctttagtcatttattaatgtcaatgcttggtatgaaattcaggaacctgatccccatgagggcccctagcatcgtccactacaaattacattactaacacaggccaattgtcttaaaatctgtgcctgtggtcacaaggagaactgggtgggaatgtacagataaatagagtctatctatccttctcctaaggaaaaataaagagcaattcaaaggacatgtctactaaggggcggtaaataatattatctctcaggtagttcctttgccctttgtctgtcttcaggaagtgagcttattagtgtcttatttagaacatatatatgttacacatatcctatctagggccaatgcacggaatttcaatgtaacattgggaatatagtggaagatatattttgaaatgcaactccctctccccttcccccaccccaagactgttgacaggtgctaagaaagaaagaaatgaggaaatttttcttaccgaagcatgcttatcaacaccatcaccattagtggatatttctaatgtcccactgtgcccaagtgagttcagcaatccttgatgtctttaagcacaggcctgagaacacttaatgggagatattttagagacaactaacccaaggagcagctgcaataaacagactttaaaattctcctccagctctagcttctgttgttctgttcttcatcaagtttaatataaaaggcaaagtgtctgcccttgggcagttaataatctggttaagaaagcacagctgaggcaagcctctttaaccttttaaaaaaaacaattaaaaataatatttggcagctcattatcttggtttgtctaaactatgtatattgaaggagataagcaagaaggttgattcagggctgaagaattcaaaggagagtttggggaaggagcattaaaatgaagaggtattaaagcaaataaattgactttcacttcatagaagataaatagaatgtttggtcctttagcccctgaagcgggctggggagtaggggtaacatccatggtccatatgagtttaagatttttttctttaagatttgtctctcttggttagaaggcagagattgcattttggatcaatttatctttctcttacaaggcatattaatggaagccatgtattcagtaagcccttgctagtcactaatttttaagtgtcataaatgggagactgtgaatggggatgatgctaatctgagcctgctccctgccatgaaaagcatcacatacaacctctcgtatggcatgccaatgacattgtcatacctcttggctgaaaatcagcctaatcaaaatggaaaatgccaggggaaaaaatacaccaaggggaataaaaaaaaaaatgatttcgattccagcttcttcacaaaaaacaaaatattatcctttattcatgaaaagttgacatttttcacttaagttttcttaatgtggtggattacattgattttctaatgttaaaccaagtttgcattccagagacaaactctatatactctaaatcttgtttatatattactgattttggtttgctagtattttgtttaggatttttgcatctcttttccaaagtaaaattagcccataatttttattcctaacattgtccttgttatgtttccatcttaggttatgtgtgagtctgtctgtttttgaatgttaggtagacgtcaccagtgaagctgtctgggcctggaattttctttgtggaaagattttttaaattactgctttaatttcactcatagttatggaaccattcagactttatactccttaatgaatcagttttagtaaattatgtttttctggaaattcatctattttatctaaaattttgcaaatattgacagaaatctgttcataatcttttcttttcaaacgtgtctgcagcatctatagcagtctcctttttactcctgatattagttataataaaccctgacttggccaccttgcctgccaatgtcattgtagagttggctggatgacccaatcttgactcagttgctacctgtgcaaagcagaggcccctggatgtcctactcctgctatgtatgtatcatacttacacaggacatgcccttagctagcccagtatgtatggactcaacaagcctagatactgccagataattaacaatgtctaggggctttgcatttctcatttgggacaagacaatttgtggtcctttcttttctcctccaaacctcaaccagcagagccttcctagactccatgctttattggattgcctgtttagcagtaaaactcttctactcagcaatcaatcctggctttctaatcgtctttttttttctttgacggttattagtgccttatcttttttttacttaacattcttgccaggaagttatcaatttcataaatctttaaaaaaaaaac

SEQ ID NO: 2509 - DNA, 8760 bp, Homo sapiens
tcataggcctttggctgatttccagagcacaaatagttgaagtttccaactttgcacagctctatcattgcattttgggaagaggatttacccaacctcctcctagagtcatagctaaaagtccactctttgccttgggttttgactcgtctctctcttcttccttcattttcccctttcacacacttaagtccaacacttgctagtggctctagagcaataaaatctttcttgcacatataagataacttcagcaacagattatatagtactattgatataaaccacgcagattaacttgcggcaagtaaaagcattcagtgaactctctaaacaccgcttgccatctatccttaggcttgtggcctttcctgcaggcaaggagtggtggatatctgatgctgcctgcatgctgttacacctgtcacaactctagcacacatcactaaatgactgcaactttcttccccactaaccctagacatggtctcagaatcttcctcagacagaactccaggcagccattatatggatcagaagatgagaccttgtagccatactttcttctttttttttttttttagatggagtctcactctgtcacccaggctggagtgcagtggtgtgatctcggctgactgcaacctctgcctcctgggttcaagcgattctcctgcctactctctcctgttccctgagtagccgggattacaggcacctgccaccatgcctggctaatttttgtatttttagtagagacggggtttcaccatgttggccaggctggtctccaactcctgacctcgtgatccacccgccttggcctcccaaagtgctgggattacaggcctgagccaccacacctgaccaccttcaagtccccaaagctgaaatgtataattcatcgcactatctgctgtgcttccacatatcagtcaaggcttggggttggtttcctgaggaacatgtctttttttacttgtgcctcaagctcagctcctgtgacagtttttcttctgaacctttgcacttattcctttggtgatttcatcgattttcatgattttaaatcccatccatttattggccctttttaggtttatatatatatttttttagatcagatctctcccccaaactccaactctctacatgccatctccacttggaaatctaaaggacacctctaagtcaccatacccaaaactgaactgttcccacctggggcctcttccacctataggctttttccatcttgattgatattaatttatctgctcagatgctcagaccaaaaaaaaaatcaagttattcttaattctcttcattctctctcataccatcaggaaattctgctggttttactttaaaaatgaatcagaaccctgtgccttcttaccacggtcactgctaccatcctagtctgagaaataccatctttcacaggactattgcaactggttttactacttctaactttgatctctcatattccatactcaacatggcacccagagtgatccttaaaccctggtatactatactcagcatcgtagccagaaagatcattttgaaaaatgaagctgatcatatcagttttctactcaaaacattctggtggcttcccattttgcttagggaaaaagccaaaggcttttcagtgacttacaatactcttcatagtctgtcttgccaccttcttcaattcactcatctttcactacactgcctcttactcctttccagccttgctggcatccttaatgcttccggaaaacatgatactggctttttggagcctttgcattggctattttcttttcctgaaatcctctttcttcaaatatccaagtgactaattctctcacttccttcaagtctttgctcagatatcaccttctcaatgacgcccaccctgtatttataattgcaaaccctatccttcccatctgtgtgtccccactgcccgcctacctctctcttcttccacatccctctcactcattcccacatttctgttcttttcacagcatattactttctactatatgatttacttatttcctatccttaatgtttgtcatctgtctcctccttctctagaacgtaactcaaaatgggtggggacttttgttcagtgacatatcatttcacagtttctagaaatgtgcctggcatgtaatagacattcaaaaaacatctgttgaacgaacaagtcagcagtggttctatggttctgatatagttttagaaaacatgcaccaaatgtgagaacactttccaaagaaatgtcaggaggagcataggtaaaagaaatgtcaatagactccatgaaaaagaagagtccatggcaaaaagaaaaaaagaaaaaaattgattgggaaatgatggatataatatacttatcttggtcaatcatggggtacattagcatagtaaaagttatgagaagtcctacaggaaaaaaatgggcttaattttattatttaaaaaaagaattcaacacaagctcaaacttcaaaaaaaagatctctatattacattgtataaataaaataagcagcagttttgcgtgtgggctctggagatagactactagggtttatatcttggcttgccatttacaagagttatttgatatctctaagcctctgctcttttatctgtaaaataaggtagtatgtatattacaggtttggggttagaattaagataatataagtaaagagggcctaatacatagtaagaactcccacaattttacaaattaaacaatgatataaatgcctgtgatctgccagttattatccttgattctggggatacagattagaaatcggtccctggtctcacagaatttatgttctgtaggcagaagacagactagaaacgcataaaccaatagatgaacattttctgatagtggcactattatgaagaaaataaatcagggttatgtgatagaaagagtggaatggagggccgctttagattgaatagtccagaaggattttcagaggagtggttgcttatactgagagctggtcagtgaggatccagtcaagcaagggtctctctggagggacagcagcacaggcagaaggaacaacaaggacagatgtgtcaagggaggaataagcttggcttgctcaggattagataaaaagtccatgtggctggtcatgtggagtgctggagaaaaatagcattttttgtagctctaaataacactaacccctctgggtctttatttgtgggatgacttttcaatttataattctttcttgggggaaagaagagaggccctggagggattgtggcaatggcccagtggtctggatgggaagagagaggcaatgatcacagttctacaattcagggagaattgactagcctgttttgaacaggcttcccaggttaaggtggtaatcttttctctccaccattcacaaaaagggcagtggggttaggtggacatgaagtgtcaactcagaggataagggaatatgaattaaaaatgcagaagaaaaagcttgtacctgggactcattgacattgtggtttctcttgaaccctgatgctctcattcttgttgaagcctaagctcatttctctttgtcgatattagaattttatgtctaaaatttcttttttatgtattctcattccacctttctctttttggaatgcagagactagtctcttggaaatagctaaacatccaggagaatgcttagcaaataccacatggtattacttttaacttgcaaaagcttaattgctcaccatattataataaagatcccctcacgtgtccagtgaatgtaaattctcactggtgttccagctagttgcctgaatattttgtttgctattgtgccaaagataattttttttttagtgctcttctatactctatagttctatactctatacttctatagttgagctcttctatgctcaactatagttgaaaggaggagaaagtgatatctctgtaacgcaagccagaaccttccgcaataatacattggcaagtggtaatgtgatgaaaatgttttaggtttaagatgtttcccatcttagtgtttctgagtgcagatccaatctgcttgttattcttctgctacacaatgggaaatggaggtaagaagattgctgacctccctgcagctttgagacaaaatttcttgactgctagctcacaataggccttcttggaactgtccggaaatagcaccctctctcaataatctcttctttctaaatgggcagtgctgttttgatcaacttaaccccagtcaagggtaccctatagcaccaattcaaagattcaagggttgactgtttgcttatcgagatttactcagatgtcatcttccttccttcttggcttttgaggcatttcattattcctagcaactctagtcgagggtaaacaagaggcactgggaataaaattgaagtcacttttagcttcttattagcaggtatgggaaaaacctggggataagttgggtgggtggtagaaaggactgaaattgtccaaagtgaggtttgagaaatatctatgtgttctaattagccccaccttagctttttctttccataacatagtttacagtgagttgactataaatggaaaacacttcttaattctcttaacaattaataaagaagttactttcctatataatgtagaagactaatttaaaagagaattgtgtgtgagtgcacgcatggcatatgtgtggatgcatgcacatgtgtgagtgaatggattcccccaacctccagcagcatatccatgtctggtcatcagcaataatctgaaatatttcctgttattcttcctgaaacaccaggagaatttcaaactctttgaaccttccttagtatgtttgaactgaatcgtttagattggcccacccattcattcagtaactatttacaaacatcactcccttttatttgtttgttttccttaaattaggtcaaagtcatctccagggaactgggattcttgaattcaaggcctattgtatttaaggtttatcaaggtatcagcctgtccctcagctttctatcctggtttgaaaggataatttgaattaccaaagatattaaattgatatggtttggctgtgtccccacccaaatctcatcttgaatggtagttcccataatccccacatgtcgtgggagggtcccagtgggaggtaattaaatcatgggtgtggttacccctatactgctgttcttgtgatagtgagttctcaggaggtctcatggttttaaaaggagcttttcccctttttgcttggcactttttcttgtctgctgccacgtaagacaggcctttgcttctcctttgccttctgccatgactgtgaggcctccccagccatgtggaactgtgagtccactaaacttctttcctttataaattatatttcctttacaaagtgttgggtatgtctttattagcagcatgagaacagactaacaaacagatctttggacaatagattccatgaagagactgaagactctagtggcccaggtggctgaatcttctcctagctttcttcttctttatatacatcccatttgtgatcatgataaacaaggtcaaagagcagtgagaaaaggaaaactaaccacctagtatatgcagagagatatcaaatgctgaagtagatcaagaagacttccttgagcaagggggcagaggagaaagctatatctagcagagatattacagctgtggaggtatcaaagaagctttgagaatctggaaggacagcccaggaaactgtttctttacctgtaccagcactaagcatgctaaaatattcacgtgggaattatatcatatgctgttttaattaaagctggttgtattcaaccttggaattgtaactaattctgtttgctctttgagaaattcttatatatatttttaatatcctttgcttcagcagctgagatttcaagtaacagggattggaaaataatcccatgtgtttccaaccagatgaattttttggttgtaaagttatttcctaagattttttttcaattaacatattagatccttgaggaatatcctggataaacgcccaagttgctctttggttaagtagaatagcacaaagtctgtatccagggaacccaatcctctgattacagagcaggtcaaagctgcaccttaattatttctttaaaaaatcaaaagattttgaaaatgattattagggagtttttattcccattctctctcagataagtattttgtctatgacacctgattcttgagaaaaaaacaagagaaaaaaataaaacctattatcaaccacacttgggataccattaagggccacctcactttattctgaaatttctacttcagggagattaccaagcttccagagagaagcaaaatgagacccatttaagaacatgtgacctatcgtgacaaacggaagttcttttttttttttaagttttttttttcttttattattatactttaagttttagggtacatgtgcacattgtgcaggttcgttacatatgtatacatgtgccatgctggtgcactgcacccactaacttgtcatctagcattaggtgtatctcccaatgctatccctccccctccccccaccccacaacagtccccagagtgtgatgttccccttcctgtgtccatgtggtctcattgttcaattcccacctatgagtgagaacatgcggtgtttggttttttgttcttgtgatagtttactgagaatgatgatttccaatttcatccatgtcactacaaaggacatgaactcatcgttttttatggctgcatagtattccatggtgtatatgtgccacattttcttaatcaagtctatcattcttggacatttgggttggttccaagtctttgctattgtgaataatgctgcaataaatatatgtgtgcatgtgtctttatagcagcatgatttacagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcattgtggttttgatttgcatttctctgatggccagtgatgataagcattttttcatgtgttttttggctgcataaatgtcttcttttgagaagtgtctgttcatgtccttcgcccactttttgatggggttggacaaacggaagttctgaggtgtcctagagttagaagaggtagtttttcataagaaaaaaaaaaaaaaaaaaaaaaaaaaaaagaacgtgtttggtgcctggggagactttggcctcaacaaatatacctgtagcttttctaggtttagctgtagcctaaaatttaaaactaaatatttgaaagttgcatccaatttcctcaaagctgaaagagaaatcagagaccaaactctttttttttttgattgaaaggtgttgctgaggtgaacaaggactattattctaacaacatagagcacgttcttccagatcaccagctgataatgtctgtaaataaggaggggtaatctgaatgtagaatgatggagaagatagaatttgcctttggtatggaaaaaaagatgggaaattatcacttttctactgcaaagcattcatactccatcagttaccattgattaatttatgcatttatttattttccctacaattatgtattgaacttatattagtttctaggcattgaagattcaacagtaaatcagacagacttagatccagtcctcaaagtacttaaaatctatctgtgcctctcaaaattcatatgttgaaatcctaacctgcaaggtgatgatattacgaactggggcctttgagaggtgactagatcatgagggcagagccctcacaaatggaattagtgccattatgtaataggctccagatagatcctcattccttccatcatgtgaggtacagctagaaggcactgtctatgagccagaacacaggccctcaccagactccaagtttaccagcactttaaccttggactttccagcttccagaactaggggaaataaatttttgttgtttataaggtactcagcttatgatattttattatagctgcctgaatggactatgacactgtctaatgaaggacacagacaatgatctaagagtaattatgccatgtaatccatgccaatatgggggaatgccaagtagctctgggagcacttagcaaggccacccagcaatatgtggggatggtggtaggctgtcaggaaatatattccctgaagtggcattttatctgaggcctgaaagtgtgagccaggtaaaggaggattgaaagtaaagagggcaagaaaagagaaaaaaagttctcatagtatgttggagaaactaaaagaagtttgatatgtcttcagtgtaaagtttggaaaagggtagtagaaaacatggctagaggagggagcatgtcttaaagctgtgccaatctgagacctaacttttgaggtctgcatatgcttggactcagatagagctgggtttgattcccagttctcatctttcccagcaacttaggcaagttatgccacttctaagactcat

SEQ ID NO: 2510 - DNA, 34236 bp, Homo sapiens
cctttgacccacttccctctctcgatccttggtgtcttactccccttttcctgtccccctccctctgtctgggttggagactgggctctaggtccctggggtggagagtggtccaccgcaggaagacaaggatggatgtgtggggagtgcgaaggtgaagggataggaaggagggggctgatgtgggacggggtcctctcatccccaggagaatattgcagagacagtttcttcttccatgttgtggtttctaggaaaaaaagtaaagccattagctaaacacccagcagaaaggtctgaagttagagagcaggaaaatgagccagtgagatgcaagaataaattcagttgtatttcataaaacaatcattattcattaatcacgtggttactgagagcacaatagatgccaggcactggtccaggagccagggatccccccacgagcaccagacgtgccggggaacatgggtcctagttgggaaagcaggagaaagtgtcttcgtggagagcatggagcccgcctcctggctttgtgtgctgtgggagccaagatgggaaggggagggaggaggaaggatttcaactctaaatgggtgctgaagggaggccttgccaagaaggcgaggaggaggtgagggaacaaggcagggcctgtctgggaagagccttctgcacggaggtgagggcaaggaccgaggcccttggattggccttggccttgtcctgctgtgtgagggaatcccgcagggaggccagggatccaggagtccacagagctctggggagagcagaaggaaaggaggtctgggtgatgacggatggcctgcggatgaggtcttgcatttcctctggaagttgtttggctttatttttgcaggggtgggtccaccccagtgctatgtgacagtagcctggggtgggggactagagaggacttaggaggcaagtccacttggggatcaatgccatcctccagggaggctgcaaagatcatgtggccaggcgggggctggcaggggtgagtgagggtcaggggtggatatgtggggtggatatgttttggaagaagagccagcaggggtttccaatggttgggatgtgtgtgtgagaggagaggactccagaataacctgagtgctgtgacctgggcagctggacagacctgtcttcaaccaagctgggaaggaggacaggacaagtgtttctccagggcagaccaacagctctgtttggccacttcaggcagaacagccccactggccatctggggggatgctgagtacacagcgggtgtaagaatctgagttcaaagaagccatcccggatagggagacaaatgtctttagtgactcacatagcattgcacaagttacctctgcagaacctgtcctggaagccccacagaacctccctcgtcagaggctcacaggtataccacaattatcttccttccgcggaggacacagctatgtctgcagggtcacagagagatggacacggcccacagtaactggcagcagggctgggtcttgggcccatggcttcagatgccctttccagttttctgtctattttcagtttttgcaaagaaatagagagagtcacttgttacgtaaatgtgctataagcatttctgaagaaacatggaaatgtaaacacggagtgaaaggaagagagagatggacagagaaagagagagagaatcagaaatagagacaatgcatgtctttgaaggtgcaggtggcctgtgcctctgaacacggtagtagggctgggcatgtgcagacaggaaggggaacttctgctgtgaatttctgggggacctggtttgttttgctggttggttgggcctcgggcccctatgaccaagatggtgtttgaagactgtgagaacagcagtttgcttctatagaaaacccccaccacatcatacgtaggtgttgttgctggcaaggacccctgggcacatcttctagggcacaagtcaggacgtgctccgctctgtggaacacagctcaagtggctaaatccaaggctctgcacctgggcaggcgcataagagttgaggacattactccagctctttgcacaaagaacatgtcctgtggaatggcctcattttgtctttgcagcgagaaaagtacctgaatacacctgcatgcaactgtctggtatttgagcctctcacccttgtcttttgtaaactgaagacatgcgctggcagtcacagttctgcatgggaaggaagctagcactggcctctgctacgctcaggtcaggagaaagctcccctcagtaaaggggaaatcctctgctttcggaacatggaaactgcagctgcatttcacttcatggtattgttttactcagcacgcaactgagtatcacagtgggaccatcttagagacagagcagagagcaaaccagaccaggagctgctgttctcaggacactcagccagtggaatagagcagatgattcagaacccacagggccaggtgcagtggctcacgcctggaatcccagcactttgggaggccgaggtgggaggattgcttgagatcaggagttcaagaccagcctgggaaacataaggagacccccatcgccacaaaaaattaaaaaattagccgagcacgatggtgcgcacttgtggtcccagctactcgggcagctgaggtgggaggattacttgagcccaggaggtgcgacttacagtgagagccttgactgcaccaccgcaccccaccctggaccaccctgtctcgacaacaggaaaaaagccccacagataagtaagcatgcagagtatcaggcagtgatgagagctgtggagtgaaagcaagcagggaaggagggcagcctggggcgctttgcagcaaagttctcaatgagcagaagacacgtgggggagacctgaaggagggtgtagacaagtggggaagatgctccgtgcagagggagcaggaaaggccctaaggtcagatgcatctggcgtgctccaggaagaaaataataataaaagggcctggcagatgagacatccagagtcaggggtgagggcagacagctgcgggaggggaagtggggggatcctggaagggcgttggcccttgctgggagtgtgttgggagccagtggcatatcctgagcacaagactgacaccatctggcttaagttgcaggcgatgccttcgccctcagtctgctgggtgaagccagggaccaatcaggaggctgtactgaccccagctgcagccctcagcagcacatgcattgtgccaaagaggtgccacgtgcatgggaagggatcgtctggtggggtcaggtgggggcccttcgtggcaaaagtggacttgagctgagcccttaaggacatcagcattaataagatgagaggaggggacatgacttttgtagggcgcgcagctgaaaaatactgcttggttgttttctgtctgaggtgtcagcaagacacgcagctgtatatgttctgtaggaaatttgcagttgaagctggggctgggaggggcgtctgggatcccatgacggctttggcattaccgggaggctgacgcggaaagatcagctgatgcaaggcgttcaaaaccctgtctctatgaaaaataaaaaattagctaggtgtggtggtgtgcgcctgtagtaccagccactcaggaggctgagtgaggaggatctcttgagtcaaagagctcaagactgcggtgagctgatcatgccactgtgctccagtctgggagacagagcgaggccctgtctcaaaaaaaaaaaaaaaaaaatcaaaggctttgggtttatccgtctatctccgatctgctgagaagaggcggggctctagtgacaggcagcacacactcagaaaaatcacattcagtgtcccagccacagtactcacatccattttccttttggcctcatagtgatcctgcaataaaggtacagtggttattaaaatggacccccttacaaaggaggaaacggaggctctgagaagctggctgcacagcccatgtttagtaaacgcagaaccaagattgacaaagagtctttgaatgtccgttctggaaacttaactttagatcaggctgttcctggggaaaatatcctgagggggtaagccgccttatcttgtaaaatttctcagttaggagcttccagttcctttttctctgactcttggctcaccaaacagccttcttgtctgaactctgaacaactggagatgcttttgctgaagagtggcattggtgtcctgtgagatgcagctctcgttacaggtggacgcacactctcctgtggttagtaagttcctgacttgtgagttggttagtgtaaacacaattccccaaccctagaggaaaatcagcattgcatttccggacatgctgaattccagggacaacctcggtgatgattagtgactcacgtctaaaaacagaatacgcagagctgaagggatgtgacttctgatgtgaggtcacaaaataccccactcctctctagggcgatttccttccactctctggaggatcacttgccctggcaggaggcaatggccacgtggtgaggcacctgcgaggagggaacaaggtgccaacagctgaaccagagcctcaggagaggcctcaggccggaggcacccagatgagcttcactggatccctggcccacaggaaccatgagataacaaatatgtgttattctgttttaagctgctcagtgttggagctatttgttacaaagcagtaggaaactcatacaaagttaagggaggaaaagcggggaagcactgcagtgctgcgctacttacagtgatggtgcctgacggtgcaggcccggatggctaaagggacaaacaaatcggaaggaggcaaatgagaaatagaacatgaaaaggcctaaggaaaactgggaactccttggagggcgaagacaaggctcagccgggtgagagcgtgacgccagtgataacagactcagagtcggaatacggtgatgttttccgcttgttgtttataatgatctgttctgttatttgccttggcttcagatattctaccgtcaaggatgctttgtcttttttaatatacatgatgtgatttcctgacttggctttgtccgtgtaaaatcatatcatgtctctggtgcctctcgatactaaggtgtttaggacaaattgtttggcaggacatggtggctcacacctgtaatcccagcactttgggaggccacgtcaggcggatcgcttgggctcaggagctcgagaccagctcgggcaagatggcaacaccccatctctaataaaaacagaaaaaaaaagttagcctggcatggtggcaggcacctatgggaggctgaggtgacaggatggcttgatcccaggaggcggaggttgcaatgagccgagatcacaccactgcaccccagcctgggtgacagagggagaccctgtctcaaaaacacaaaaacacaaaataattcttggctaaatatcaagggaaacccctctttattagcaggctccaaataaatccattgaaactttgatgaagcagtgaggaaatgactcagaaatcccagtgaagtatatcagttacaaggatctcataaagaaggcactttgatttctactaaagataacttaggaagcaggtattacctatactgatgtgccagcctcttctactgaagccctgactaagggattattttctaagccccagcataactgaaacctcactgttcttaagactcttgggcaccaagtcattgcttcacctcattggccctgtgacttcctgtcactcgcggtatgactgacaatgacaccgtccatcgcaactcttcctttctcacgtggggcacaacaggagaacatcctttccctgtagtctgaacataatagagtggtaagcatgagaaaactctcagaacatagagagagactccagactgaggagcaactcctgtttcttcccttcctttctacagcacacatgaattatctcctgggaatgaaatggtcccggccccgttaaacattgtttcccaagtccatgtgatcccaggtaaaagattcggtatcggccgggcgcggtggctcacacctgtaatcccagcactttgggaggccgaggcgggtggatcacaaggtcaggagatcgagagcatcctgcctaacacggtgaaaccccgtctctactaaaaatacaaaaaaattagctgggcgtggtggcgggcgcctgtagtcccagctactcgggaggctgaggcaggagaatggcgtgaaccctggagggggaggttgcagtgagcagagatctcgccactgcactccagcctgggcgactgagcaagactccatctcaaaaaaaaaaaaaaaagactctgtatcatatggtacagccaagactttgcctgctgaagggggttgtccgaaggtctctgacacatgaaacaactcagttcttctctttgtggtaaggatacatacagcacataaacacagtccaattctaggagccaggagggcccccaccgctgtgttagggagatatggagtgtcccctattatgtcccaaagcttcagttgttgagatctaatgagttgcacacaacacagctgactgaagacatagcagcagaggtctataaagagatgtcagtcaatgtaacacatcttgtccatattctcaggtgaccaggagcaacaaccgagccatggagacgtgggtgaaccagtcctacacagatggcttcttcctcttaggcatcttctcccacagtactgctgaccttgtcctcttctccgtggttatggcggtcttcacagtggccctctgtgggaatgtcctcctcatcttcctcatctacatggaccctcaccttcacacccccatgtacttcttcctcagccagctctccctcatggacctcatgttggtctgtaccaatgtgccaaagatggcagccaacttcctgtctggcaggaagtccatctcctttgtgggctgtggcatacaaattggcctctttgtctgtcttgtgggatctgaggggctcttgctgggactcatggcttatgaccgctatgtggccattagccacccacttcactatcccatcctcatgaatcagagggtctgtctccagattactgggagctcctgggcctttgggataatcgatggcttgatccagatggtggtagtaatgaatttcccctactgtggcttgaggaaggtgaaccatttcttctgtgagatgctatccttgttgaagctggcctgtgtagacacatccctgtttgagaaggtgatatttgcttgctgtgtcttcatgcttctcttcccattctccatcatcgtggcctcctatgctcacattctagggactgtgctgcaaatgcactctgctcaggcctggaaaaaggccctggccacctgctcctcccacctgacagctgtcaccctcttctatggggcagccatgttcatctacctgaggcctaggcactaccgggcccccagccatgacaaggtggcctctatcttctacacggtccttactcccatgctcaaccccctcatttacagcttgaggaacagggaggtgatgggggcactgaggaaggggctggaccgctgcaggatcggcagccagcactgaacccagggcatccagtgcctggctctgccatctcttagctccagggatgtcgggttaataattctctcattttcagtcttggtttcctcgtgaattatgatgattgtgacaccctcagacttggaaggtctttttaaacactacatcagttctttctttctttctttctttctttctttcttttgttctttctttcgttctttctttctcttcctctttctctttctttctttttctttcagttcttactctgtcacccaggctagagtgcagtgacacaatctcggcttatagcagccttgatctcctgggctcaggtgagtctccaactcagcctcctgagtagctgggattacaggtgcgtgccccacacctgactaattttttagtaagggatccactattgttgtagagacaatgttttactatgttgcccaggctggtctcgaactcctggactcaagcaatccaccttccagagtgctgagattacaggcgtgagccaccacgcacagccaacatcagtactttttatctgatgaagaaacaacttttcctcccaatcttttgtgtactaattattttacactatacattgaaaatgaatataggacattgtaaatcagcactgtgcagaaataagacattgggattgctgtcactcattatttaaaattggaattacttctactagaagaagacgttgagctgagcctcctaactctccttgctaatgttttattctgtgcttactctgtgggagacttcgctctgtgatctatgtgtagacgtagatcccacctgcatgatgtttatatgatgtctcacaacagttgtagcccaaccctagggtcttaaatgaacaacttacagatgacagaaaataagcctttatagttctctttagagaatgtctactcctcacactggaaacttcataaagacgtattaaaagcatacaagttgtctttgagataatgagggacagggtagagacatgcttgcttgtgtattcagtggaaatcccccaagcctgctgtctcctcaccacgtcctagcagtgtgtgctgctctgtgtcagctcagcttctgtaaggagaaaactggctgaactccttccccttcggggaatgaagactggagcatggtgacagaatttcatctgctatttgaaaacctattttcagaatttcagtgtgaactatttgcaggacttgtatccatccttccaagctctgtacctgtcctatttgcagtaaaattctcttttcatggaaaaaaaatatctccattgaaggcggagagaaaagaggccagaactggtcctgaggattagactaaaccccagggaggtgtttgctgggcttcaggctttggagaggtggagggaagtggcacccagggcctaccgtggttgactttagattgtccactcagcttaattctcacaggaaacattctgtggtgaaaatattatgcccattttacaggagaggaagctagggctcaaatcggtaagtccctgcctcatcgtccagttttcttcttcacctccccatgggaaagactggtttgtcagcgcagctgagatgagcaaacaacttcggaggaggctccttcccttgggggtttaattgcctgaaaaggtgtctccaaggactggtgaaaatagaagtaactttccttagtcacggggctgcaagattttccactgtgtagatggatcttagtgtattctgtgaccacttgctgatatcacttaggtaatgcccaacctaccaaattaatttaagctctataatatcaaatatctttctgtgtattctcctcattttcatcatatctttttgccttgtacacatttctatttgccccaaattcttctcttccaggaagcatccctgattaacctcatgcccactcagatttctctgggattttgcacccttcaacccgtaagtaccttgagtgtttcaaccacaactctttatctatagccactgaacccctagactggaagaaaatttagagcaaacttaatccagcccccttccgtgatgcagaattttggatcataatcacccaagcaaaagtttcaccagcctttaccttatctagtcccatgatggggaaattcctatttcattttaattgcatttcattggcataggcttgatgtccttaattcatttcccgcacaaggaccagggaattccattgaaaattatctactgaacgccactagcacccagaaatgtggtaagttccatgtcacaaaaaggttccacagggtcctcttatgtccaggcacacacttcagttcactaatcaatgctccttatgaaacaagagttgcataactagtctcagtgtgagcaactgcaaacttagagatgtgtaattgttagagatttgtaagaaaataatatagagaggaaatacatgtggggggggggcaggtgcggtggctcacatctgtaatccaagcactttgggaggccaaggccaaggtgggaggattgcttgagctcagcagttggagaccaacctgggcaacatggtgaaaccccatctctacaaaaagtacaaaaatcagccgggcgtggttacttgggaggctgagttccttgggaggctgaggcggaaggattgcttgagcttaggaggctgaggctgcaatgacccatgatcatgccactgcactccagcctgggccacagagcagaagcctgtctcgaaaataaataagtaaataaataaataaacaaaaaataaaaagaaaacatgtgaaagcacaggagagtaaaagaagcaagaatcttgccaggggacatgggagtttttgttacttgcttcacttttgtgtatgcctgacattttttataattaacagtttaaaatgctcaaggccagttttttttttgccaactaccttaccaaatcctttcccatcaagttgtctgttcattttattgggtgattttggggcatagatgtgacaaatcttcattgcaatcagttaggtcaatgttttgtgtgtgtgtgtgaatataaaaaattgcttgaagccaggcatggtggctcattcctataatcccagctgataatggggaggccaaggtgggaggatcacttgagcccgggagtctgacgctgcagtgtcactgcaccccagccagggcaactcagagagatcctatctctacagattagaaatgttccatttcagctggacagggtttctcatgtctgtaatcccagcactttgggaagccaaggcaggaggatcacttgagcccaggagtttgagaccagcctgggcaacatagcgaaaccccatctctagaacaattaaaaataaaacatgaattttaaatttaaaaattgctctacacctccatttggaaagactgtgtatgtgtttgtgtcacgtatgaaagctaagctggcatctccataaccacggggctcagatctgtcctgatcacgttgagccccatagcctgaccctggaggaatgagtatctgctgttgtgaatgaggccagcacccttccccacccaggaaaaccaacggccacaggagggcagcagagagccacgatcccaaccagaggagaaagcacagacagcatggggcaggtgcaggcgcttatgtttgtttattggtttgttttcttttttatttaagtgacctgtgccatcgtattgggctgaaatagccagggatgtggccatacagacagatctagtgtaggtgaaaaagagagcggagtggggtccagactattccagcctccctcctgctgcccttggcaaggctgccagcctctctgtgcctcggtgtcctcatctgtcacatggggataataacagtatggactgcagggggctggcaacagtaaagagagtgaggtgcgtggcggcagcacaggtcggcccaggaggaccccgtgggagctcctactgactgcggagaagatcagcagaggccccgctgaggacggcctgggggaggtgcagggaaggggctcatgggagggtggtggggaacacctgcaggcagaggatgggtgtgattgtggggacctcaaaagccacacccagagccagggggtgctgcagggcagaggctgcagcggggaagtgcccatggcccgaggtccctgtgggcgaggccctcctctctaacccacagccatcccccaggcccaactttcaggggtgtgggaggtctgcctgtctcccgaagacccactgtggtcactaacagactgggacgtacatgagggtgacccaggcaggcaggtctgggcctccctggagctggcaaccgtgctcccatcatccctgtcccagggcctgtgtggtcctgagctgacacccgagggtgacaccccacactccacacatggcagagtgaaataatagcaccctggccatggtagcgcacgctcacagcccctccagcacagaaatgcagggagcagggggcagcgtcgggggtggccaaggctttggcctgtggcaggccctgagctcagaaggatgcaggggctttgcccaaacccacactaggtgcagggccggggaggctgtttcaggaggcgaaggaagggccccgggcggtgaggggagaggctggttccgaaagtgtgggcgacgcagccagagcctgatgactgaagagtgagcaggcggtggggcttcctaggaggcagtgaggagaggcagcccagacccagtgagatcacacctaggatgtccccaagaaacccccagggctggggccaggtcgtgcatcgtcattgggggtggggccaggacgagcatcgtcactgggggtggggccaggacgagcatcgtcactgggggtggggccaggacgagcatcgtcactgggggtggggccaggacgagcatcgtcactgggggtggggccaggacgagcatcgtcactgggggtggggccaggacgagcatcgtcgttgggggtggggccaggacgagcatcgtcgttgggggtggggccaggacgagcatcgtcgttgggggtggggccaggacgagcatcgtcgttgggggtggggccaggacgagcatcgtcgttgggggtggggccaggacgagcatcgtcgttgggggtggggccaggacgagcatcgtcgttgggggtggggccaggacgagcatcgtcgttgggggtggggccaggacgagcatcgtcgttgggggtggggccaggacgagcatcgtcgttgggggtggggccaggacgagcatcgtcactgggggtggggccaggacgagcatcgtcattgggggtggggccaggacgagcatcgtcattggggatgggcagccatgtggatgagccgagagattccagtggggaaaaaggagacgaggccgagattgatgatctagaggcgcccgcagcctcacagacccaggtgccctggcaagcacagccctgctcacacagcagacatgggggtggggatgactgagtgtgtgcatagcagggaacagataaatgagcctaaaggcatggataagtttaaaggctaaagaagggccttgtgcagaccaatcctgagcggaaatgaatgcaggagtccagttggcccctgctgagaggggaaaaccggtgtcttaaactcaggacctagagtcaggaggaaagaggttccagataggacccagattaggaacctcctcacccactcctccctccagagactacagcagagggggaggcccacaggcagcacagccttcaactcctggtttccccagaagacactgtgggcatttgtccaactgacctcagaggccccctccaggacactgtgacagtttataccaatctgcacttttgctccttgagctcttatctttggggcagctcaaatgatgacaatggcttttctggccaacttacccagactctgtcctgagacgagtaagcagggcccagtcttcccaaggccctccctgtcttctgggacaccatgtgggtccttctgagacagtggccagctttgccccagcccagagcagctgagccagcggtggaatgactctcatgacagacagctgtgagctcctgctgtgccccaggcccaaggctctagggggtcaaagaggtaggaagaagagctatgccaggggggatgctgggaggcgtttgggggtgagtgccccatctctgtcacatgggccaccttctccacctgtaagaaggacatcccagaaaactggctctttatcttggctttcactcactctgctgaagggcaggatattcagcagaaatcttagaaacagggcgaaactcagtgacaggaaagctgagagtttagagccagcaggaaccttagagatcatctcattcaccctctcatcttgttgatgtgaaaacaggctcagagatgggagtggctggcctgtggtcacagagtgggtccccaaactgtgcccagggcctgggtatgcatcacttccagaaatgtgtaacactggaaatgaatccgaatggccttccaaagcggcaaaggcagcgccaacccggtttctcctcctggacgcattggaacaaccagccaagcagccccagaagatcacttcctcccacctctagcctaaaggtgacacttttgaaaccccccgtagcctccctttgcagtttggaccctgccgttctgttcacctggagatctcaggcctgaaaggtcttactgtggtggaattacgtttccctcaaaatccatcttagcactccaaccctctttccctcagaatgtgactgtattggacatagggcttttaaagaggtggtcacactaaaatgaggtcactagggtggaccccaatccaatctgacaggtgtccttataagaggaggaaatgtggacacacagggccatcacgggtacatgtgcacagacgaaagaccatgtgcggacacatgtttggggtgtgtgtgtgtgtgtgtgtgtgtgtgtgtgtgtgtgtgtgtttggaacagggtcttgctctgttgtcctggcagcagtgcagcagtgacgtctctgcttactccagcctcaaactcccaggctcaacccatactcccaccttagcctcccgagtagctacagaaacttcaggtgtgtgccaccactcctggctaattttgggattttctgtagagatgatgtcccaatatgttgcccagactggccttgaactcatcggttcaaataacccatctgcctcggcctcccaaagtgatggaattacaggtgtcagccaccaggcgaggccagttcctctgttttttgttttgggggattttttggatgtttgttttctgtttctttgtttttaatggaagagatatttaagagacacctcacaaaggaagattaaaaaaatgagtcatacacatgaaaaagtgcttatcgtctttcctcatcagctaaatgcaaacttaaaccatgaggaaatactacatacccagaagaatggctagaagttaaaaaataatcatcgtaataggtgaaaagtaccaaatgctgccaaggaggtagcctcataacgctttcacatggttgatgggaggaaaataacctaaatgtccaacagcagtggctgcttggataatctagagctctaccaaacaatggaacaataaaaatggtgttgtgggctacttcctctttcattccactccagtttctccaggcacacaagctccagctccactcacgaacgcatggcctcatattccccaagcagcttcttctgaaagtctcttctcttagaaaacgctgccagcgcgcccctgctgttcaacccccaggcccactgtcaaccccagacagctcgactgcctcacgtctctctgaggtcgccaccacaccttctgtcaggactcccatgcccgcttatgccaccacatcaggcatgaaaacttccttttcttgcttctctctctctctctccctttttctttcttttctctctttcgagactgagtcttgctctgtcttccaggctggagtgcagtggcgcaatcatagcttactgcagcctcgacctcctgggctccagccgtccatccatctcagccttccaagtgctgaaacgtccttttcttgtgtgctcatgcccattagccaagctcgaagggacgcatggaggaagctcagaattaccatgagaaataaaatgcggccttgtgtggtggctcattgtggtgggtcagaaaacgcgtgcaagtttccgtagtgtagtggttatcacgttcgcctaacacgcgaaaggtccccggttcgaaaccgggcggaaacagaatcttatgcttttcatctcattacttcaaatttattacaagaaaactagcctggaacaccccaccactatctccacctggttacggagaaaaggccatcaagggtatttataccgttgcctttcctcaacggttgaggcacctgggaagaactgaacccacctcacttgccctggacagcggcgccgacgaacttcgcacaaagcccgtccgctggacggctgcgcgctgccaagtggaatccagatcccgagcatgcgtggggcccaaggcgagttccaatgaatcctccttttgcaacccatggggggacaaaatggagaaatcacaacaagttggcagaggtggaattcgaacccatgcctccgaagacaccggcgccttaatccggagccttagaccgctcggccttgctatctttctcctggccgtatacttacatatttcctttctttatacaacatcgctagggtccccgggccaacaaggcgttggggcgaatccacagggcattgcagaaccaccgccttgcagtacgattctctgggccagaggcaccggctgggaaacggctccaccagcgccctggcggagaagattcgagaagcgcaggcctcgggatctgctttggggggtcactcaaagtcacccacatcggccctctttggggagccggcgtgagtgctggggaagccttctaccctctcactttaaagaaagataaacaaaccagggccggccaagagcggtggctcacgcctgtaatcccagcactttgggaggccgaggcgggcggatcacgaggtcaggagatcgagaccatcctggctaacatggtgaaaccccgtctctactaaaaatacaaaaaattagccgggcgaggtggcggcgcctgtagtcccagctactcgggaggctgaggcaggataatggcatgaacccgggaggcggagcttgcagtgagctgagatcccgccactgcactccagcctgggcgacagagcgagactccgtctcaaaaaaagagcagagagaaaccctgtacatccattcccttttttttttttttttttttttttttttttttttttttttgctgtgaactgtgttcctgagtagaggttggttaagctctgacaccagaattttcaggtgtacggctaaagagcattgctcttgcaaaagtacccatgattctccagatcttttgttttacttcaaaaacatcttctaatcctgacagagtcttcacagagaagtgtttgtttgtggtgaggtccaactcacctttttttttttcctgtttggtgtcaagtcaaagaactcttcacccagctctaggtctagattttctcctatgtctttttgaagttgtatagttttaaatctgacattaaagcccatgatctcctttgggttcatttttgtctcagctgtgaggcttggctaaggttcattagtttggcctatggctgctccagcactgtttgttgaaaacacgatcctttctccattgtattgcttttgcacttttatcaaaaactacttgaagcatggtgcgtggctgacgcttgtaatcccagcactttgggaggctgaggtgggcagatcccttgaggtcaggagttccagaccagcctgaccaacatggcgaaacccggtctctactaaatatacaaaaattagccgggtgtggtggtgcaggcttgtaatcccagccatttgggaggctgaggcaggagaattgcttgaacgcgggtggtgtaggttgcagtgagctgagacggcaccactgcactccagcctgggcgacggagtgagactatgtctcaaaacacaaaaacaacacaaaacaaaaactacttgaaaagaaaatatttgcaaaggacatatttgacaaaggacttgtagctgggctatataaagaataatcaaaactcagcactgagaaaaaatcctacatattaaaagagtgaaagaaggaaagaacacgataaatgcaattgacgcggaaaaagtattggacaaaattcaacaccctctcgtgactaaacactcaacaggccaggcgcggtggctcacgcctgtcatcccagcactttgggaggcctaggtgggcagctcactttgagatttcatctcaaaaaaaccccaaaaaacaaaaaacattcaaccaactggtacatgaaagcatactattaacggagcaaaaaggcaacccacataatgggagaaactgctagcaaattacgtgactgataactgatgaatatctagaatatgtgaaaaactcccacaactcaacaacaaaaaataaataacccaattaaaatatgcactgtggctgacgcctgtaatcccagcattttgggaggccaaagtgggtggatcacttgaggccaggagttcgagaccagcctggccaatatggtgaaaccctgtctctactaaaagtacagaaattagctggtcgtggtggcacgtgcctgtagtcccagctacccgggaggctgaggcaggagaattgcttgaacccgggaggcggaggttgcaatgacccgagattgcaccgctgaactccagcctgggtcacaaagcgagactccatctcaaaacaaacaaacaaacaataaaatagaggacaaaagagtagaatagacagttcttcaaagaagatatagaaatggggataagcacatggaaagatgctcagcatcattaatcatcagggaaatgcaaatcaaaaccacaagaagataccacctcacagtcattaacatggctattttcagaaaaacaggaaataaccaaatgttggtgagaacgtgaacgaattggaacccttgtgagttaatgacaggattgtaaaatgatacagccactgtagaaaatagttttacggtccctcaaaactttaaacagaattaccatatgatccagaaattctacttctgggtataaacacaaaagaattaaaagcagggagtggaaaagatatttgtacagcagtgttcatagcagcattattcacaacagccaaaaggtgaaaacaaccaaaatgtccatcgaataattgagtggataaagaaaatgtagtgtatacacatgatgggctatgactcagccttaaaaaggaatgaagtccggacatatgctacaacatggatgaacctttaatcttacacagactgaagtaagccagacacaaaacagcaaatatggtgtgattccacttatgaggaatagtgtggtcagattcacagggatagaagagcaggagttactggggctgggtgaggaaggaacagggagttgttgtttaatgactatactgtttctatatgggatgattaaaacattgaggctagtggtgatgattacataagaatgtgaatgtacttaatgctattgacatgtacatttcaaactgttgaaatggcaatttatgttgtgtatattttattacaatttctaaaaagagaaaaaaatccatttagaaaatgggcaaaaacatgaggagacattatatagaaagggaaatgaaggtaccaaataagtacataaggtgtccaacagcactagccattcaggaaatgcaaattaagacgaaagggagctatcactatacacctattggaacggctaaaattaaaaaacagccaggcgtagttgtgcaagctgtgatctcagccatcccagaagctgaggcgggaggatcacttgagcccgggagttcaagagcagcctgggaagcacagtgcgaccctccccttacccctgcccgggcagtccccctactccccacctctactgccccctgccggtgtctcaaaaaaatgagataacatcaatgccagcaagagcgcaaagaaaccaaatctcatagaaggctcgtagaaatgtgaaaagacacagccactctgaaaatagattggtcatttcttcagaaactaaaaatgcactgagcatatgacctagcaattgcattcaaccatttatctcagagaaaagcaatataatagccaaactgaaaacaatgcagactttcacctggtggatgattaaacaaactgtggaatatttatagcttgaaatgctactcatcaataaaaataaatgaattactgtattgatacaattagagtggatctcaagggaattatgctaaatgaaaaaagccagttgctagaggccacgggctgtattattacatttgtataacattcttgacataacaaatttttagagacattaaacagattcgtggctgtcaggagttaggaactggaggacaagggacgctgtaggggtgtgtgtggctctaagagtgtggtgctggctgtgataatggaacagttctgtatcctgattgcggtgatagtcacagggagctacacgtgataaaattgctgtgtagagaaacatacacgcacacacacacacacgaatccatgtataactggaggggtcccagtaagctctgtggattgtaccaatgccgttttcctggttttgttaccgtgctacaattatgtaagacgtcatcactgggaaagaccagtgcctgagacctccctttagttttctttgccactttctgtgaaactataattgtttcaaaatgaaaaattggtttgctttaggttttatgttttcctttttctttctttcttcttctttttttttaaatagacctggggttttgccacattgcccaggctagtctcaaactcctgagctcaagcaatgtacccacctccgccttccactgtgctgggattacaggcgggagctaccgtgcctggcgtggttttttctctttctttctttcttttttttaagatgccagattctaaattggcacgcgagggcagttcctcgtttttggtttttggggattttttggttgtttgttttttgtttctttgcttttaatggaagagatatttaagagacacctcacaagggaagatttaaaaaatgagtcatacatatgaaaaagtgcttatcgtctttcctcattagctaaatgcaaacttaaaccatgaggaaatactacatacccagaagaatggctagaagttaaaaaataatcatcgtaataggtgaaaagtaccaaatgcggccaaggaggtagcctcataacgctttcacatggttgatgggaggaaaataacctacatgtccaacagcagtggctgcttggataatctagccgtccatccatctcagccttccaagtgctgaaacgtccttttcttgtgtgctcatgcccattagccaagctcgaagggacgcatggaggaagctcagaattaccatgagaaataaaatgcggccttgtgtggtggctcattgtggtgggccagaaaacgcgtgcaagtttccgtagtgtagtggttatcacgttcgcctaacacgcgaaaggtccccggttcgaaaccgggcggaaacagactcttatgcttttcatctcattacttcaaatttattacaagaaaactagcctggaacaccccaccactatctccacctggttacggagaaaaggccatcaagggtatttataccgtggcctttcctcaacggctgaggcacctgggaagaactgaacccacctcacttgccctggacagcggcgccgacgaacttcgcacgaagcccgtccactggacggctgcgcgctgccaagggaatccagatcccgagcaagcgtggggcccaaggcgagttccaatgaatcctcccccagcctcctgctcggcccctgcaggccccgcacccgcctttcccctgcagccccgtgcgccctcgcgccgcctcttccacatctccctgggcggaggccccgctccatcgcgcagtgccgtccaccgttgtccgcctgtgtggcctcggtcttcccttgttcctcacccccacccttcccctctggggagcaggatccgtgcgttttgtttccttcgtgctgtgtcccctgggcctggaactgagctgccttggcacagctgtagattccgtgagtgtttcttcagtcgtacccagtgctagtgcgggtgttaattgctctgaccctggtcacccgcccgtaagaaaggcgctgctctcaccccattctacagacgaggaaccgcccctcccggggttgtgtaactcgcaccttgacagccagcgcaggagctgacccgcccaggcggcccctgcagaggcccagcacactcaacaccgcgaccctcctgcggccccgagcgctcgccgacagcagcttttctctcctagatttaaaaagacagctgtggaaaataaaagccagtgcccccatctcctcaaggaccaggactttgcacatgacacacaaaacacagcagcacacactggcccctcctgcagacgcacattactgggtggacgtgccggtgttgagtgttggccgtaaacgatcctatgacggatcctcatttcgtttctgtaacatgcacttttcgttttttaaacccatccattggcaaggtctccattccggcagttttggattggatgacttccatcacgtccctcccagcttcagtctcgcggtggtcgctcatcttcatttacttggcatctccgtaaatttactcacatcttgattatttatacaactactttagcttaattacaagcaacactaagcaagaacttcaagtttcaaggtgcaagttacctgctctccaaggctgcattaaagcattctgtaaacattaattatgctctgggccacaggaatcattttgcacactgcaacggtcactcagctgatccctggggaacactaactgcctcgctgctgtgtttgggggtctgtttttatggtttagcattccataacagctttattggggcacagttcaatacaataaagtccactcactgtaagtttacagctcaatgatttttagtcaccgcataggattctgcaaccatcaccacaatccagtcttaaaacagttccgttaccacaaagatttccgacatgcccatctgcagccagtcctggctctcggcctcagtggtacagaagaagtgatctgctttctctctgttttcatctgccttttctggaaatgtcatataaataaatggtggtagtggaattgctagtttcaagtttcactttctataccaaaaagttaaacatagggttactatacaatccatcaattccactcctaggtatatataaaagtgagttgaaaaccttggttcacataaaaaatgtacacaaaatatatatggtatcatttttcattatagcgaaaaagtggaaacaaaggctaggcaaggtgtcccatgcctgcaatcccaacactttgggaggccaaggtgggtggactgcttgaggccaggagttccagaccagcctgggcaacatagggaccaagtctctacaaaaaatacaaaaattagccaggtgtggtggtgtgcacctatggtcccagctgcttgtgaggctgaggtggaaggatcacttgaaccaaggaggtggagattgtagtgagctatgatggcacctctgtactccagcctgagtgacaagagtgagaatctctctcaaaaaaaaaaaaaaaaaattggaaacaacataaatgttcattctttgatgaatggataaacaaaacggcatattcatctaatgcaaagatgtattaatttacttatttgtttatttatttggagacagggattcactctgtcatccagtagcatccagtagcagtgccctggtgtgattacagctcactgcagccttgatgcccagcaaactttttttttttttttttttttttgtagagacgtggtcttgctatgttgcactggctggtttccaactcctggcctcaaacaatcctcctgcctcagcctaccaaaacgctaggattgcaggggtgagccaccatgcctggcctatttgaaatgtttaattaaaaagcaaaaaatgaacaaaaagaatttgggcccacatatatgcagttatttgattttcaccaaaggcaccaaagcaattcaatgtggaaatagcgtctttgcaacaaatgggttcaggagcagctggatatccataggggaaagaaattaaccttaattccaaactcataccataacagaaaaattatatgaaacagaatttacacttaaacagacaagctgaaatttaggagtttccagaattaaaaaagacataggagagtcttttttttttttttttttcttggaacagggtcttgctctgttacccagactggagtgcagcaccgagatctctgctcactgcagcctccatctctcaggctcaatcaatactctcacctcagcctcccgagtacctacagaaaccgcaggtgaacgccaccactcccagctaatttttgaatgttctgtagagatgatgtcccagtgttgcccagactggtctcaactcatgagctcaaacaattcgcacacctcgccctcccagagttctggaattacaggtgtgagccaccacgccagaccagttctttgttttttgtttcttggggttttctgtttgtttatgtgtttttttctttgctcgtttttaacggacaagatatttaaagagacacttcacacagtaagataaacacatgagccataaacccatgaaagagtgcccatcttttctcatcagctgaatgcaaacttaaaccataaggaatactacatacccataaatggctagaagttaaaaaagtaataatcaatgaaaagtgccaaatgttgccaagggtgtagccttcataacgcttgcacattgttggtgggaggaaattaccctaaatgtccgacagcagtggctgctaggaaaatctagagttctaccaaacaatggaacaataacaatggtgttttaggctacttcctctttcattccactccaatttctccagacccacgaacttcagctctactcacgaacgcgtgtcctcatattccccaagcagcttcttctaaatgtctcttctctttgaaaatggtgccagcgcgcccctgctgttcaacccccgtgcctactgttgctgccacatcctctctcaagactcccgtgtccacttatgccaccacattgcacatgaaaacttccttttcttgtttctttcttttctctctttcgagacaagatcttgctctgtcgcccaggctggagtgcagtgctgcaatcatagctcagtgcagtgtggacctcccgggctccagccgtcctcccgcctcagccttccaggtgctgaaacgtgctttttttgtgtgttcatgctcattaacaaagctcaaagggacgcatggaggaagctctgaattatgatgagaaataaaataccgccctgtgtggtggctcattgtgatggcacaggtatcccatgcaggtttccgtagtgtagtggttatcacgttcgcctcacacgcgaaaggtccccggttcgaaaccgggcggaaacacctccttctgctttttacctcattatctcagatttgttacactgaggacttgcctacaacactccaccgctatctccacctggttaaggaaaaaaggctatcaagggtatttatacctttgcctttccgcctcaaccattggaacctgggacgaactgaacccacttcacttgctgtggacaccagcgccgacgaacttcgcacaaagcccgtccactggacagctgcgcgctgccaaatggaatccagatcccgagcaagggtgcggcccagggagagttccaaggaactgggggacaaaatgggcaaaccacaacaagctggcagcggtgggattcgaacccacgcctccgaagagactggagccttaatccagcgccttagaccgctcggccacgctaccttcctccgggggttcacctgcatcttttccttccttataaaacatccccagggttcccgggccaacaaggcgttggggcgaatccacagggcatcgcagaaccaccgccttccagcaggattcgcgggccagaggcaccagctgggaaacggctccaccagcgccccagcagagaagattcgcgacgcgcaggcctcggaatttgctttgggggccactcagaaagtcagaaagtcacccacattggccctctttggggaggcggcgtgagaggaggggaagccttctgcactctttactttaaagaaagataaaaaaataaaccagggcagaccccgtcagttccgggccgcgtagtcctgcaaagtctcactctgtgccccaggctgcaatgacacgatcttggctcactgcaacctccgcctcccgggttcaagcaatgctcccgcctcagcctcccaagtagctgagatcacaggcgcacaccaccacgcccggctaatttttgtatttttagtagagacggggtttcaccatgttggttaggctggtctcgaactcctgacctcatgatccacccgtctcggcctcccaaagtgctgggattacaggcgtgagccaccgtgcccggccaataaaaagtatattaaactatcaagagaaaaaaatcaacaggccagaaacgtaaggtctgtttctgcattctcagttctgttccactggtctatatgcctatctgtatgccaataacattcatcttgattactgtagctttattttatttatttatttatttatttatttattttttgagacggagtctcgctctgtcgcccaggctggagtgcagtggcgcgatcttggctcactgcaagctccgcctcccgggttcacgccattctcctgcctggttaccagaatacccgtctctactaaaaatgcaaaaacaaaattggccgggcgtggtggcgggcgcctgtagtcccagctactccggaggctgaggcaggagaatggcgtgaacccggggagttggagcttgcggtgagcagagatggcgccactgcactccagcctgggcgacagagagagactgcgtctcaaaaaaaataaataaataaaaaaaagaaagaaagaaaaagaaaaaagaaaagaaactcctgggctcaagtgatcctcctgcctcagcctcccaaagtgctgggattacaggcatgagctactgtgcccagtctgttttgttgtttaagattactcaagatttttctacatacaggatcatttttctctgctaataatgactgtcttacttctgcttttcctgtcttgtgcctttagcttccttttctcacctccagtactccgtgaaatacaaatggtgagggtgatatccttgtcatcttccaaagcttaaggaggctttttcaccataatgttactggaaagaggtcccattccagattccaagaaaggattcttgaatctcgagcaagaaagaatttggaggcctgtaatcccagcactttgagaggctgaggtgggtggatcacctgaagtcaggagttcgagaccagcctaatcaacatggtgaaaccccatctctactaataatacaaaagtcatccggtcatggtggtgcatgcctgtaatccccactacttgggaggctgaggccggagaatcgcttgaacccgggaaggcggaggttgcagtgagccgagatcacaccattgccctccaacctgggtgacaagagcaaaactccatctccccccgaaaaaaagaattcgggaagttcataaagtgaaagcaaggttattaagaaaataaaggaggccgggcgcgggggctcacgcctgtaatcccagcactttgggagaccgaggcaggtggatcatgaggtcaggagatcgagaccatcctggctaacatggtgaaaccccgtctctactaagaatacaaaaaaattagccggacgtggtgacaggcacctgtagtcccagctactcgggaggctgaggcaggagaatcccttgaacctgggaggcggaggttgcagtgagccgagatcgcgccactgcactccagcccgggcgacagagcgagactcctttccaaaaaaaaaaaaaaaaaaaaagaaaagaaaaaagaaagaaagaaaataaaggaataaaagaatggctactccacagggagaacagcccccaacggctgctgttgtccatttttatagctgtttcttgattatatgctaaacaaggggtggattattcatcagttttccaggaaaggggtgggcaattcttagaactgggggttccttcttgttttagaccatatagggtaacttcctggcattgccatggcatctgtaaactgtcatggtgctggtgggagtgtctttagcatgctaatacattataattagcatgtaatgagcagtgaggatgaccagaggtagcttttatccccatcttggttttgatgggatttggccggcttctgcactgcatgctgtcttatcaccaaggtctttatgacctgtatcttgggctgacctatcttatcctgtaacttagaataccagacttactaggaatgcagcctagtaggtctcagcctttttttatttaaacagcccttatacaagatggagtcactctggtttaaatgcctctgacaataagaataatgttcactataagtctgctgtaaatgtactttatcaaattgaggaattttccttctattcttagttttttaatttcttttttgtcataaaaaacatgactttgccaaatgcgtttctgtgtctattacaatgatcttgtgggctgggttgtagggatggcggagaaatggggagacgttgggcaaaggctatgaagtttcaggtagactggatggaaaagttctaaagagctattgtatagcatagtgactacaggtaataatactgtgttgtattctcaatgaaaagagtcaggcgcctgcctgtaatctcagctactcaggattgctaaggcaggagaatcgcttcaacccgggaggtggaggtttcagtgagccgcgatcgcgccactgcactccagcctgggtgacagagtaagactccttctcaaaaaaaaaaaaaaaaaaaaaaatggagttcgtaagttcattttgaatgaatacctggcatgtagaaggtgcttaaacaaagagcagataacatttaaaaagcatcaggaatattcttataggatgtagattttcagatccaaatgccagcagttcattctggtcgatgagaggaaaatattttgcattgaggctatcccaggaaagcaaggacacaaggccacggggagcaaccaaggaccatgacaacttctgagaaaaataagtttttaaagagaagcccctgccatttggaagctaacgggcactcacagcctgctggacataagcagccccgcagaatacagccctggacagggctactcggaggccgagattaaattagaccacgcgaggccacttcgtcactgcaccgaagcaggggtggaagcaagctcactgcaccagccacaaagcaccagacatcccacccagacaaaaccagtggctgttacttcttcaccaatgacagctttaaaaagccgctcctgccagtcacggtggctcacgcctgtaatcccaacactttgggaggcgaaggtgggcggatcacctgaggtcaggagttcaagaccagcctggccaacatagtgaaaccccgtctctactaaaaacacaacaaattagctgggcgtggtggcaggaagtcagggaccctgaatggagggaacagctggagctgcagcagaggaacataaattgtgaagatttcatggacatttatcagttcccaaaattaatacttttataatttcttacgccggtctttactgcaatctctgaacataaattgtgaagatttcatggacatttatcagttccaaaataatacttttataatttcttatgcctgtctttatttatttatttatttatttatttatttatttttttttcttttgagacggagtcttgctctgtctcccaggctggagtgcagtggtgcgatctcagctcactgcaagctccgcctcccgggttcacgccattctcctgcctcagcctcccgagtagctgggactacaggcgcccgccaccacgcccggctaattttttgtatttttagtagagacggggtttcaccatgttggccgggatggtctcgatctcctgacctcgtgatccgcccgcctcggcctcccaaagtgctggaattacaggcgtgagccgccgtgcccggccgaaagaaacctttcttttacaccagccttccagggctaggaaagtcttctgaaaatcccggtacaaagaaatctgcacaaagataagcctccatgtattattaactgtaataactttggtcctggtgcaggaagaaccaagaagatcaatggagtggaactgaatcaataaagagactcgaatgtgtttgggaattgagcacatggtaatggcggcgtttcagtggagagaacagagttacctgtgtaatagaaaaccaagtcaaaaggaagaaaaattaatggtggagataattttgtttttacccaaaaataaaaaataaaagccgggcacggtgtctcatgcctgtaatcccagcactttgggaggctgaggtgggcggatcacctgaggtcaggagttcaagaccatcccggccaacatggtgaaaccccatctctactaaaaatacaaaaaattagccgggcatggtggcgggcgcctgtagtcccagctacttgggaggctgaggcaggagaattgcagtgagctgagatcgtgccactgcactccagcctggacgacagagcaagaccctgtctcaaaaaaataaaataaaataaaaataaaaaataaaaaaataaggaaagtgggactgcatgggactggagggagagaggtgggttagagcaagtttggttttttccctttcccttggtcagcaaactaccctcaggccaaatccagcctgcaacctatttctctccagcccagcgagctaagaacattttttactggttaaaaaaataaaaagaataatatttcatgacatgtaaaaattagatgaaattcaaatgttggtgtctgtgagtcaagtcccattggcacacatgtcccattggcacacggcgcctccctctcattatgtgtcacctttactggctttggcaccaaaagggcagacgtgggtacttccgacaaaactgaaaagattctgtacgtggcccttgcagagaaagcttgcagacccctgctttagagagaggaggtatgagagtttaggctttggtgtgggtggctggggagatcccctggttcaggaaatggtgattccaagggaagttgctgtctgggtgctggtgctgtcctcctcctctgtccaccccatatctaatgcattctgagcgctcgctgggcagtcagtgcagggcgggacaacagtcacgtgttgcttcccaagacatacagtcacgggccccttaacaacaaggatgcattctgggaaatggtgattaggtggctcttggaaggtgcacctcatttacccctaggctgggtggcatagcccatcgctcccacgagtgacgtctgtgctacgacagtaccacggctatgacatccctaggccataggaattcttcagctccatcatagtcatgggaccactgtcatgcacgtgtccctccttgcctggaaggttgctgtgcagcgcatgacggcacttccatgtcagcgggtgcctcgctggcccatctcctgcccctgctcactctgtctgccaccttccagcagctccctgccctaaagccatcctgatgctgcttttccgccatttcttcctctgtgcatgttaccccaaactccacagggactgctgcttgcttgacatgcattctggaaccttctgggatcctgtcccagtgctcccaaggagaagcggcaagcaagggccaactcagcccagggctgcctctgtccaggccctctgtccaggtcgacaggcatcttcccctccccagggggagtgcaggctccagatgagtttctgtctccccagctgagaacctttgtcttggttcgggttgctgtaacacaataccatatgccaggctgctcaaacaatgacattgatttctcacagtttcgcaggctggaagtctagatcagggtgcagcacactgcagttcttggtaaggatcctcttcctgatttctgcccagctgccttctcactgtatccccacgagagagggagaggaaccagctctcagtctcagttctgtctccctgtgaatctgagagtgtgctgaggccaggaacctttgtccccttagcacctagacaggatgtgggacaggagttaggcacataaataaatgaatgaatgaatggaaagaaaatatatgattggtaataatccttcattgattcaacaagccaaccctgcacagtcctcactctcagctggggacatccgttgcaaaagttcaatcacctctggccctggccagtcccaggtggcacctcagctgtcaccaacctgtcccctgacagtgccctggatgaggccaccagcacctccctcctgactcacaagcatggggctcttctagcagccctacttgactactcttggatctgtggggcttttggttctccgaaagtcactcactcatttatcaaagggggacttcatgttccacctttgacccacaactcttttgtactatttgcaagactctgaggcttttttttttttttttttgagacagggtttcactctttttgcccaggctggagtgcagtggcatcatctcagctcactgcaacctctgtctcccaggttcaagtgattctcctgcctcagcctcctgagtagctgggattacaggcacccatcaccatgcctggctaattttttgtatttttagtagagacggggtttcaccatgttggtcaggctggtcttgaactcctaacctccagtgatccacctgcctcagcctcccaaagtgctgagattacaggtgtgagccaccacgcccagccgagtctgagcccttttaaagatgggtggccatggactaccagtctggtgaaagttatggactccttctcagaataatgctttctttctgtttgtttttggttttggttttttgagacagggtcttgctctgttgctaaggctggagagcagtgggaagaacctagctcactgcagccatgacctcctgggctgaagggatcctcccacctcagcctctcaagtacttggggctacaggtgcatgccaccatttctggctaatattttgcattttttgtagagatggggtctccctatgttgcccttgctggtctcaaactcctggcctcaagcgattcaaataccttggcctcccaaatagctggaattacagctgtgagtcacactgccaggacaattaccataatttttaagtactaatgagcataagtgatatttcaaagtgcctacaagaactatgatttgacatgtgatatgaaaggacctgtgatttctttgtgttttgctggtgtatgagacagagtctgcctctgctgcccaggctggagtgcagtggcacaaccttggctcgctgcagcctccacctctggggctcctgcgatcctcccgcctcagccgcatctgtgatttccattagcaataaaggtcgtgttaattctactgtggattgcagcctcctttctgaatggaaaaccctctttcagttcgtgattaggaaaaacatgagttctgctattgttcccacccagattcacagatcccctgttatccccgcctcctaggaaagggaatctttcggccttctcggggccaggccttcacctccgcctacaggcaggagatggcgccaacagcaagaggttccttctgactgtggcctataattaggtcaagtggcagcataggtagacgtgcaatcagggactaagtctgcagatgtgacttgcatgaggtgggcatgactgtgctacgagcataactaagaacgtcttcatcttagtgagcgggtgttttatgagagtgtgcactaagatgagaaatcatccacagcatccactaaaagagggtttgggggccttaagtctgtgcacacatccgcccgcggtgtccggggagagagtgcgaagtgccgggtccctgcgaaggtgcagttcctggagg

SEQ ID NO: 2511 - DNA, 15266 bp, Homo sapiens
cagggggaacccgatggagcaaatggtggggtgtgggaaggagtcaaggattatctctcagtcctttgccccctcttctaggcctcagtgtctccaccatcccccagccctaaccagagttaccagggcagcagcggctacaacttccggcccacagatgcccgctgcctgcccaggtcagtgctcctctgcccctcccccacaaaatatgctcccaattattcacatcttctggactttatcacccagaattcttttccctctcccccttggctacccacttcttggcctagaccgacttctagaactagtgtctggtagccagtattctggggaagggagtcccttgggggtagtgtttgagctctgcacttcccagggggagaaggtcctgttcccctgcttcaggtcctgactttccccactccaaccccagcagccccatccggatgtttgcttccttccacccttctgccagcaccgcagggacctctggggacagtggacccccagacaggtgagattctgtcttctattaccagtgatgctcttcttcccctctatgtgctcaaggctcttagtctctaacactgtttctctgattcacatgtgctctccatttctgcccatttcttacaattgccttctctccctaggtcacccctggaacttcacattggtttccccacagacatccctaaaagtgccccccactcgatgactgcctcatcttcctcagtttcatccccatccccaggtcttcctagacgctcagcacccccttctcccctgtgccgtagtttgtctcctgggactgggggaggagtccgaggtggggttggttacctgtcccgaggggaccctgtccgggtccttgctcggagagtacggcctgatggctctgtgcagtacctggttgagtggggaggagggggcatcttctgaacagcctgcctctgcccagctccccattcacacacaccggcactttcataccctgacctctgacctcacctacagctgggatgtacctggagagatagggggtagttctccctactgcccaggctggaatccaagagtggggagtggggaagaggccctcttctctaccctccttcatgattcctgacccctcccatccttcccatttcctttgatgttattttgttacagctttttaaatattttttaaaattatttaacccctgggggcagagactgaggagggaggatgataagggatcccggactctgtatgattgaaataaagagaaataaacaaatctagcagctctgagtcattctgaaagatgtagagaatacagggactagaagcacttatattctcccaacaaatttgcatacatgacaaaaaacaggcaaaaggcagagagacccaaagacgggatttattgggggcccagtcatcacctggaagtcagaaggcgttgaagtatcgcggggatcttcatgatgagcaggaacagggctcatcatggcaggactgtgatagagtcagaaactgactctgtgacctggcgcacccactgcaggtacggaaagttcccctgttccacaggcaatgcaattacctcggccacttcgtaagggtgcacagaactacaaaataggtgggtgggggaaggggatcactcaaagatttacccaaaagaacccactcccttacacgcaagccctagactgcccagcaagtcacacccacacagtacacaccctcaccccatccatctcaaagttctcaccgaacaaaatctgtcaaagctgggaccaaggaactttgggttttaatcatctaagggacaaagataaacatggttgaatcaaggagtgggattgagttcagtttctcagaagaggggtaagggctaaaggggtcagggattggggatattttgttgggtgggggaaatgtttctcaccatcagcacctcactgtcttcctcgatcttccctttccactcatagctgaaaggtcagagggggagagttgtggggagcaaagaatttcccccaggaaagaggttcccagtcagctcctacagttaggttaaccccccaactcctatgactcacatggatgtaatctgagggatgaggttgacgcaggctgctaggcgcttctccaccacggccctggagtgaagagacagtcccattcagagtaccccataaccccagtttttgtactggcagcccagagacaggcttccagagctggagaaaggagaaagcagcactcttctgccccacccccaactgtcccttcatgatcatcctttctcgctgcacatcgaggtccctacctggcgatctccttggcgaccttctcgttggggcaagtaacaaaggctgcagagaccgagcccggaacgtagccagagccggaatccgaggccggcgagggctgggtcggagggcttccagaggccatggtcagcaagactcggggtagcaacaaaaggcgggaggccacaggcagcagcgccggcatccaaacaaaagacaggagcagagaggcctgagagcaggaggcgaattcgatctctcctcacaaacagcccaggaaattacacccggggaagccttcgcttagatcctcaggctctgccctccctctgatgcacccccgaagaatgcccctgaaggtgagagagaaacttggaaaataaagcaaaagctcatttcactcacacctcagggggccaacctctgggatttagggtgcgggtagcggtcgaggcttcgaggaccggaaggggcggggcggggccggtcactcaccactccgccgagcaggaccgcgggagcccgccccccactcatgcggcctacgctggtacaggagagttgatctcaaaggccacacgtcacacggagaaacaaccccaggaagagcggcctcttcttacctgggtggcagccacgtgattagaaaacagcgcgcaccatgtgacagtagaagaaggaccacctgcgcctccagagccagccaatcccgaccctatcatggcgcggtttgcccacctcctgatgaaggaggagccatgggagacttgaccaatcgactaccgcatctgcagacgtgcgcggaaatggcacgcccgtttccgtgtgaacccgaaactgccacttgctggctgaggagagccgctgcggcgttccactgtcacgtgagggggccggtcctcttcggcggcggcactcagtgagtgacgccaagtggccaatcacaggccagcctcgcaggccacgtgaggcgagagctggttccaggaaaggggggccagagaccccgcagagtcgatgcgtcaggctgtggagtggggaatcatccttaaaccccacaatgtgcctagtgacctcccctgcactgtttccgaggtcttaaggagtgggagggtctgagaaggacccttcaccccaaactcaggggttaagagagcgccccctgcccttttagttgggcagagatatgcctgggtttgggaatgaacaacggtgatctagaagcccgctgtccctgggtagcagggagtgattaggcaggcacgggcatggcaagacaatagctagctgaggaaagaagcattttaaaacagagcgagaccctgtggtagaggatggtgaaaatggggcctagccatcttaattgaaaacccaaagcttgagacagactactgaatcagagggaaggagaacgagggctgcaggatggggacagtggtgatggtccttctgtcccctcttccctgcctattccactccccaggattggtccacctctcagcctcgggtctcctttccctaacccatcccccaaggagccaggacctgccctacataacttccctggggcccaagcacatcctgtgacccaaaaatggagagaggggccaatgagaggcagagaggtgggaggaggtgcagagaaaaaagctcttgccactgcccccacccaatatttcccctcccttcaaggtctgaggtcattggtctggtggtggggatgcctcggagtttcccaggctgacgtcagggttatacctctcggaggttctagggcagggaagtggggaggggaggttccctgagatctctgtctttgagtttggagtttgtctctgagacagatttcggaggggtctttcagtatttgtgtggagatctttcttaggattgagtttccttttatgcttctggtttggggggtttctatgtttcagggtctgtggtcgcactctgaggtctttcgaagtcttcttcatgaattttgggtctctgagttgtccatctccggaccagctgaagtctctatctccccttaagtcaggagtgtctctgtctctaagttatcagtctctgagatctgagtctggggtctctttctaggtctgagttctctaagctctaattctacatctggctctttctgaatctgggcctcatctttttctgagtctaggtctcaggtcctggtccctgaaatcatcatctcagggtctggagtctaagatatctgtaggtatggagaaccctttttagactggattttcagattttgatattgagcttctctctctgggggatctggggtcgttttttcctcaaatcaggagtctcttttcctctagattttggccctgtgtctcaaattaccccacagtggggggtggtgaagtatctttctctgtgggtctagggtctctctgtctcagggtctggggtctgcatctttaggacctctgtctctctctggtgtgtttttgagtcaggggtctctctctctctcacaatctgggcctcccggagtaggggtgggggctgcagagtctctccctcctcctcctcctcctgctctcttcgctctcgctcgctcccccgccccccctctctctcggctgccgctgctgccgttggctcttattctcctcctcctcctcctctctcctcctctctgcttctctctgctcctctctcctcctctctcctcctcctcctcctccacctcctcctccttctccccctctttctccccctctttctctcttctttctcccccgtccccccgccccctccccccaggcctgatgagcaggtctcgagcctccatccatcgggggagcatccccgcgatgtcctatgcccccttcagaggtacgtggtggggggagggggagggccatatggggggcaacagggggaggggcagggggcgggggagagtcggggccgagggaagggagcggctgaaatggagggagaggggaggaccgggaaggcaggggtgggagcaaccgggaaggagggattggaggccagagggataggggtagataagggatggaggggccaggaaatgggccttgaaagggggctgaagggaaaatgatgaaggggaaagaaagcgccagaaaggggtgggaaggtagaaggattgggttggggaaaaagctgcagaaataatttgggggtgggagctgagtgatgaggaaaacatcaaggaaatagagggacagagtcttgggagaggggctaggaaggagaaatgaaaacataggggtgaaaagagaagccaagaagatgtggggggataatttggtgggggactcagagtatggtaaggggcggaaaaagagaggaggatggagggagagaaggggccagatggagagagagggaggcagtggggggtggggggatggagggtccagatggagggaagagagaagagagagggaacggtgggggaggggagaccagggcagggggagggccaaattatgtgtgcttgggggggtggcagtacaagtaagatgaaatgatgggagtaggggacaggttaggatcctgccccagactctgaccctcttaaaggctcttgaccagtaaaatgtaacctctggggtcttaatgctgtcttcacttcatcacttttacccccttcccccacccctccaatccttatttccattccccctccctcctctgctgtccatcacctatatctttccccccatatggtgtccgttccttatatgagtcccccttctgtccttcccctatatcagtcccctctctggtgttcattgcctctctcttatctcttttctatgtggtcgctcccttatatctctatcacttctttactagtccgtcttgaccccttctcatagcctccgcattaggtctgcctcctttgctctgacacatgtccagtcgagcccttcaggtgtattcccttgcccctgggcatttaccatcatttctgcctccttttctatctactcctattatttgtctcccagaccattccttgtcaccacaagtctgtgcctacccactttcccttaatacctcaactcttattatcatttctcttttcttgtctcctctacttattggggtgttggagatttggggtacaaagacacaggttttgatgattagaacaagggatccccatctcagcccttgagggatttctcatcctagtaaaaatttcccgtttctcagccatgttgctctgcctcttgcatctgcctcccagaatcattcttcaccaagtccagacagtatgtgtgtgtgtgtttctagagttgttcctaagttccctgctgccaggagaaagatgccctctgaagtctaacccgcctcccttggctgcagcctgaaccagccctttccccaaatgcttatgtgtatcaacagatttctcctctgggtataccaagtgtctaagtgcggtgggcatgttgcctgcaatgtctgtagtttcagaggctaggtattggtgatctctgtatctagagaacattagttagtctctgagatgggttgagatagagtttcaaagtatgtggtttctaaatggtggacattctgagggttcatcgctcactgtgatctggaggttgggtaaatttgagagacatatttatagacagaaaagggctgaatttgcaaaactctgctactcagtgcattctgttggaatgaagctcaaagaccagttctcctgcagtatactcatggttatcccataaaggtgacagagtttgatcttttttccatctaaaatctgataccttaagcctaatttctagctctttgctgtcgccaatgtgacatctctcttacttcaatagggcctgtgtggcattggggtttaaaggagaggcagtttgcagggagagcggcatggcaagaacaacagagctggggaaggaggaccctggtctcatctcagccataggcgacacttggtctactgttctctcttctcaaagttttgttcccatctccagctcttgtctttggaggcccctctgtgtcaccaggcctggatattccattctttccccctgacatctttcttcctcaagctcctcactgtgccttgagaaggctcctgacctatggagtggcttccatcctgtccactgagactaggtggggtgaggtggtgggggcagtgttgaatctctgggcactgaatgggagaagagataaatttggtctctacttgtccaaacaagggcatatttcccaccttctgccctggggcctccacagccagatgccgacaaaagccatcttctccttaccaccagaagaaccagaactttccctaaaggatgagcagggttgaactaggggaggagggcacagaggagggaagagttgggaggggaggccctctcatgtctctgactgtgaacaggtaagctccccgacttcttcttttctagatatttagccctcagaatctcatgatcccaatgttcctacacacacaccccatccttctttcccacagccatgtagctttcctcatactcttttatagaggggtggtgccaccttccaagtccttgtcttctgcagctatttggatgccttcctctacccagatatctgacaccaacttctctgtttttctcctgccaattttgcggcacctctaccttattttcctgaagtagatggagagctccttcatctttctctgcccccaaacgtgtaccttctctgtcatataattcccatccctgaacctctgcatttcttcccccaagtctccagagccttctgtgatgtgatcctctcctcttttcccctttgtataaatgcttgtcttgtgttcctttagagttgccaggtgtctcactttcaactgtgatctcctgaaggccggtagggtccccttctcactttgtggactctcttcttgccattttaggcctctgcttccaaatgcatagagcctcccttactgtttctgtgtgtctctgtcctccagatgtacggggaccctctatgcaccgaacccaatacgttcattccccgtatgatcgtcctggttggaaccctcggttctgcatcatctcggggaaccagctgctcatgctggatgaggatgaggtgagtgtggtgagaaggctgggaaaacgcatgtgggagaatggggagagtcctcattagtgaaggggagagagacacaaagaaggcagacaaagaagaaacatttgcaaatggcaggagggtggccattgagacttgggttggagtgtgacaagaggggtagtcattctctcatcttgggcagggagtctttgagggttatgagctgtgttggggaggagatgtggttctgaagatttcgggggtggggaggctcctgttttcacactgtccatattgtaggataggttagaatggggaaggggaactgaagggtttggagaaggggtgaagacatggaaggccctcccaaccaaagcaatcctcaggacccctctctgctttgcccactgagcaagactcccagtcctttctccatcagggggcagagtgcaagaagagaaattgcaggacgcagagaaaaggcaggggatagaggaggttttaggtagctggaggatactgggaaagaagactgaggtcagtggatcttggcatgatggggtgaagactgggagagtgattgagatcaaggtttagagagacactgagagggcttctgcaagggagtggttggacatcaggaaggaatataagggaggggaactgggagtatgtggagttatctaaaggagtacaagtggagtaggggcagggactagccagagtaaaggagatgaaacggacagaggcctcttatgggaggtggtggccaggtatggagatctgagagccagggaagtgtgggttctgatttgggagctgggtcagcaggagtgtccattggaggaaatagaggataaaaactggaatggtgccccacaagtgtgagtcagggaatgggggtgatttgggggacaagctttaaaaaatggtagggtagcctggaaaaccaaacgtggtgagagatggaccctgaaagttattgggaatggtgtgatgaggaagggttagaatttgagtcagggctaactagagtgtcaagggacctatgggggcaggtgagagtgtggagagatggctgggtagacagcttccaggccacagagtaaagtagaggtgttaaggagaggatatggtgactttgaaaggagaggtggcttggggagtctaagttttggacaccattgggagacatttgagtgactgtggtcaaacccctagatcaaggtttggagtctgtaggagaaatgggggaaactggaacccagagtggggactgttatagggatgaagagggaagacaatggattggggtaatgaaggaatgacagagatagggacagactgaagggaccagtggccagcaagttgaggggcaataggaatggccggtctggagcaggaagggcgtgtgtgtgggaggaggagtagatagaattgggaaaatgagcagcctgaacagacgcagggagttggaattggatgggtggtggaactggggctgggggatagtgaggggtctgttcctgtggctctttgtagaggtggaggagactgcaggggtggaggtgtatggaggtagggatggaggtggacagggggagctgggtgtgaagcttagggaaaggtgatggctgaggggaagaagggaactgagagatgctgggtcgggtgatggaaggagatgaaaggtgggggaaggtgaccaggccctctggcgggaggggaggttgggtcccagtctggccgcaagccgggccgtgggagggagacaagctgtggatcctgattataaatgcagcttctgctacccccgtgacaggctcggagggagagaagggggtaagggaggtgggaggttgggaggaaagcagggagaatggaggaactgaaggtcaagggaaaactggattcaggaagtagctaacttctgaggagttgcagaagagctgagtagggtttgggagaattctccggaaggtgtttcaagacaaatggagggagaaaagagggtgggacggcaaagaatgagagagagagactgggggagagaagggagagatccagtcaccaagtgtggaggggccggggcagaaaaagtgggcaggcttagggggaaaaggaggcccgcccttcctgggaggaggcggaggggggaagagggaggggaggggcggcgtgggccagggaggtctgacacacccccacctcccctagatacaccccctactgatccgggaccggaggagcgagtccagtcgcaacaaactgctgagacgcacagtctccgtgccggtggaggggcggccccacggcgagcatggtacggcggccgagcaggctctcatgacccggacaggcgcggggagagggctgaagatggaccgggctggcggggcgggggcgtcggggagcggcgggagctggccgggggcgggagaaggcggagacaaagtcttgcttcccgaggggagatggcgccctcctctggaaggtggagcgggacaggggctgtgggtgagaggcccctgtgggtcctcgctcggcttcgctccctttctcctctccagcagtgaagtttgactattttcctggtgcttgtaaaaatagtctccttagatctttagcttccagtccgtgtgttcctgcccctgcccctcccagcccctggtctgggatcttggaaagaatgacctagttcctgccctccccccagacctcttccccacccctatgctcctgattcttcttccggaccttcagtccttgaggtctccttttattaccccctgttttctcctctcatcagctgcttctattttctgcaattgtatcaccctttctctttcctccctgatttctcttattttctgtacccctcttgattaccccgtccctcccctctgctcccggcgaaagtccatcagactcccatctcatctcctttctgtctgtagagctatctgcgcggtctgtctctccaactctctccctctctccatctgtctcttcccctccctccccctttctgcccccccaaccccctctttagtcatttaaaaaaagatttttgtcttcctgagaagttcgcttaaaaggtttccatgggaacagtgaggggagatgaaggcagagaacagagatctgcagccaaggtgcagagagacgccctcagcccccggaaaccccctcgtcactgcccccttccacttcatttcccttcccggacctagcgatccaggttccccattcctccaacccccaggtgacccctttttcccaccagctccccctcccttcaggaattcaagctaccagtttctctcccttagagagccagtgacctgtccccatcctttggctccttccagccttctgataggtccaggccctactagccttgtgggccggtttggggaccttgggtgggtgggtgggtggtcagggatgtgtgtcattgtcatggaaaccccataccatcggggtgtgtgggtagcacatctctgtgaggcaaagtcaggtggtggtggagtgtatacagagaatgtgtgtgatgtctgtcacatctgtgtgtatatgtatatgtgtgtatgtcatgttcatgtctggggaagatgtgtgtgtttgtgtgcatgtgtgtacacctgcgtttccaggccagaatggtcacatgctcacagagcatgtttatcatgtgtcctgtggttggcagatctgcccacttattccccatctttctccttatcctgagtcctcagggtctaggggtctctggcgggggtctcccgtgtgttttgggtggggacaccgtgtgtgtttggagttgaggtggcatgtggaggttgctgtattggggttcagtaggggctgggaggggttccaggggcatatgtatttggggggagggcttagtgaaagttgatgggggtgaacgtttagggtcttcaggcagacatggaatgtgtaaagggcatggaggatgtgcagtggacataggggtcgttgggaccttggggacttggcaatgccaaggtgtttgctgaggctgtggactctccagcccgggagaggtcgccggacctttgaggggcattggaatcctgggctcctcctctgctgggtggagccgcgaaccctcgttctctccgcggttttgtgtgtgtgggggggtcctgctcaggaggggatggtgggtggcctggtttgttttgggggtccccttgcccccctcccccgtctctctcgcgctgtctccgggcgacagggctcgtgacagaggcggccacggcagcagcggtcgcctagcaacggcggcggggcccgggcaacggcggcagcggcgggagcggcggcggagggagccgttcccgcggccgtcaccgcgcggccgtcccggccgtcccgggccccgccgccgcccccaccgcgccgggcggcgcgagccgggccgtaccgccccctctccctccgcaccccgcccttcccccgcgcaggggcggggcccctcccccaccggggacacccctggcccccccggggggcggtgcgaggtaagggcggggccgggcggactaggagcgcgcgtagaggggggggcgccgcgcgcgtggggcgggggcgcgcgtgtgcgtgggcgcggggaggggggtggggaagccgcggtggcggcggcggcggcggcagctgctccctccgcatgttctcgctgcatcttccgagtggggggagttatggtaaccggagggggacagcggaggacgggagggtcggggaccggcctcgtgcggacagggtcttgagcacgcgggggcggccggtgtgtgtgggatcttggagcccctggtggaaggggcagcccgtgtgtccgcgtgtgtgttcgtgcccatgctcgtgtctcctgtgtgtcggtgccatgtgcacacgggggcccagttcctcgtgcacacatgtgcagccatccttgtgcaagtgtgtcctgtcttatcttgcctctgcctgtttcctgcctagggggctgttgggccagccacgggcttgtggggcagtccgcggccttgctggtccatgtcacctctgaccctgagcatgcatatccctggctggggctcacctcctgtcaggcttctgtgtgtgggaatgtgtggccctatgagcaggattttctgtgtccctggtggcaggtgtgtgtctttgcatgtgtgttccagcactggcctgagtatctgtgtcaatcccagcatgggtgtccagggcgtgtctggatgtgggtggtgtggctggggggagtaagtgtgtgaatgtgttccttggaattctactgtgtatgaaacacctttgggctgggcaggtgtaagccctgcttggtcagtaagtggggacagaaaagcttaaaaagggaagaaatggggtaaagaggaaaagtggggaggggataggagagaaggaatgagagaggcttgaagaagagagcagagagcagcaggccagggagaaagaatagctggagaatgggaatgtgggagaaagccaagccagacttagaagagagaacaggggataagagcttaagatggggaactggatagagatggtgggagaagaaggggtctgggagctggggaggcagtggggaggagagagtcaggccttctggtaaagtgatctctgaaagaagaaagggaagaagatgggagaaggcactggattcttgtaggccttgcaggatcaggcttggttttggatcagggaaggccactcaggcatacgggctggctcacagtgaggcctgtcatagcagggactgtcattagaggttcatatccccagcacagagctctgtctcccatttctctgctctgtgtccaaccctgttcttcgcccttctctggcaacctccctcctctggctccccttgagagctgccagctgggtgtggagaggaagaaaggccaaagggaaggttagggatttggagggcagggggagattctgtgggtgatggcaagattagagatgttggaggggcaggagtccaagcccttgctgtgtgtgtgtgagtgccattgtgtgtgtacacagggtgtgtacatgtgtgggtgtgtgcacaatgcctgtgttacgggtttgtgtaggtggctgttatgtgtgtgcatgcgtgtatacatcgtgcaggcatgggacatggagacccaggatcacagtttgtgcttttcaggtttgctgtgtgtgtgtgtacacgggtgtgtgttgttttctctgtacatgtcactgcatgcagcattaataacaggatgttctgtgtttctgtcactctgccccccctttcctctgtgtttctgctattcttttcctgcggcaacaaaagtgtttaataagcatatgtgtatgtggcctctgtgtacctgtgacttatgagtgagttcatggatcttagttcttggtaatatgtgtaaggttatattacttccaagaaccaagcaagccaattagcaaatttgttcttctgttaatgctttagttccaaagcggaattttaatgcatttaaagttagactttatgcctttattagatgagcttgcacatgaaaataatggctgagctcggttccctgaaatgagagtgaggcagccatacctgagaaatgcagaaaaaatgttactagggaagagatatcctgaaccattggatgcattgcttagtgtgtaccagaaggataattaacacatttgctcctggtttttctttactctggtggcaatctcggatgcctgtgttagagtgagagaagggctgggggaggaaagggggttgtcctgagacagagtggatgtggttgtac

SEQ ID NO: 2512 - DNA, 16879 bp, Homo sapiens
cagggggaacccgatggagcaaatggtggggtgtgggaaggagtcaaggattatctctcagtcctttgccccctcttctaggcctcagtgtctccaccatcccccagccctaaccagagttaccagggcagcagcggctacaacttccggcccacagatgcccgctgcctgcccaggtcagtgctcctctgcccctcccccacaaaatatgctcccaattattcacatcttctggactttatcacccagaattcttttccctctcccccttggctacccacttcttggcctagaccgacttctagaactagtgtctggtagccagtattctggggaagggagtcccttgggggtagtgtttgagctctgcacttcccagggggagaaggtcctgttcccctgcttcaggtcctgactttccccactccaaccccagcagccccatccggatgtttgcttccttccacccttctgccagcaccgcagggacctctggggacagtggacccccagacaggtgagattctgtcttctattaccagtgatgctcttcttcccctctatgtgctcaaggctcttagtctctaacactgtttctctgattcacatgtgctctccatttctgcccatttcttacaattgccttctctccctaggtcacccctggaacttcacattggtttccccacagacatccctaaaagtgccccccactcgatgactgcctcatcttcctcagtttcatccccatccccaggtcttcctagacgctcagcacccccttctcccctgtgccgtagtttgtctcctgggactgggggaggagtccgaggtggggttggttacctgtcccgaggggaccctgtccgggtccttgctcggagagtacggcctgatggctctgtgcagtacctggttgagtggggaggagggggcatcttctgaacagcctgcctctgcccagctccccattcacacacaccggcactttcataccctgacctctgacctcacctacagctgggatgtacctggagagatagggggtagttctccctactgcccaggctggaatccaagagtggggagtggggaagaggccctcttctctaccctccttcatgattcctgacccctcccatccttcccatttcctttgatgttattttgttacagctttttaaatattttttaaaattatttaacccctgggggcagagactgaggagggaggatgataagggatcccggactctgtatgattgaaataaagagaaataaacaaatctagcagctctgagtcattctgaaagatgtagagaatacagggactagaagcacttatattctcccaacaaatttgcatacatgacaaaaaacaggcaaaaggcagagagacccaaagacgggatttattgggggcccagtcatcacctggaagtcagaaggcgttgaagtatcgcggggatcttcatgatgagcaggaacagggctcatcatggcaggactgtgatagagtcagaaactgactctgtgacctggcgcacccactgcaggtacggaaagttcccctgttccacaggcaatgcaattacctcggccacttcgtaagggtgcacagaactacaaaataggtgggtgggggaaggggatcactcaaagatttacccaaaagaacccactcccttacacgcaagccctagactgcccagcaagtcacacccacacagtacacaccctcaccccatccatctcaaagttctcaccgaacaaaatctgtcaaagctgggaccaaggaactttgggttttaatcatctaagggacaaagataaacatggttgaatcaaggagtgggattgagttcagtttctcagaagaggggtaagggctaaaggggtcagggattggggatattttgttgggtgggggaaatgtttctcaccatcagcacctcactgtcttcctcgatcttccctttccactcatagctgaaaggtcagagggggagagttgtggggagcaaagaatttcccccaggaaagaggttcccagtcagctcctacagttaggttaaccccccaactcctatgactcacatggatgtaatctgagggatgaggttgacgcaggctgctaggcgcttctccaccacggccctggagtgaagagacagtcccattcagagtaccccataaccccagtttttgtactggcagcccagagacaggcttccagagctggagaaaggagaaagcagcactcttctgccccacccccaactgtcccttcatgatcatcctttctcgctgcacatcgaggtccctacctggcgatctccttggcgaccttctcgttggggcaagtaacaaaggctgcagagaccgagcccggaacgtagccagagccggaatccgaggccggcgagggctgggtcggagggcttccagaggccatggtcagcaagactcggggtagcaacaaaaggcgggaggccacaggcagcagcgccggcatccaaacaaaagacaggagcagagaggcctgagagcaggaggcgaattcgatctctcctcacaaacagcccaggaaattacacccggggaagccttcgcttagatcctcaggctctgccctccctctgatgcacccccgaagaatgcccctgaaggtgagagagaaacttggaaaataaagcaaaagctcatttcactcacacctcagggggccaacctctgggatttagggtgcgggtagcggtcgaggcttcgaggaccggaaggggcggggcggggccggtcactcaccactccgccgagcaggaccgcgggagcccgccccccactcatgcggcctacgctggtacaggagagttgatctcaaaggccacacgtcacacggagaaacaaccccaggaagagcggcctcttcttacctgggtggcagccacgtgattagaaaacagcgcgcaccatgtgacagtagaagaaggaccacctgcgcctccagagccagccaatcccgaccctatcatggcgcggtttgcccacctcctgatgaaggaggagccatgggagacttgaccaatcgactaccgcatctgcagacgtgcgcggaaatggcacgcccgtttccgtgtgaacccgaaactgccacttgctggctgaggagagccgctgcggcgttccactgtcacgtgagggggccggtcctcttcggcggcggcactcagtgagtgacgccaagtggccaatcacaggccagcctcgcaggccacgtgaggcgagagctggttccaggaaaggggggccagagaccccgcagagtcgatgcgtcaggctgtggagtggggaatcatccttaaaccccacaatgtgcctagtgacctcccctgcactgtttccgaggtcttaaggagtgggagggtctgagaaggacccttcaccccaaactcaggggttaagagagcgccccctgcccttttagttgggcagagatatgcctgggtttgggaatgaacaacggtgatctagaagcccgctgtccctgggtagcagggagtgattaggcaggcacgggcatggcaagacaatagctagctgaggaaagaagcattttaaaacagagcgagaccctgtggtagaggatggtgaaaatggggcctagccatcttaattgaaaacccaaagcttgagacagactactgaatcagagggaaggagaacgagggctgcaggatggggacagtggtgatggtccttctgtcccctcttccctgcctattccactccccaggattggtccacctctcagcctcgggtctcctttccctaacccatcccccaaggagccaggacctgccctacataacttccctggggcccaagcacatcctgtgacccaaaaatggagagaggggccaatgagaggcagagaggtgggaggaggtgcagagaaaaaagctcttgccactgcccccacccaatatttcccctcccttcaaggtctgaggtcattggtctggtggtggggatgcctcggagtttcccaggctgacgtcagggttatacctctcggaggttctagggcagggaagtggggaggggaggttccctgagatctctgtctttgagtttggagtttgtctctgagacagatttcggaggggtctttcagtatttgtgtggagatctttcttaggattgagtttccttttatgcttctggtttggggggtttctatgtttcagggtctgtggtcgcactctgaggtctttcgaagtcttcttcatgaattttgggtctctgagttgtccatctccggaccagctgaagtctctatctccccttaagtcaggagtgtctctgtctctaagttatcagtctctgagatctgagtctggggtctctttctaggtctgagttctctaagctctaattctacatctggctctttctgaatctgggcctcatctttttctgagtctaggtctcaggtcctggtccctgaaatcatcatctcagggtctggagtctaagatatctgtaggtatggagaaccctttttagactggattttcagattttgatattgagcttctctctctgggggatctggggtcgttttttcctcaaatcaggagtctcttttcctctagattttggccctgtgtctcaaattaccccacagtggggggtggtgaagtatctttctctgtgggtctagggtctctctgtctcagggtctggggtctgcatctttaggacctctgtctctctctggtgtgtttttgagtcaggggtctctctctctctcacaatctgggcctcccggagtaggggtgggggctgcagagtctctccctcctcctcctcctcctgctctcttcgctctcgctcgctcccccgccccccctctctctcggctgccgctgctgccgttggctcttattctcctcctcctcctcctctctcctcctctctgcttctctctgctcctctctcctcctctctcctcctcctcctcctccacctcctcctccttctccccctctttctccccctctttctctcttctttctcccccgtccccccgccccctccccccaggcctgatgagcaggtctcgagcctccatccatcgggggagcatccccgcgatgtcctatgcccccttcagaggtacgtggtggggggagggggagggccatatggggggcaacagggggaggggcagggggcgggggagagtcggggccgagggaagggagcggctgaaatggagggagaggggaggaccgggaaggcaggggtgggagcaaccgggaaggagggattggaggccagagggataggggtagataagggatggaggggccaggaaatgggccttgaaagggggctgaagggaaaatgatgaaggggaaagaaagcgccagaaaggggtgggaaggtagaaggattgggttggggaaaaagctgcagaaataatttgggggtgggagctgagtgatgaggaaaacatcaaggaaatagagggacagagtcttgggagaggggctaggaaggagaaatgaaaacataggggtgaaaagagaagccaagaagatgtggggggataatttggtgggggactcagagtatggtaaggggcggaaaaagagaggaggatggagggagagaaggggccagatggagagagagggaggcagtggggggtggggggatggagggtccagatggagggaagagagaagagagagggaacggtgggggaggggagaccagggcagggggagggccaaattatgtgtgcttgggggggtggcagtacaagtaagatgaaatgatgggagtaggggacaggttaggatcctgccccagactctgaccctcttaaaggctcttgaccagtaaaatgtaacctctggggtcttaatgctgtcttcacttcatcacttttacccccttcccccacccctccaatccttatttccattccccctccctcctctgctgtccatcacctatatctttccccccatatggtgtccgttccttatatgagtcccccttctgtccttcccctatatcagtcccctctctggtgttcattgcctctctcttatctcttttctatgtggtcgctcccttatatctctatcacttctttactagtccgtcttgaccccttctcatagcctccgcattaggtctgcctcctttgctctgacacatgtccagtcgagcccttcaggtgtattcccttgcccctgggcatttaccatcatttctgcctccttttctatctactcctattatttgtctcccagaccattccttgtcaccacaagtctgtgcctacccactttcccttaatacctcaactcttattatcatttctcttttcttgtctcctctacttattggggtgttggagatttggggtacaaagacacaggttttgatgattagaacaagggatccccatctcagcccttgagggatttctcatcctagtaaaaatttcccgtttctcagccatgttgctctgcctcttgcatctgcctcccagaatcattcttcaccaagtccagacagtatgtgtgtgtgtgtttctagagttgttcctaagttccctgctgccaggagaaagatgccctctgaagtctaacccgcctcccttggctgcagcctgaaccagccctttccccaaatgcttatgtgtatcaacagatttctcctctgggtataccaagtgtctaagtgcggtgggcatgttgcctgcaatgtctgtagtttcagaggctaggtattggtgatctctgtatctagagaacattagttagtctctgagatgggttgagatagagtttcaaagtatgtggtttctaaatggtggacattctgagggttcatcgctcactgtgatctggaggttgggtaaatttgagagacatatttatagacagaaaagggctgaatttgcaaaactctgctactcagtgcattctgttggaatgaagctcaaagaccagttctcctgcagtatactcatggttatcccataaaggtgacagagtttgatcttttttccatctaaaatctgataccttaagcctaatttctagctctttgctgtcgccaatgtgacatctctcttacttcaatagggcctgtgtggcattggggtttaaaggagaggcagtttgcagggagagcggcatggcaagaacaacagagctggggaaggaggaccctggtctcatctcagccataggcgacacttggtctactgttctctcttctcaaagttttgttcccatctccagctcttgtctttggaggcccctctgtgtcaccaggcctggatattccattctttccccctgacatctttcttcctcaagctcctcactgtgccttgagaaggctcctgacctatggagtggcttccatcctgtccactgagactaggtggggtgaggtggtgggggcagtgttgaatctctgggcactgaatgggagaagagataaatttggtctctacttgtccaaacaagggcatatttcccaccttctgccctggggcctccacagccagatgccgacaaaagccatcttctccttaccaccagaagaaccagaactttccctaaaggatgagcagggttgaactaggggaggagggcacagaggagggaagagttgggaggggaggccctctcatgtctctgactgtgaacaggtaagctccccgacttcttcttttctagatatttagccctcagaatctcatgatcccaatgttcctacacacacaccccatccttctttcccacagccatgtagctttcctcatactcttttatagaggggtggtgccaccttccaagtccttgtcttctgcagctatttggatgccttcctctacccagatatctgacaccaacttctctgtttttctcctgccaattttgcggcacctctaccttattttcctgaagtagatggagagctccttcatctttctctgcccccaaacgtgtaccttctctgtcatataattcccatccctgaacctctgcatttcttcccccaagtctccagagccttctgtgatgtgatcctctcctcttttcccctttgtataaatgcttgtcttgtgttcctttagagttgccaggtgtctcactttcaactgtgatctcctgaaggccggtagggtccccttctcactttgtggactctcttcttgccattttaggcctctgcttccaaatgcatagagcctcccttactgtttctgtgtgtctctgtcctccagatgtacggggaccctctatgcaccgaacccaatacgttcattccccgtatgatcgtcctggttggaaccctcggttctgcatcatctcggggaaccagctgctcatgctggatgaggatgaggtgagtgtggtgagaaggctgggaaaacgcatgtgggagaatggggagagtcctcattagtgaaggggagagagacacaaagaaggcagacaaagaagaaacatttgcaaatggcaggagggtggccattgagacttgggttggagtgtgacaagaggggtagtcattctctcatcttgggcagggagtctttgagggttatgagctgtgttggggaggagatgtggttctgaagatttcgggggtggggaggctcctgttttcacactgtccatattgtaggataggttagaatggggaaggggaactgaagggtttggagaaggggtgaagacatggaaggccctcccaaccaaagcaatcctcaggacccctctctgctttgcccactgagcaagactcccagtcctttctccatcagggggcagagtgcaagaagagaaattgcaggacgcagagaaaaggcaggggatagaggaggttttaggtagctggaggatactgggaaagaagactgaggtcagtggatcttggcatgatggggtgaagactgggagagtgattgagatcaaggtttagagagacactgagagggcttctgcaagggagtggttggacatcaggaaggaatataagggaggggaactgggagtatgtggagttatctaaaggagtacaagtggagtaggggcagggactagccagagtaaaggagatgaaacggacagaggcctcttatgggaggtggtggccaggtatggagatctgagagccagggaagtgtgggttctgatttgggagctgggtcagcaggagtgtccattggaggaaatagaggataaaaactggaatggtgccccacaagtgtgagtcagggaatgggggtgatttgggggacaagctttaaaaaatggtagggtagcctggaaaaccaaacgtggtgagagatggaccctgaaagttattgggaatggtgtgatgaggaagggttagaatttgagtcagggctaactagagtgtcaagggacctatgggggcaggtgagagtgtggagagatggctgggtagacagcttccaggccacagagtaaagtagaggtgttaaggagaggatatggtgactttgaaaggagaggtggcttggggagtctaagttttggacaccattgggagacatttgagtgactgtggtcaaacccctagatcaaggtttggagtctgtaggagaaatgggggaaactggaacccagagtggggactgttatagggatgaagagggaagacaatggattggggtaatgaaggaatgacagagatagggacagactgaagggaccagtggccagcaagttgaggggcaataggaatggccggtctggagcaggaagggcgtgtgtgtgggaggaggagtagatagaattgggaaaatgagcagcctgaacagacgcagggagttggaattggatgggtggtggaactggggctgggggatagtgaggggtctgttcctgtggctctttgtagaggtggaggagactgcaggggtggaggtgtatggaggtagggatggaggtggacagggggagctgggtgtgaagcttagggaaaggtgatggctgaggggaagaagggaactgagagatgctgggtcgggtgatggaaggagatgaaaggtgggggaaggtgaccaggccctctggcgggaggggaggttgggtcccagtctggccgcaagccgggccgtgggagggagacaagctgtggatcctgattataaatgcagcttctgctacccccgtgacaggctcggagggagagaagggggtaagggaggtgggaggttgggaggaaagcagggagaatggaggaactgaaggtcaagggaaaactggattcaggaagtagctaacttctgaggagttgcagaagagctgagtagggtttgggagaattctccggaaggtgtttcaagacaaatggagggagaaaagagggtgggacggcaaagaatgagagagagagactgggggagagaagggagagatccagtcaccaagtgtggaggggccggggcagaaaaagtgggcaggcttagggggaaaaggaggcccgcccttcctgggaggaggcggaggggggaagagggaggggaggggcggcgtgggccagggaggtctgacacacccccacctcccctagatacaccccctactgatccgggaccggaggagcgagtccagtcgcaacaaactgctgagacgcacagtctccgtgccggtggaggggcggccccacggcgagcatggtacggcggccgagcaggctctcatgacccggacaggcgcggggagagggctgaagatggaccgggctggcggggcgggggcgtcggggagcggcgggagctggccgggggcgggagaaggcggagacaaagtcttgcttcccgaggggagatggcgccctcctctggaaggtggagcgggacaggggctgtgggtgagaggcccctgtgggtcctcgctcggcttcgctccctttctcctctccagcagtgaagtttgactattttcctggtgcttgtaaaaatagtctccttagatctttagcttccagtccgtgtgttcctgcccctgcccctcccagcccctggtctgggatcttggaaagaatgacctagttcctgccctccccccagacctcttccccacccctatgctcctgattcttcttccggaccttcagtccttgaggtctccttttattaccccctgttttctcctctcatcagctgcttctattttctgcaattgtatcaccctttctctttcctccctgatttctcttattttctgtacccctcttgattaccccgtccctcccctctgctcccggcgaaagtccatcagactcccatctcatctcctttctgtctgtagagctatctgcgcggtctgtctctccaactctctccctctctccatctgtctcttcccctccctccccctttctgcccccccaaccccctctttagtcatttaaaaaaagatttttgtcttcctgagaagttcgcttaaaaggtttccatgggaacagtgaggggagatgaaggcagagaacagagatctgcagccaaggtgcagagagacgccctcagcccccggaaaccccctcgtcactgcccccttccacttcatttcccttcccggacctagcgatccaggttccccattcctccaacccccaggtgacccctttttcccaccagctccccctcccttcaggaattcaagctaccagtttctctcccttagagagccagtgacctgtccccatcctttggctccttccagccttctgataggtccaggccctactagccttgtgggccggtttggggaccttgggtgggtgggtgggtggtcagggatgtgtgtcattgtcatggaaaccccataccatcggggtgtgtgggtagcacatctctgtgaggcaaagtcaggtggtggtggagtgtatacagagaatgtgtgtgatgtctgtcacatctgtgtgtatatgtatatgtgtgtatgtcatgttcatgtctggggaagatgtgtgtgtttgtgtgcatgtgtgtacacctgcgtttccaggccagaatggtcacatgctcacagagcatgtttatcatgtgtcctgtggttggcagatctgcccacttattccccatctttctccttatcctgagtcctcagggtctaggggtctctggcgggggtctcccgtgtgttttgggtggggacaccgtgtgtgtttggagttgaggtggcatgtggaggttgctgtattggggttcagtaggggctgggaggggttccaggggcatatgtatttggggggagggcttagtgaaagttgatgggggtgaacgtttagggtcttcaggcagacatggaatgtgtaaagggcatggaggatgtgcagtggacataggggtcgttgggaccttggggacttggcaatgccaaggtgtttgctgaggctgtggactctccagcccgggagaggtcgccggacctttgaggggcattggaatcctgggctcctcctctgctgggtggagccgcgaaccctcgttctctccgcggttttgtgtgtgtgggggggtcctgctcaggaggggatggtgggtggcctggtttgttttgggggtccccttgcccccctcccccgtctctctcgcgctgtctccgggcgacagggctcgtgacagaggcggccacggcagcagcggtcgcctagcaacggcggcggggcccgggcaacggcggcagcggcgggagcggcggcggagggagccgttcccgcggccgtcaccgcgcggccgtcccggccgtcccgggccccgccgccgcccccaccgcgccgggcggcgcgagccgggccgtaccgccccctctccctccgcaccccgcccttcccccgcgcaggggcggggcccctcccccaccggggacacccctggcccccccggggggcggtgcgaggtaagggcggggccgggcggactaggagcgcgcgtagaggggggggcgccgcgcgcgtggggcgggggcgcgcgtgtgcgtgggcgcggggaggggggtggggaagccgcggtggcggcggcggcggcggcagctgctccctccgcatgttctcgctgcatcttccgagtggggggagttatggtaaccggagggggacagcggaggacgggagggtcggggaccggcctcgtgcggacagggtcttgagcacgcgggggcggccggtgtgtgtgggatcttggagcccctggtggaaggggcagcccgtgtgtccgcgtgtgtgttcgtgcccatgctcgtgtctcctgtgtgtcggtgccatgtgcacacgggggcccagttcctcgtgcacacatgtgcagccatccttgtgcaagtgtgtcctgtcttatcttgcctctgcctgtttcctgcctagggggctgttgggccagccacgggcttgtggggcagtccgcggccttgctggtccatgtcacctctgaccctgagcatgcatatccctggctggggctcacctcctgtcaggcttctgtgtgtgggaatgtgtggccctatgagcaggattttctgtgtccctggtggcaggtgtgtgtctttgcatgtgtgttccagcactggcctgagtatctgtgtcaatcccagcatgggtgtccagggcgtgtctggatgtgggtggtgtggctggggggagtaagtgtgtgaatgtgttccttggaattctactgtgtatgaaacacctttgggctgggcaggtgtaagccctgcttggtcagtaagtggggacagaaaagcttaaaaagggaagaaatggggtaaagaggaaaagtggggaggggataggagagaaggaatgagagaggcttgaagaagagagcagagagcagcaggccagggagaaagaatagctggagaatgggaatgtgggagaaagccaagccagacttagaagagagaacaggggataagagcttaagatggggaactggatagagatggtgggagaagaaggggtctgggagctggggaggcagtggggaggagagagtcaggccttctggtaaagtgatctctgaaagaagaaagggaagaagatgggagaaggcactggattcttgtaggccttgcaggatcaggcttggttttggatcagggaaggccactcaggcatacgggctggctcacagtgaggcctgtcatagcagggactgtcattagaggttcatatccccagcacagagctctgtctcccatttctctgctctgtgtccaaccctgttcttcgcccttctctggcaacctccctcctctggctccccttgagagctgccagctgggtgtggagaggaagaaaggccaaagggaaggttagggatttggagggcagggggagattctgtgggtgatggcaagattagagatgttggaggggcaggagtccaagcccttgctgtgtgtgtgtgagtgccattgtgtgtgtacacagggtgtgtacatgtgtgggtgtgtgcacaatgcctgtgttacgggtttgtgtaggtggctgttatgtgtgtgcatgcgtgtatacatcgtgcaggcatgggacatggagacccaggatcacagtttgtgcttttcaggtttgctgtgtgtgtgtgtacacgggtgtgtgttgttttctctgtacatgtcactgcatgcagcattaataacaggatgttctgtgtttctgtcactctgccccccctttcctctgtgtttctgctattcttttcctgcggcaacaaaagtgtttaataagcatatgtgtatgtggcctctgtgtacctgtgacttatgagtgagttcatggatcttagttcttggtaatatgtgtaaggttatattacttccaagaaccaagcaagccaattagcaaatttgttcttctgttaatgctttagttccaaagcggaattttaatgcatttaaagttagactttatgcctttattagatgagcttgcacatgaaaataatggctgagctcggttccctgaaatgagagtgaggcagccatacctgagaaatgcagaaaaaatgttactagggaagagatatcctgaaccattggatgcattgcttagtgtgtaccagaaggataattaacacatttgctcctggtttttctttactctggtggcaatctcggatgcctgtgttagagtgagagaagggctgggggaggaaagggggttgtcctgagacagagtggatgtggttgtacttttcacgtgaatgaaaggatgtttgtgcttctgagatatggggatacctttctgtggtcaggatcatggtgtactcaagcatgtatttcaggggttaaactggaattcccctgcatggggatatgtgtgtcttagggttataggtccatttctgtagtgtgctgtccacatgattgcccaagagacttgggccacaaagtccacaccagcagctctcatgtgggtcactgggttcaagtatgtactcccttgttgcagagctcacatatgtcaaagcatgtatcctgtggggtgtgtgggcctcagggtctcagaatgtggatccgtgctatgcccgtgctcacagttgtctgtatgtctcaaaagcacatagatccccagttatttttctgtattgtggttctcatatacacgtacctccatagctcagtatatgtttctgtactatacacctgttcctgagggagtgatagggttctcgtgtcatggggtccacatttttgtatgcaaacctcctaacacctgggttttacaggtaaagggaagctgaggactgattctagggcagtttgcaggcaatttgcaattctggaagcagacagtgaaaatataattgtggtcctcccttgttctgttctggaacctagagggttaacaggcagctcttccggtccacccccctccttccagcctgtagcttcttgttgccgtggagatggtggccccgccccgatgcagcacctgcccccccattggctgcagtggtgactgtggggctgaggggggagcccaggcctgggcagccattctggagctggagccggagcttggcatccccccacttacattctcttccagcccctcggcccctctaaattcccttgcagccgagcctcagcttcctttttcagcgcttgccatccctctaggctcttggcagactgagctgcatccgcattcacctcccctcctcctcctttccctatccttacttgggagtcccgagaacccccactgtccatccttcctgctccctgcccattcccctgcattctttgcttttcccctccccccaccaaccttctgagcccctgccactgcagtgcacgtggaaccggctccttctcccttccccccacctgccccttccttggattttctgtccccagcttctccccctgctactcttcacaggtctcttccaagacctccccctccagtccagggagggggtcatgggaggcagccctggccctccagacagacaggggttccaggaggtggggggcaggtggaagatgtgcccaccagggggaagaggaaagcctgcctatgggcaatgacctttaacccatctttccccccagctagccccttctggggtgggtgggcaccagggacctagcctccctggatctttggtgtccttcattactggggttttactgaccctctcagccatgctcccctgctgactgccagccccagtcatgggcctaaggcctcccaccccatccccctcagggggctcctgctcaggttccttgccccctccttcccgctgccagcctctccgccgtcgctgctcttcctgctgctttccggggggtag

SEQ ID NO: 2513 - DNA, 13981 bp, Homo sapiens
atctagcagctctgagtcattctgaaagatgtagagaatacagggactagaagcacttatattctcccaacaaatttgcatacatgacaaaaaacaggcaaaaggcagagagacccaaagacgggatttattgggggcccagtcatcacctggaagtcagaaggcgttgaagtatcgcggggatcttcatgatgagcaggaacagggctcatcatggcaggactgtgatagagtcagaaactgactctgtgacctggcgcacccactgcaggtacggaaagttcccctgttccacaggcaatgcaattacctcggccacttcgtaagggtgcacagaactacaaaataggtgggtgggggaaggggatcactcaaagatttacccaaaagaacccactcccttacacgcaagccctagactgcccagcaagtcacacccacacagtacacaccctcaccccatccatctcaaagttctcaccgaacaaaatctgtcaaagctgggaccaaggaactttgggttttaatcatctaagggacaaagataaacatggttgaatcaaggagtgggattgagttcagtttctcagaagaggggtaagggctaaaggggtcagggattggggatattttgttgggtgggggaaatgtttctcaccatcagcacctcactgtcttcctcgatcttccctttccactcatagctgaaaggtcagagggggagagttgtggggagcaaagaatttcccccaggaaagaggttcccagtcagctcctacagttaggttaaccccccaactcctatgactcacatggatgtaatctgagggatgaggttgacgcaggctgctaggcgcttctccaccacggccctggagtgaagagacagtcccattcagagtaccccataaccccagtttttgtactggcagcccagagacaggcttccagagctggagaaaggagaaagcagcactcttctgccccacccccaactgtcccttcatgatcatcctttctcgctgcacatcgaggtccctacctggcgatctccttggcgaccttctcgttggggcaagtaacaaaggctgcagagaccgagcccggaacgtagccagagccggaatccgaggccggcgagggctgggtcggagggcttccagaggccatggtcagcaagactcggggtagcaacaaaaggcgggaggccacaggcagcagcgccggcatccaaacaaaagacaggagcagagaggcctgagagcaggaggcgaattcgatctctcctcacaaacagcccaggaaattacacccggggaagccttcgcttagatcctcaggctctgccctccctctgatgcacccccgaagaatgcccctgaaggtgagagagaaacttggaaaataaagcaaaagctcatttcactcacacctcagggggccaacctctgggatttagggtgcgggtagcggtcgaggcttcgaggaccggaaggggcggggcggggccggtcactcaccactccgccgagcaggaccgcgggagcccgccccccactcatgcggcctacgctggtacaggagagttgatctcaaaggccacacgtcacacggagaaacaaccccaggaagagcggcctcttcttacctgggtggcagccacgtgattagaaaacagcgcgcaccatgtgacagtagaagaaggaccacctgcgcctccagagccagccaatcccgaccctatcatggcgcggtttgcccacctcctgatgaaggaggagccatgggagacttgaccaatcgactaccgcatctgcagacgtgcgcggaaatggcacgcccgtttccgtgtgaacccgaaactgccacttgctggctgaggagagccgctgcggcgttccactgtcacgtgagggggccggtcctcttcggcggcggcactcagtgagtgacgccaagtggccaatcacaggccagcctcgcaggccacgtgaggcgagagctggttccaggaaaggggggccagagaccccgcagagtcgatgcgtcaggctgtggagtggggaatcatccttaaaccccacaatgtgcctagtgacctcccctgcactgtttccgaggtcttaaggagtgggagggtctgagaaggacccttcaccccaaactcaggggttaagagagcgccccctgcccttttagttgggcagagatatgcctgggtttgggaatgaacaacggtgatctagaagcccgctgtccctgggtagcagggagtgattaggcaggcacgggcatggcaagacaatagctagctgaggaaagaagcattttaaaacagagcgagaccctgtggtagaggatggtgaaaatggggcctagccatcttaattgaaaacccaaagcttgagacagactactgaatcagagggaaggagaacgagggctgcaggatggggacagtggtgatggtccttctgtcccctcttccctgcctattccactccccaggattggtccacctctcagcctcgggtctcctttccctaacccatcccccaaggagccaggacctgccctacataacttccctggggcccaagcacatcctgtgacccaaaaatggagagaggggccaatgagaggcagagaggtgggaggaggtgcagagaaaaaagctcttgccactgcccccacccaatatttcccctcccttcaaggtctgaggtcattggtctggtggtggggatgcctcggagtttcccaggctgacgtcagggttatacctctcggaggttctagggcagggaagtggggaggggaggttccctgagatctctgtctttgagtttggagtttgtctctgagacagatttcggaggggtctttcagtatttgtgtggagatctttcttaggattgagtttccttttatgcttctggtttggggggtttctatgtttcagggtctgtggtcgcactctgaggtctttcgaagtcttcttcatgaattttgggtctctgagttgtccatctccggaccagctgaagtctctatctccccttaagtcaggagtgtctctgtctctaagttatcagtctctgagatctgagtctggggtctctttctaggtctgagttctctaagctctaattctacatctggctctttctgaatctgggcctcatctttttctgagtctaggtctcaggtcctggtccctgaaatcatcatctcagggtctggagtctaagatatctgtaggtatggagaaccctttttagactggattttcagattttgatattgagcttctctctctgggggatctggggtcgttttttcctcaaatcaggagtctcttttcctctagattttggccctgtgtctcaaattaccccacagtggggggtggtgaagtatctttctctgtgggtctagggtctctctgtctcagggtctggggtctgcatctttaggacctctgtctctctctggtgtgtttttgagtcaggggtctctctctctctcacaatctgggcctcccggagtaggggtgggggctgcagagtctctccctcctcctcctcctcctgctctcttcgctctcgctcgctcccccgccccccctctctctcggctgccgctgctgccgttggctcttattctcctcctcctcctcctctctcctcctctctgcttctctctgctcctctctcctcctctctcctcctcctcctcctccacctcctcctccttctccccctctttctccccctctttctctcttctttctcccccgtccccccgccccctccccccaggcctgatgagcaggtctcgagcctccatccatcgggggagcatccccgcgatgtcctatgcccccttcagaggtacgtggtggggggagggggagggccatatggggggcaacagggggaggggcagggggcgggggagagtcggggccgagggaagggagcggctgaaatggagggagaggggaggaccgggaaggcaggggtgggagcaaccgggaaggagggattggaggccagagggataggggtagataagggatggaggggccaggaaatgggccttgaaagggggctgaagggaaaatgatgaaggggaaagaaagcgccagaaaggggtgggaaggtagaaggattgggttggggaaaaagctgcagaaataatttgggggtgggagctgagtgatgaggaaaacatcaaggaaatagagggacagagtcttgggagaggggctaggaaggagaaatgaaaacataggggtgaaaagagaagccaagaagatgtggggggataatttggtgggggactcagagtatggtaaggggcggaaaaagagaggaggatggagggagagaaggggccagatggagagagagggaggcagtggggggtggggggatggagggtccagatggagggaagagagaagagagagggaacggtgggggaggggagaccagggcagggggagggccaaattatgtgtgcttgggggggtggcagtacaagtaagatgaaatgatgggagtaggggacaggttaggatcctgccccagactctgaccctcttaaaggctcttgaccagtaaaatgtaacctctggggtcttaatgctgtcttcacttcatcacttttacccccttcccccacccctccaatccttatttccattccccctccctcctctgctgtccatcacctatatctttccccccatatggtgtccgttccttatatgagtcccccttctgtccttcccctatatcagtcccctctctggtgttcattgcctctctcttatctcttttctatgtggtcgctcccttatatctctatcacttctttactagtccgtcttgaccccttctcatagcctccgcattaggtctgcctcctttgctctgacacatgtccagtcgagcccttcaggtgtattcccttgcccctgggcatttaccatcatttctgcctccttttctatctactcctattatttgtctcccagaccattccttgtcaccacaagtctgtgcctacccactttcccttaatacctcaactcttattatcatttctcttttcttgtctcctctacttattggggtgttggagatttggggtacaaagacacaggttttgatgattagaacaagggatccccatctcagcccttgagggatttctcatcctagtaaaaatttcccgtttctcagccatgttgctctgcctcttgcatctgcctcccagaatcattcttcaccaagtccagacagtatgtgtgtgtgtgtttctagagttgttcctaagttccctgctgccaggagaaagatgccctctgaagtctaacccgcctcccttggctgcagcctgaaccagccctttccccaaatgcttatgtgtatcaacagatttctcctctgggtataccaagtgtctaagtgcggtgggcatgttgcctgcaatgtctgtagtttcagaggctaggtattggtgatctctgtatctagagaacattagttagtctctgagatgggttgagatagagtttcaaagtatgtggtttctaaatggtggacattctgagggttcatcgctcactgtgatctggaggttgggtaaatttgagagacatatttatagacagaaaagggctgaatttgcaaaactctgctactcagtgcattctgttggaatgaagctcaaagaccagttctcctgcagtatactcatggttatcccataaaggtgacagagtttgatcttttttccatctaaaatctgataccttaagcctaatttctagctctttgctgtcgccaatgtgacatctctcttacttcaatagggcctgtgtggcattggggtttaaaggagaggcagtttgcagggagagcggcatggcaagaacaacagagctggggaaggaggaccctggtctcatctcagccataggcgacacttggtctactgttctctcttctcaaagttttgttcccatctccagctcttgtctttggaggcccctctgtgtcaccaggcctggatattccattctttccccctgacatctttcttcctcaagctcctcactgtgccttgagaaggctcctgacctatggagtggcttccatcctgtccactgagactaggtggggtgaggtggtgggggcagtgttgaatctctgggcactgaatgggagaagagataaatttggtctctacttgtccaaacaagggcatatttcccaccttctgccctggggcctccacagccagatgccgacaaaagccatcttctccttaccaccagaagaaccagaactttccctaaaggatgagcagggttgaactaggggaggagggcacagaggagggaagagttgggaggggaggccctctcatgtctctgactgtgaacaggtaagctccccgacttcttcttttctagatatttagccctcagaatctcatgatcccaatgttcctacacacacaccccatccttctttcccacagccatgtagctttcctcatactcttttatagaggggtggtgccaccttccaagtccttgtcttctgcagctatttggatgccttcctctacccagatatctgacaccaacttctctgtttttctcctgccaattttgcggcacctctaccttattttcctgaagtagatggagagctccttcatctttctctgcccccaaacgtgtaccttctctgtcatataattcccatccctgaacctctgcatttcttcccccaagtctccagagccttctgtgatgtgatcctctcctcttttcccctttgtataaatgcttgtcttgtgttcctttagagttgccaggtgtctcactttcaactgtgatctcctgaaggccggtagggtccccttctcactttgtggactctcttcttgccattttaggcctctgcttccaaatgcatagagcctcccttactgtttctgtgtgtctctgtcctccagatgtacggggaccctctatgcaccgaacccaatacgttcattccccgtatgatcgtcctggttggaaccctcggttctgcatcatctcggggaaccagctgctcatgctggatgaggatgaggtgagtgtggtgagaaggctgggaaaacgcatgtgggagaatggggagagtcctcattagtgaaggggagagagacacaaagaaggcagacaaagaagaaacatttgcaaatggcaggagggtggccattgagacttgggttggagtgtgacaagaggggtagtcattctctcatcttgggcagggagtctttgagggttatgagctgtgttggggaggagatgtggttctgaagatttcgggggtggggaggctcctgttttcacactgtccatattgtaggataggttagaatggggaaggggaactgaagggtttggagaaggggtgaagacatggaaggccctcccaaccaaagcaatcctcaggacccctctctgctttgcccactgagcaagactcccagtcctttctccatcagggggcagagtgcaagaagagaaattgcaggacgcagagaaaaggcaggggatagaggaggttttaggtagctggaggatactgggaaagaagactgaggtcagtggatcttggcatgatggggtgaagactgggagagtgattgagatcaaggtttagagagacactgagagggcttctgcaagggagtggttggacatcaggaaggaatataagggaggggaactgggagtatgtggagttatctaaaggagtacaagtggagtaggggcagggactagccagagtaaaggagatgaaacggacagaggcctcttatgggaggtggtggccaggtatggagatctgagagccagggaagtgtgggttctgatttgggagctgggtcagcaggagtgtccattggaggaaatagaggataaaaactggaatggtgccccacaagtgtgagtcagggaatgggggtgatttgggggacaagctttaaaaaatggtagggtagcctggaaaaccaaacgtggtgagagatggaccctgaaagttattgggaatggtgtgatgaggaagggttagaatttgagtcagggctaactagagtgtcaagggacctatgggggcaggtgagagtgtggagagatggctgggtagacagcttccaggccacagagtaaagtagaggtgttaaggagaggatatggtgactttgaaaggagaggtggcttggggagtctaagttttggacaccattgggagacatttgagtgactgtggtcaaacccctagatcaaggtttggagtctgtaggagaaatgggggaaactggaacccagagtggggactgttatagggatgaagagggaagacaatggattggggtaatgaaggaatgacagagatagggacagactgaagggaccagtggccagcaagttgaggggcaataggaatggccggtctggagcaggaagggcgtgtgtgtgggaggaggagtagatagaattgggaaaatgagcagcctgaacagacgcagggagttggaattggatgggtggtggaactggggctgggggatagtgaggggtctgttcctgtggctctttgtagaggtggaggagactgcaggggtggaggtgtatggaggtagggatggaggtggacagggggagctgggtgtgaagcttagggaaaggtgatggctgaggggaagaagggaactgagagatgctgggtcgggtgatggaaggagatgaaaggtgggggaaggtgaccaggccctctggcgggaggggaggttgggtcccagtctggccgcaagccgggccgtgggagggagacaagctgtggatcctgattataaatgcagcttctgctacccccgtgacaggctcggagggagagaagggggtaagggaggtgggaggttgggaggaaagcagggagaatggaggaactgaaggtcaagggaaaactggattcaggaagtagctaacttctgaggagttgcagaagagctgagtagggtttgggagaattctccggaaggtgtttcaagacaaatggagggagaaaagagggtgggacggcaaagaatgagagagagagactgggggagagaagggagagatccagtcaccaagtgtggaggggccggggcagaaaaagtgggcaggcttagggggaaaaggaggcccgcccttcctgggaggaggcggaggggggaagagggaggggaggggcggcgtgggccagggaggtctgacacacccccacctcccctagatacaccccctactgatccgggaccggaggagcgagtccagtcgcaacaaactgctgagacgcacagtctccgtgccggtggaggggcggccccacggcgagcatggtacggcggccgagcaggctctcatgacccggacaggcgcggggagagggctgaagatggaccgggctggcggggcgggggcgtcggggagcggcgggagctggccgggggcgggagaaggcggagacaaagtcttgcttcccgaggggagatggcgccctcctctggaaggtggagcgggacaggggctgtgggtgagaggcccctgtgggtcctcgctcggcttcgctccctttctcctctccagcagtgaagtttgactattttcctggtgcttgtaaaaatagtctccttagatctttagcttccagtccgtgtgttcctgcccctgcccctcccagcccctggtctgggatcttggaaagaatgacctagttcctgccctccccccagacctcttccccacccctatgctcctgattcttcttccggaccttcagtccttgaggtctccttttattaccccctgttttctcctctcatcagctgcttctattttctgcaattgtatcaccctttctctttcctccctgatttctcttattttctgtacccctcttgattaccccgtccctcccctctgctcccggcgaaagtccatcagactcccatctcatctcctttctgtctgtagagctatctgcgcggtctgtctctccaactctctccctctctccatctgtctcttcccctccctccccctttctgcccccccaaccccctctttagtcatttaaaaaaagatttttgtcttcctgagaagttcgcttaaaaggtttccatgggaacagtgaggggagatgaaggcagagaacagagatctgcagccaaggtgcagagagacgccctcagcccccggaaaccccctcgtcactgcccccttccacttcatttcccttcccggacctagcgatccaggttccccattcctccaacccccaggtgacccctttttcccaccagctccccctcccttcaggaattcaagctaccagtttctctcccttagagagccagtgacctgtccccatcctttggctccttccagccttctgataggtccaggccctactagccttgtgggccggtttggggaccttgggtgggtgggtgggtggtcagggatgtgtgtcattgtcatggaaaccccataccatcggggtgtgtgggtagcacatctctgtgaggcaaagtcaggtggtggtggagtgtatacagagaatgtgtgtgatgtctgtcacatctgtgtgtatatgtatatgtgtgtatgtcatgttcatgtctggggaagatgtgtgtgtttgtgtgcatgtgtgtacacctgcgtttccaggccagaatggtcacatgctcacagagcatgtttatcatgtgtcctgtggttggcagatctgcccacttattccccatctttctccttatcctgagtcctcagggtctaggggtctctggcgggggtctcccgtgtgttttgggtggggacaccgtgtgtgtttggagttgaggtggcatgtggaggttgctgtattggggttcagtaggggctgggaggggttccaggggcatatgtatttggggggagggcttagtgaaagttgatgggggtgaacgtttagggtcttcaggcagacatggaatgtgtaaagggcatggaggatgtgcagtggacataggggtcgttgggaccttggggacttggcaatgccaaggtgtttgctgaggctgtggactctccagcccgggagaggtcgccggacctttgaggggcattggaatcctgggctcctcctctgctgggtggagccgcgaaccctcgttctctccgcggttttgtgtgtgtgggggggtcctgctcaggaggggatggtgggtggcctggtttgttttgggggtccccttgcccccctcccccgtctctctcgcgctgtctccgggcgacagggctcgtgacagaggcggccacggcagcagcggtcgcctagcaacggcggcggggcccgggcaacggcggcagcggcgggagcggcggcggagggagccgttcccgcggccgtcaccgcgcggccgtcccggccgtcccgggccccgccgccgcccccaccgcgccgggcggcgcgagccgggccgtaccgccccctctccctccgcaccccgcccttcccccgcgcaggggcggggcccctcccccaccggggacacccctggcccccccggggggcggtgcgaggtaagggcggggccgggcggactaggagcgcgcgtagaggggggggcgccgcgcgcgtggggcgggggcgcgcgtgtgcgtgggcgcggggaggggggtggggaagccgcggtggcggcggcggcggcggcagctgctccctccgcatgttctcgctgcatcttccgagtggggggagttatggtaaccggagggggacagcggaggacgggagggtcggggaccggcctcgtgcggacagggtcttgagcacgcgggggcggccggtgtgtgtgggatcttggagcccctggtggaaggggcagcccgtgtgtccgcgtgtgtgttcgtgcccatgctcgtgtctcctgtgtgtcggtgccatgtgcacacgggggcccagttcctcgtgcacacatgtgcagccatccttgtgcaagtgtgtcctgtcttatcttgcctctgcctgtttcctgcctagggggctgttgggccagccacgggcttgtggggcagtccgcggccttgctggtccatgtcacctctgaccctgagcatgcatatccctggctggggctcacctcctgtcaggcttctgtgtgtgggaatgtgtggccctatgagcaggattttctgtgtccctggtggcaggtgtgtgtctttgcatgtgtgttccagcactggcctgagtatctgtgtcaatcccagcatgggtgtccagggcgtgtctggatgtgggtggtgtggctggggggagtaagtgtgtgaatgtgttccttggaattctactgtgtatgaaacacctttgggctgggcaggtgtaagccctgcttggtcagtaagtggggacagaaaagcttaaaaagggaagaaatggggtaaagaggaaaagtggggaggggataggagagaaggaatgagagaggcttgaagaagagagcagagagcagcaggccagggagaaagaatagctggagaatgggaatgtgggagaaagccaagccagacttagaagagagaacaggggataagagcttaagatggggaactggatagagatggtgggagaagaaggggtctgggagctggggaggcagtggggaggagagagtcaggccttctggtaaagtgatctctgaaagaagaaagggaagaagatgggagaaggcactggattcttgtaggccttgcaggatcaggcttggttttggatcagggaaggccactcaggcatacgggctggctcacagtgaggcctgtcatagcagggactgtcattagaggttcatatccccagcacagagctctgtctcccatttctctgctctgtgtccaaccctgttcttcgcccttctctggcaacctccctcctctggctccccttgagagctgccagctgggtgtggagaggaagaaaggccaaagggaaggttagggatttggagggcagggggagattctgtgggtgatggcaagattagagatgttggaggggcaggagtccaagcccttgctgtgtgtgtgtgagtgccattgtgtgtgtacacagggtgtgtacatgtgtgggtgtgtgcacaatgcctgtgttacgggtttgtgtaggtggctgttatgtgtgtgcatgcgtgtatacatcgtgcaggcatgggacatggagacccaggatcacagtttgtgcttttcaggtttgctgtgtgtgtgtgtacacgggtgtgtgttgttttctctgtacatgtcactgcatgcagcattaataacaggatgttctgtgtttctgtcactctgccccccctttcctctgtgtttctgctattcttttcctgcggcaacaaaagtgtttaataagcatatgtgtatgtggcctctgtgtacctgtgacttatgagtgagttcatggatcttagttcttggtaatatgtgtaaggttatattacttccaagaaccaagcaagccaattagcaaatttgttcttctgttaatgctttagttccaaagcggaattttaatgcatttaaagttagactttatgcctttattagatgagcttgcacatgaaaataatggctgagctcggttccctgaaatgagagtgaggcagccatacctgagaaatgcagaaaaaatgttactagggaagagatatcctgaaccattggatgcattgcttagtgtgtaccagaaggataattaacacatttgctcctggtttttctttactctggtggcaatctcggatgcctgtgttagagtgagagaagggctgggggaggaaagggggttgtcctgagacagagtggatgtggttgtac

SEQ ID NO: 2514 - DNA, 24286 bp, Homo sapiens
ctgaaatatttcatagcttgcctttatcttactcagatcaaaattgtcacgtgataatgattggcttaaatgtacttacattatacaacacagtagtatttttgttttgtttatttagcatgtaactctaagttctttaggctctttgtgatattttcattttttgcaaagatactaaaatccttgaaaaagtgaatgttaccagtaaagataaatcgttatcgaactaccattccaacagagtatatcataggaccggtaaaagaattggatttctaactttttaaaaaaacgatttttacatttgcttactagaattatgtgtctgtagttcaaagaacaagttcatggagtgtgtgtctgtgtgtgtgtgtgtgtgttttggcttctgttacaaaaaatatgattacttaacaattataatgttatgatcctgaagatgatggagtcactgtaggaaaaatccttcagtgtcttccataggacagcagcttatttcgcctccatagtggaccaaggaactgacaaaacactcttttgtttggtttttatttttcttagaatggcttctactcacaatcaggttaggcagaccacctggtgtctgcctgtgaatggggatatttatgagcagtctgaagcagttcttaagtgtccacttctttgatagagagagactgcttattccaagctcagacattacttttctctcagaaattgcctgccaacacccccctcatagtagaatgactaattatgagctgcagtcttaacatttttcattgttttgacgttgtatgcttggcagggtatagggtagctctttacttcttcaggctgtctatatttatcaaatacagtgtagatgcctttataatattaaatatgtgatttgtaactcttactctccaatttctatcaataaagcacagctgcttagttacaactctggctggattaagcagtttgttttattttgtggctcactagagtaatttgaaacaatgaagatttaccaaggatataaggccagatttttgcaggtgctgttgtgtgttttgtaaacaaacattcatctttagtggctagatatcaggcaggtccccccaaatttctggtgtacactagagatcagcccagatgtttcttatccggggtgggggtaaagagagggtgaccctaatgatcatgctcaagagtgttatgtttggctgatccagtggttctgactgcctttgttccaggcagtgtgtagcagtttaacagctcctttgaatgtgttagtgaatgaatgagagagtaaaagttggggataaaagcagaaaggtggtggcatgataatactggagaacctgcgtgagcatattaattatatgggtgcagtatgccatgtcaaggcagctgctgactcttgacagatcctattaaccccatgtttttttcttcttcttttgaggtgatcttcttagtagaaatttaattttaacctctttcttaaaataaggaaaactaatcttgggtgtcagtcacattcataattgtaggggcaagcattttagaagaacttaactgttttcaagcactaaattctcaacctgagttgtcttcagcaacctaaggtattaatatgtctaaagagcccggtctcttggtttcttgtgcacgtagtttttgggtttctattaatgaaaggttctggaggttctagaataaaacaggtatacccttttggaaattgcattattaacatgcagtgatcattatttcttcaccatgttgttggaaaatttaattttgcagtgggaataaaaaatgtttaagaattcaattgatgtttattaattgttgcctatatatgttatgtactgtgcctggggaggggaaatacaaagatgagtaaagcaggacctcttccttaaatgaaattttagtttttaaaaagccttttaatgagcacaaaaagccctttagtgagcaaaacaaacacagttagtaagtaaaatgagtgcatgtgattttttttaaaggaaactatcaaattattctaaatataaaaattttaaacgaaatttaaaacagtgagacttggccgggcactgtggctcacacctgtcatcccagcactttgggaggccgaggcaggtgtatcacttgaggtcagaagtttgagaccagcctggccaacatggtgaaaccccatctctactaaaaatacaaaaaaattagccgggcgtggtggtgggtgcctgtaatcccagctactcgggaagctcaggcaggagaatcgcttgaacctgggaggcgtaggttgcagtgagccgagatcacaccactgtactccagcctgggctacaagagcgaaactccatttcaaaaaaaaaaaaagagactcttatctttcttatcttgcagaagaaaaggaattttaagtgcagattttcaatggttataattttccaacaccagacaaataatgaacacaaaatatatgctgctgtaagattatattgatagtctcacagtatttctcttcagcattattatctgatcaacacatatatgaatggaatagtaaaacttaacatttatcatacacttgttatgtacttatttcttttttattatcacaaaagtataagtgtcctcaatttaaatgaggatgcacagagattagtaaccatcccacagttaacagaactaatagtttagcagagcctagattcaagccaagcagtctgatcttttatccaacatttcctgagttcagttattcttagctgccccttaaccccctaataggttttttttgttttgttttgttttctgttgagtatggtttggaagaacctgcaaaactctatctaaaatgaagggatacattaacttttcttcagactaatattgtaagagaaaaaatttaaggaaaaatttggttaatttaattatctaaatcattttctgtatattttccttcaggttctttatatatatgcatatttttgcagtgtataaatatatttgtaaccttatattctacaatatgagacatttcccatgtttctattttgttttccaattattttgaattgttgcatattataccattgacctaatttattcacatttgctcatcttttgggattgttttggttgtttcagtttttcattattatacataacatagtaatgaacattttctgcatagcatatttttcttctcttgaattatttttgtaggatacatttccaggagagtcacatgtactctagaacttcatatgttagtttgtgcctggcagtgcctttattatgtgaattaggtagggagaagtaaatttgcagaataaaatgtgttatattccttgtaaagtcatttttgcattatccagtcattttgcatataaatagtagaaaggggtttagttatttatactgttttcttatttccattggggaaagtaagaattggggagatacaggcaatattaaattagaagtgctttaacgtatcagtcttcttcttcggcatagtcttttagttcctatattttcaggagtatggctggtatatgattccaggccctacaaagaaaatgagaatggaggaaagaatagcattgtaatgatagaagagggttaaggaacacctgttgactctgatgataagaattatgatggatttgtcattcgtacagaaagctaggaacttagctcagatgcatgcatagtgtgagagacaagactcaaataaaaatacacaggtagttcatatcactagagagccccaagctagtttctacttgaagttaagacagccactgcaaggagggagggatagctgttggggtaagcttgggagcactgtgaagcacttctgtggtcccttgtgctcctgggtgaattaactggaggtgctttgctttcctcatagagggccatgaccactgtttcattcatcctttgaatcctagtgtatacagtgcctgacacatagtaggcccttagtaaatgtttattcgatttagtagaattcataggtccgtcagctttgaaaagagtggctagcacatgtgcaattaaaattgtgctagagaaatagaggattattgggcagatgcaccagtttggtgggaagagactttggtgacttcagtggataggtagcagaattggaagattgttcaggaagaagggatggtgttaactgctatattgaaatttcctttgaaaacttaggttcacagaaaaacctgcatatgaatgtttatcatggcagctatattatgatctccagaaaatggaagtaactaaagatgttcttcaataggtgaatggataaacaaactgtagaatattattcaactgtaaaaagaaataggctgtcaaaccacaaaaagacatggatgaatcttaaatgcaaattacaaagtggaacctgattcaaaaaggctgcattctatataatttcattagtatgacatggaagatggaaaactaaagtgatagtacagagatcagtggttgccatgagttcaggaagtgaggaggattgaataggtgaagcacgggggaatttttagagggatggaactattctgtatgatccagtggaatagtggctacgtgacagttgtcaaaacatacagaacttttgcagcacaaagaatgaattttaatgtgtgaaaattaaaaagaaaatgtttaggagatcccaggatagaatgcagaatgttttaaaaacagactattacagatgtatgaaacatctgtaatgaggggggcgggagggggagagaaaaaaatgctgaactaagtaaatttggaagtaagtgaattctgaaagactaaaggcaaaagaacctgcacctgagtattgtattctagctgatgaagttgtttttcatgggtgtacaggttaacagttctgatactgttatacatgtatactggaattgaccaaataaataaatggatggtggaagccagatttctcattgttggggtgggtatttacagaagagtaaggggaagaggctagaatggtccatgtggtaatgaattagagaaggatatatcagtaatgtggatacttaatgtggatacagatggttacatatagaaatatttacagagatgaatgtgtacacagattggtatacacatatatttccttgctctgtctgctgagagggcctagatgcagcaaacagtgattatatgtagcacctagatcctggtttctaataaccattctccaatagaagcaaccagggctcttggagaagtggtcagttctaggactggagtaggaaatatataaattgagctttgaacatattatagtgccaaaaagtaaagtgctttaaaaaaccccacaatgaagggggcatgtcagagggacacaggagccagctgaagagctcccagtggcccaagctggaaggaactatttgaacaacaaaataaaatactaacaagttgtaacccgaaatataaaataaatatccatgagtccatactgatatataattagtgatagataactaaaagagggagaaagagataaatttgccatgtagcattccaaataatttatgtagctactctgccattaaggagcaaggggagcctgactctctgttccttaagtgtgggctgtgctgtgacttccaagtgtggaaagggagggaaagtaactttaatggagaaacctgacaaacactgcctcagccaggtgatcaagattaacatcagcagtgataattcatattgattgcatatacccttgatatggtgtgatgagaatggcctctgtgatcttcctccaatcccattaatccagtttaaccatgagaaaaatcagacaaacccaaattgatgagcattgtacaaaatacctgaccagtactcttgacaaatgtcaaggttatcaaaaacaaggaatatctaagaaactatcacagctaagaggaacataaagagacatgacaactaaatctaatgtggtgtcctggatgagatcctggaatgggaaaagaacatcaggtaaaaactaaggaaatctgagcaagtgtggactttagttaatagggtgtcaatattggctcgttaattgtaacaaatataccatactagtgtaagatattaatgataggagaaattggctcctgagtatatgggaattctctgtactatcctggcaacctttttataaatctaaaactattactaaaaaataaagctttatagattccattgattagaaggaaaaaataaataaagcttttttaaaaaaggaaaatacttctgggtggcacaagtagaattgcttttacttatccccctattggagtttaaacaatttttaaaaaaataaaagcaaattcagataccaaacaaaccaaaaaacttactgtgatgatcctgagaggttttgagatgatgttgatctcagattgatattgatcatttgcgagacccatagcaccttccattaattaattataaattcttctcatctaattctgaaattgagaaactgtatttcccatgccctccaaacaaatttgtgaaagagcgaaaatttcatagatcctgactgtatttattagttcattcttatactgctaataaagacatacccaagacagggtaatttataaaggaaagaggtttaatggactcacattttggcatggctggggaggcctcacaatcatggcagaagacaaaggagaagcagagacacatcttacatggtggcaggcaagagagctcgtgtaagggacctcccctttatgaaaccatcagatctcatgagacttaacttatttactgtcaggagaaccgcctgggaaagacctgcccccatgattcagttacctcccacttgtccctcccatgacacgtaggaattattctctagtaaaacaataaattagatcaaggatgctaaactctgtattcacctaatatatcaatatttagactaaaagaaaagactaaaagacaaaaagaaaagatatcagaccaacagccataactcagttctcttgtgtgtaactactttttactcctagagacaaaggagttgtctttacttttattccaaaatgagatttgggtggggacacaaccaaaccatatcactgactgagtcttgcgcctaccttctgcttaatgcttctttctttttagaagtagaaatattcatgaatgagaaaattataggcactggaccttcctctgatgcactgaataaagctcagagttcgctctaatcacacttgaaggagaataggttgaagaatgcagggtaatttagaaatgcaagaatgcttgtatatccttttactaaggagatttttaaaaaatcttcaaaataactctgaccacccttagtgtagaaagtattctaactcatttttattcattcttttaaataagttactttctcttgacctggagtaggacagtcccaacttccagttgaataataatcccctagaaacaatgctttgttatttctgacactggttcactgctctcctcttcacagatccattactactagtgtttgaccttctggaaggcacaaggtgctcctgaaatcatagttaggactgggaactgaagggctgatgcaaatgtatcttgtaagacagtctgtgttctgttacaaatgatctccatcctggtgttctttcctgcccagttcatttatttttcctaggatctttgcacagagcagagcaacataaactctattacagtcttatcttttagtgggcttttggccaaaggttcagagctctagaatttagaattactttttacttcataaaatcacagggttgatgttagcactttttttttcagccattaattcatcccttggtcatatgtaaataaactaaatttgtatgatgtagttggtggagtgagatgtctggtttattcagcttggaaaacctctttcagaacatggataaacatgtatttgtgcattcccatagcttccggcaagctctgtagagaaggtcagaggaataaaagtaaaggcaactcctttgtccctaggagtaaaaagtagttgcacacaagagaattgagttatggctgttggtctgttatcttttctttttgtcttttagtcttttcttttagtctaaatattgatatattaggtgaatacagagtttagcatccttgatcaaatttattgtattactagagaagtacatttttaccagtgaaaatacagtcaagtgtgaacattttaaatgcagaaagcctgagattttgtcctattcaataaaacggctgaattatagaatactcaagagatgttgttttccttaagaagatatactataaatattcatgcgtactaagcctatagaaacataaactaggcttagttcaacaataaatacttgcaagctcaatgaagacataatggatacaaagatgataccctcaggaagcttatagtttagttctaaattacactactgtattttcttttcttttttttttttttttaaagaaaacagtttaacatcaaatgtttcccaggtttactttttgcacagtgcatacagttttgggaaaatatgtggttacaacacgatattctaggccagttatgttggctcacacctgtaatcacagcgctttgagaggctgaggcgggcggattgcttgaacccaggaatccgagacaaggctaggcaatatggtgaaatcccgtctctacaaaaaatccaaaaattagcctggctcggtgttgtgcctgtagtcccagctactcaagaggctgaggtgggagaatcacttgagcccaggaggtggaggttgcaattgccactgcactgcagcctgggtgaaagagtgagaccctgtctcaaaaaaacaacaacaataaaaacaaaataaaacaccctatgatagtccacaatttgttcgatgctactctagatcatcctaaaggaaaaagcaatcagtacgacaccaagtctttagaatttcgaggattggttgatattatctcccagtagatgagagagcagatcttattttttttctgtgagcagattcgctggcttcatctgggccttccctatgctaagttcaattattgatattttctttttaaaaagccacataccttgctaacacgagaagagggctggggggaaaatgccacacttggacagaatgactataattatcaaaaccagaaggccatcaacgttgcctccaatgatggtaggcaaagaatgttacttctcatctttcaggaagatgacaatgatcttagttcgttggttctctatattcagcccctcatatagagatttgttgaaaggatccacagttcagttacatatcttggtaacagtttagagtgacccaacgaaatctctgcagccatggttacattttctttatgtgacgtgatggcatagctcactgaatgccattcttccacatgctgaactaaattgatctcataagtgtgcttctgactttggatgcacaaagtgtaggcctgaaatgaaagctattcctgggatgcactgagcaaataaactgccatagtcatctgccccctctcctctataccgctgtattttaatttagtttataataattaaaacagcttgtacattgtattttattataaatgcaattaatgaaatatgagtaaatgaacctttagtattaaaaaccatccataatctttttttttttttgagacggtgcctcacttttgtcgcccaggctggagtgcatcagtgtgatctcagctcactgcaacccctgcctcttgggctctagcaatcctcccacttcagcctcccaagtagctgggactacagtcatgcaccaccacgaccagctaatttttgtgtttttttttttttgtagagacggggttttgccatgttgaccaggctggccttgaactcctgagctcaagtgatccacctgcctcagcctcccaaagtgctgggattacaggcgagagctacagtgcctggctagtccagaatcttaacattgctatttgtatatctttttccttctgccttcagggaacccctcaatcactgcttattactgtgagtttgctctaacctgctgccatcaccttctgtcgtccgaatgaaaaaactaattttttcttgatgactctaatattgtttgaggggcaattcttctttttctcagcttttctcattaatgttgttatcttttatatgaaactgaaggatggccaaatcccattatccagctatcctgggtcagctttctaggttttacagtggtcccttggaggattttaggagtcctgtattttaaaaatttggtgacatggggtttagtgtagaagatgcagagaggccatgggaagggattccagtttgtatcccagaacatggatatattcaggttgagatcttgtgattgtcaaaaactcttgtgtattttgaaggtgatttctgatagtacatatttggtagaatcttaccaaggaggcatttgatttccaacacgtttgctcatagcattatattgcttgccttggtgataccgtcagtgttcctcctctgcaggatttttatttcttttaaatttttcttttcttttttctttctttccttttccctctcccttcccctctcccccttcccctctccccctctccatccctctttaggacagcagtgtcctgatagagttaacacacttggaagtgctaaagctgtctacacacacacacacacacacacacacacgaatgaataagtaggtcttcagattgaacggtattaaatgtaacaatattttcatttatactttgatcctatattttctaaattttcaataatagaatatgcagaatataagtttataatcttcagacttgaatttttagcccaatacatgatgttattgtagagtaggaatggtatggaaaaatgaaatcgagagataattctcaacctttattcttaatcatttaaagtcagaatttttgtctcttccattaaatgtctggctataacacagatcatcatcatgtggcaaaggtatgtcagactgagaaagagagtggcagttcttttggggggctcagtaattagagcttacctaaaacccaaaatgttgaactagaaaatcactgtggtctcttctgattctaaaagttggtgattttcttgacatcacaaattcatgcagttgcgtgtgtgaatagtgagatgttaaacctgtaacaagaagagatagatcttcttcagtgagataatcagcttctgggtggctgagaagtttttatatgagtaagatcaaaaatgagagtctgctcagcagatttgcagagagtctctgataaatttctttagtgccatttcaaaccccaggagctccacatatgatggttttatattgggctctgttatgggcatattctatatctctactctcactctgcagatctgtcgaagcatgttttgataaagagtattgaagtctcaaagatgggttttaatatctttaccaaaggatggcagacattgacagatggtttctaaggatagttccttgcaatcaaatcttatttatagtgccagtatataaaatgagtataggtggtgtgcattattacattatcaataaaaactaacagttgatttccactgtcaatggcatctgacttttctagatcagaatcatgtaatgtggtagaaggagctcttaagtaggattgacaagcctttatctatccttccctctctgttttgagcacttgggcaagtcatttgagctacctgagagactgtttttagaatgaatcacttttcttataatgatggatttttaaaaatcacattaatttattatacagttgttacattctgcatggttaataaaggatgacttgccaagagaaatcttaatttcatcaggtttctagaacagtttttaaaacagtattgaaaacattactatgtttttatacttcttcactgtgtatgaggaaaagttgaccacttgagtgttgttatcaatgtacactaaactagatgtacagttcaggggacatcagcacatatatggacatttggcagatttcttgagccaataattctggtccttctcttttaaaagttcttagttaggtaaccacagataattgaaccagagaagtcgtctcatggtgtgctaagtaaacacagatgaagatagagccagctgacttcagcaactcttctctgcatggtgtgtctctgagacttacattgaagatgtataatatgggttacttttacttcagtttcttgtagttacagcttctgcatgtatcatgccccagaaaaaggtaatcatcttcccattatgacatgcagtatacaatttatagtcttttttgtggggaaggagttggggaagaaagtgagtttaatggacctgaggtaatgtttaataacaggatatgtaagttaaattgaccagctgttgtatgtctctgtgtttgctgtgatagaatttgggatagtgagaaatttcacactaattttattcacactaaacaattctaattgtttcttttttataaaaaaatgtgaaatttgcctaattaagaggctgtcctttttaaattaaatataaatttggtgttcttctggaactctgctgtttcgagtgctttttgtcctcattcagtattattaatgcaagacaacctgcttgcatgcagctaagcatggcttctttctcttatgtataacacagagtgggcagggtgtacaaaactcatctacatccttctcagaaaacttctgtgtaacactgccatgtgctaagcctacggaggtgaggaagagggttttttttttttttttttttttaattgatggttttggctcaagctttggagggacgaagaaatggtgtggattctgtgaaatcacaggatgtctaagttccaagggctttaggaattgcctcatatcgtgcgtctaaatattgcacccctgcccctcttccagtccagactcatccgagaggatcagcacaattccattagtaaatgaagtcacaacttggggattgatggggataattaataaaaagggccacaagtggttccaagtgctcctgcagtcatacacacacatactctgtttagcatcccgagttctcagagaaggaagaggtgtggagaagttatttgaatttgttagttctcagatttttttatcagggtaagcagtttttaaaaattaaagagtgaagagaaagtgatggacatacacttgccaacttttattcatttggacatttaaaaggaaaatcatcaccatagagttataaataaattataacaaatgtaacaatatagcatatatttagctttatgaaaaactgatattgtccttctcatttaactataaaaatttcatcactggctggatgcttggtggctcatgcctgtaatcctaacactttgggaggctgaggattacatgcctgtaatcctagcactttgggaggccaaggcaggaggatcgcttgagctcaggagttcaggaccagtaaaactccatctctacaaaaaatacaaaaatttgtccggcatgatggtatattcctgtaatcctagctcttgggaggctgaggtgggaggatcacttgagcctaggaggtcgaggccacagtgagctatgattgtgccactgcactccagtctgggtgacagagtgagaccctgtttcaatttaaaaaaaaagatcacttagttcgttgtgtaggatttaggaattgctaatcaagtagttataattaacttgaagaataatttaacagtatacattttaaatttaaaactatggtattagcctatatcagctctaagtgaattcttgcctgatgcaagatgtgattcctgcacagccacagaggggtatttttaattaatttaggctcaataaactaaagaagcttttggaaaatttgaacacaactgagaaagcaacccacatcagtttccgtaggtactcacaaagctgggtggtggtgtacattggttatattatttacaaatacaatttttgggagactgtggaagggataacttgaaatcttgaagaatgatttagggccttgttacccaaagtctgatccagggactagctacattaatagcacttgggagctgctggaaatacaggcctcaccccagacctgctggatcagaacctgcattttaacaagatccccaggtgattcacatgcatagcaggtttaagatactgatttagagtacctttctgaaaacaagggtttcagttaggtaactttcacatagcctttgccttatctaattaacaagtgttccaaaaccaggattattagaataaataggttgttgagaatagcaattaagactagccttaaaaaaaggtagtatagaaaggccttgagacctgcattaatgataatatagcttataattagcttatcaattaaatatgcatggctgtatctaaagggcttgaaaactgtttttaaggtttttcttttctatcttgattttatatttaggaaaacccaggtaaactcacaaatagaggaacatttttttaagcaggaaaatatgtaacaatttttgggccaaatgcttaagaagtgagaattttgaaatggaaacaaaagttggaatctgtcttagaagtaatctactccaccccttctctcccagcagtttgagtgctctatttaaagctagaattttgagcatgagaacgccactgtggacaacagagagattttctctctctctcacctcttctctttctctccttctatctccccctccaccaccatctctctcatcttcttccctttgtccccaccccattgcttttttctttctgcttttcctgttccctatccttacgcaggattgttttactgttagccaggttaagtttaagcttcttgaggactttagtactgaaagacaatggctcacttgtaagacctagttgaagagtacagatttagatttgttcagtgtgctgtgatctgtaaaaaaaaaaaatcacaatgggatttctactaatggatatgtaaatatataatcattccttttatgcttacatccagggtttaattaatcctttggtaattaagaatcccttcaaagtttgcttgtgagcatgttgttccgaccagctattagctcctatactaaaattggttgccttgcagacctgtgttatcagtaataagcacctcaaaagtcactcaggaggaaaaccgaatggaagacctgagcagagggaatcttcattgtatacctttttgtgtcttttgaattgagccctttgagtatattaactaatcaaataaatagttaaataaaatttaaagagaaaactttctaaactttttcactatgagtgtgtgatctctgatgccaggtactgttttgtggaaggggagaaaatactaggtttcggtagcatcttaacaagtgataaatgcttttggctttatttctcactgacatcttgtacttctggtggtgtatttcttctttctactgaccagcaagtaagttccaaaatactgctgaatatcaggttagaagagagccagtgtttatttcccaccctgcagtcttcagtgtaaatatctgaaaatggttatattgggagagacaaaaagatcttccaaatctctcttatacatctgttagtctacaagagcttgccaaaactgtattctgaacttttacaggatcctgctataacccagcatacgtagccaccatccagattttgttttaaaagtaggtgtggtttaatttatattgaaggaggtttcccaggaagttcctgggccagattaggtctcctccttcatcttaaactccaatagaaatacagaaacctctctgctttgatctgaatatgttttaagagacaatgttatgactggtggttaccgttgcattttaagttataaacagtatgtagccacttgccagaattaacaaataggttagagttacattacattcttttgaatctgaaattgatattttatcacttgttttggcctttttgctgaaatgagaatttgtggacggtgggggcgcaagagaaaaaaatgttggttccatgtctgtcaggtaactggcagagttaaattcctatggcatatttctggtcgcaaaaacatcactaaatgtctaaataaagaccaaaacacttctaacattgaatattgacataaatgtgaactgtacatatatttaagacagaaactaagcacaagataatatttacccagttattccagctcagggtgccaggtgagaaccagccctggacagggcaccatcccattgcagggcgcactcacagtcactcattctggaaccgtttagactcatcaatgaacctagcatgcatagctttgggatgtgggaagagtacgcagaaaaaaaacaggtgtgcatggggagaaggtgtgaaccatatagacagtggcctcagttgggagttgatttttttccccccttaccatccttctaatgaaatgatgttgaaggaaacagtgttatttgaggagccattgtacaggactttaactgggattttgaaagtttatatctaacactgtcattttgattagattaattcaggtttggtgatatgttgcttgcttttgtcttcagctgttaagtcttttcatgccctggtctatgacaaacatggacctgttttctgtcactatcattttgcttttacgcccccaaccttttttttttttttttccgagacaggatcttgctctgtcacccaggctggagtgcaatggcgcaatctcagctcactgcaacctccgcctcacgggttcaagcaattctcttgcctcagcctcccgagtagctgggattacaggcgcctgccaccatgcctggctaattttttgtatttttagtagagatggggtttcaccatgttggccaggttggtctcaaactcctgacctcaggtgatccgctcacctcggcctcccaaagtgctgggattacaggtttgagccactgcgcccggcccaacttttttttttttttttttttaaagagatgaggactcactgtgttgcacagcctggtcttgaactcttgggcccaagtgatcctcgcacctcagcgtctcaagtagctggcacttacaggtgcatgccaatgactggctcattttgctttttctaaaaattcatattaatggatgtatacagttgtgtctggcttgtttcaattcgcataatacgtttgggactcattcatgttgttttcatgtagtttgttccttttcattgctttccattgcataaatttaccacagtttgttgagctgatggatatttgggttatttccagtattggagtattttaagtttctgtagacctttgagtacaggtctttgtatgaatgtatgcttttattttcttgcataaatacacacagtagaattttggggttgtatgataaagtacagcagctgtatgcttaactttataagaaactgccaaactgttttccagagtggccgtactgttttacaaattcccatcagtagtacatgagcgttccagttgctccatatccttgccaacacctggtgttgtcagtctttaaaaaattttggtcattccactgagtgtggaatgtagttttaatttgtatttttaattttaatttgtagttttaattttcatttccttttggtttgtggatttgtactttgtggcatttatgctaaaagtaccaaggaggaagaaagttgtttttttcttcagattgttatcatcttggtttgtaacttgtatgttctcagaacattatttgattctccacaatcagtagcacaattaattttatattaattggttttgtagttgtccagaactctattacacttaaaacgtgatcaaatactataaattattatatcatttatgatcacacctgatcaattaagaggattcggggaaggtaaaacttcatgtaaatctttggaaaatggttttaacctgtttctcagctaattaaagaatacgtagctatatttcttgtcattctttttttggaaactataatatgaaagttcaaaatataaaaaagatacttaaaattagacatttgatagttgggatatgttatagtactttgaaacaaattctgtaatagtattcagaattgagatgtttagcacacactgcgtcagttatgttaaatggtggggatggggtgtggcaggcagtagtggaatgtagaatgctgctgtatgctgtgtaatgtaagcatctccgttcctagtggagaagttgcgtcgtgttctcaagaagcacagagggagacatttggtaaagtaccaagtagttgaatgaaatacagtacatagcagataaattttgtatatactaacaaatcagtagctatatttgatatcctgggtagccgtatttgatatccaaactattaacacttcattaccctgaagagcttcctcctttctttttgatagtatttttttttttttttttttgagtcggagtcgtgcactgtcacccaggctggagtgcagtggcgcgatcttggctcactgcaacctccgcctcccgggttcaagggattcttctgcctcagcttcccgagtagctgggactacaggtgcgtgccaccacgcctggctaatttttgtgtttttagtagagactgggcttcaccatattggtcaggctgatcttgaactcctgacctcgtgatccagccgcctcggccttccaaagtgctgcaattacaggtgtgagccaccatgcctggctgatagtaatttttaatctttatgtgatgaggtgtgcaggtccagaaatcgtaacatgaatggcagttaaaggcctttgagaaagtaggggagggtgatggatgcatcagcctcggccaccctctagtggctgctctgaccatattgcaacttcagttgatcctcttaagtgtacatcaggagggggaatggctgaggggcttgttgttttttatacaaaattcttttttgtattataaaacatctggagtaatctagaggaataacttcagtaaggagttaccttaaatatcaacattggttatttgggtactaggattatggatgattttattttcataattatacttgagtgtattttctaaattttacgtagtcaactttttgttctaagtcagagaaacagaaaggaagactcactgatcacctctgtgtgccagacactgttatatatatcattcctaattcctaatacacgaatttgagttacattgattagtatatacaaaatttatgtcctgtattttcaacttcacttggggctttaatggaacactatcattcgctaacatttttgtggcacagacttcttgctgatgttgtttaccagagtgtcctttgattctacttcagtcttgcctagtaaagtcatctttctcccttaatgaatatctcaccttctttcgggaccactcaccagtctgtgaaccttcaaaacaaatacattccatgttcttattcatgttgacatatgtttgatatagtacatactgccgtctgttgtagttatttgtgtgtattgcctatttcctagctttgcatcctacagccccagaacaacacatagaaagcacacagtatttgcctaaaaccatatattggaagcttctacctgcctcagtttgtgatgtaatggtatttgacttattttaatcagttgcttggcattgtagcacattttcctagaaccagtatttcaaatggtgtgtaggtgcctaagccctgaaatactggttttaaaacttagccacacatttaaaaactggagagttaaaaaaaaaacaaaaaaaacctccaatgtccaggttacacctcatacacgtggaatcaaagtatttggaatggaagccaggtatcagtatttttaaaaaagacaccccatgttatttggatgttcagcaaaagttaatgaaccactaccctatttaatctatactgcatgggtactaaagttaaactcctgacatttaaagttttgcttttggggaaaatacttttctcaagccagatgcaagaggttttgatggcataagacctacagataactaacaggcttatttaagcccaggtatttattgttaaaggaggtatttgtccaacttactctcaaatagttcccaaaaaatgtttgcaaggggagagagagagaatgagaatggtaaagcaaatgggggcaaaatgtaaacggttgctgaattctataaaggctgtatgggattgactaatattagtcgtgcaacttttttgtaagtttgtaaaactttttaaaagttttgttaaaaagagagagagaatttgttaacacagataaatcactaattggtgaaatagtagagatttttgtttgtaattttactttattattattattattatttttttttttttgagatggagtttcactcttgtcgcctaggctggagtgccgtggcgcgatcttggctcactgcaacctccacctccctggtttaagcgattctcccgcctcagcctcccgagtagctgggattacaggcacctgccaccatgcccagctaatttttgtatttttagtagagacggggttttgtcatatgagtcaggctggtcttgaactcctgacctcaggtgatctacccgcctcagcctcccaaagtgctgggattacaggcgtgagccaccatggccagccctagatttttgtttttaatttttaaaaatattggagtgcacagagtatatctggcttcaatcatctcttttcattcatgttgctgtttgactgaaatcctctttctcctggcggatgggattggcgggtggtcctattttctaaagggaggaggcatttcctatttaatcttgaggatacagggaagatggtatagagttaagcatcaacccacttctctgtctcttctttttgcctcttctttctgcttcattggcacaaaatactgtttccattaagatgcttaaaagtgatgcaggtgcagttctgcaaatttagaaaataatcattcgttggaagatacgttagatcgtttaattttaacctcctgctttttaccaatatgatgactaaaccaagactggtagatgtaaccttatactttatttaaggtctacaaggaggaggagtatatattttactgtttctcttgttatctagaatttaacatgggatatttacctttagggaaatcttttatattataactctgccctggatgcttagttagttaactgtgcttttgtagtttctttaaggattgtggctagtaattatgaaaatatactaaatctcattactaatcagagaaatgcaaattaaaacaaaaatgaggtaatttcacaccattttattggcaaaaattaaaatgtctggcactgccaaatgttaatgaggatgtgtgggctctgctattggtgggtgtaagaattgaatactgccttcatgaacagtttggcaatatttgataaaggaggcattccttttggcctgacatttctaagtctgtattctggaaatgcttgttcaaaggagtcaggtacaagagtattcatcatagcagtgtttatgttaatggaaaacttagaaacaagccaactctccagcagcaagtgaatagattaattgtggtttgttcataccctagaacactatgcagctattagcaaggaatacatctcaaaaacatggttgaattaaaaaacaagtttctgaatgatgtgtatgtatgacaccattatataaagttgggcaacttgcaaaatcttgtgtttgtggatacttatttgtagaaatagtattaaaacatgcattggaatgcaaaccctgaaccaaatttaggatagcagttacttctaggaaacagagaagggtataggatttgaggagtacacacagattttcaacttgacctgtggtgttttctttcttattaaaactctgaagcaaatatagtgaaatgttaagattagacaaagctagctagtgggtgcagttgttgtgttattctctgtaactttctgtatatttataaaatacatgattagatacattgagggtagtatgtttataatgggccatacattcagtcaccagtggtaacatagaacagcagactgtgtcttgcagatgagacctaagacagtagttccttagacagtagttcagaacttaggttttggagtcaaatatacctggattaaattacagcttatccacttgttagccatctgactttgggctttagtgtgcacatctatgaagtaacaatcaaacttacctcttagaggtgggttgtgagattttaaaaaagtatgcttcaagtaatacccactcaatatatgatagcttcatttagcctttaaccacctagattaaataattcttgtttcaaagaaccatacttcagagaaccatgggacgatatgttacaaatacaatatcgcttcttttctgtatgactggcataattaaaagtttctaaaaggcaagtccatgccagaacttaagagaacacactggagttatattctgtactgagttccacctacaaacttaattatgaaagatggttgaggttaactttgttattgtgctttcctcctggataagcttgctttttaaaaggaaaaagctcctttaaaaataggttcagttaaacttacaattttgcagcaacctcaaatcctcactcttaatggatttgtccagtgaaaatggtaaacaagaacacatacatggtatgtaaaggtagatataggtacaacaaatgaaagtatattttcctggactggaaaaattcctttttgcaaaggttatgtttttgttgatccttttcttgattttcagtgcagaattactgttaatatattttaattgacctttgagagctgtcttagggatctctagaaatattattaaatatattcataagccaggctcagatattcataatccatagcgaggaaaactcttccttactatgtgtcagaaagagaagaaggtagatgacctctctcccccaaatgtcttgaacttcccttttctaacctggcattgcttgcttgccttctgaccaaattcatcacattgggaagtggaagtatacattgctatctgatgagatttcattttaaaagttctccccagtgaaagcattataggcacttcagagttgtgggtgtttggcaggtgtctacagccaaggagagtgagggaaaagtgtttcaagcccagctgtgtggtagaaatggagcatcttcatccagcatctcccagtgaattgatcatgtgtggaaacaccagtccaaaaggtaactcacagcttatggagggaccagaagctttggaataaagcacaggagaaggaacccatgtgaggaagttgggcaggagctgtttggcgttacagttagaagcattgcctttccattccacgatgacttcaactggtatttgaagctagttattagtgtgcccagtgagccatgcatttctgaggtatctcagtgtttttaaaataaagtctgaaatcttgatctgcttagttccaccaaaccctgttcaaattttctgaaggcactttagcagagcttgtcttttcattttgtgaatactaaactgtaaacaatgttcttaaagcggtaaagggaatatacatttttagaatttctatatttgatacttgaaaagttgggatagaggagagacctggtgtttgtgtctcactggagagggaaactcctgctcccattaaaaaaaaaaagaatcatatatttctagatgtatatttcagtcttccgggaaactccctttacagtttaccttcctaggcaatgatacagacctgtttgttttatggaaatgagtgttaactatattttctcaaactacagaaaataatattcatgttattcgtgtcagcattcttgatctctggttttgggtattgtcccctcccccaagtcttatctcattctcaaaagtatgccttttcctaggttcccagaaaactacttataatttgcccttccctcctttttgcggactttgaggatcagctcccttttgcagttgttggtggactaaaatgacatt

SEQ ID NO: 2515 - DNA, 16309 bp, Homo sapiens
aataataaaaaaataaaaagattaaaattcatgcaaagtattaaataaaaacattcttaagcttcatgatgaaaacaaaacaaaaatagctttgtattcttttctcgttctttgtaaccactaaacacatttagtgtctcattttggataaatgccattggaacacgaagctcagaatctaaggtcagctgccctattcaagaggcttaggacttctggatcctctcattcattaacgacatgacatttctactttatacaaaatattcagttgaaattaaattctccctaaccaggtagggcaggcagaatttgtttttaactccaaagctatatcttcacaatagaactacttggtattagtccattttcattctgttgataatgacatacccaagactgggcaatttacaaaagaaacaggtttaattggacttacagttccatgtggctagggtagcctcacaatcatagcagaaggcaaggaggagcaagtcccttcttgcacagatggcagcaggcaaagagagagtttgtacagggaaactccccttttgaaaatcatcaaatcttgagagactcattcactatcaccagaatagtgcaggaaagaacctccaccataattcaattgcctcccaccaggtgcctcctacaacatgtgggaaatcaagatgagatttgggtgtggacacagccaaaccatatcatgcttataatagtttgccaactttacatggtacagattgcatggtacagtaagaagaccaaatcaatgaatgggttccatgcatcaaaatagcatcagaagggaatctcttgctctctttctctctctctttcacagagacattgtggttgggggtgaatttcactttgagataaaaactgatttcactaacagtttccctttcatacttaaaaaactttactgtgtaaggcagaggtctccaacacccaggctggggactggtacaggtccatggcctgttaggaactgggctgcacagcaggaggtgagcggtgggtaagggagcgttacctcctgagctctgtctcctgtcgcaccagcagccacactgaattctcataggagcgtgaaccctattgtgaacctcatatgcaggggaattatgttgtgtactccttatgtgaatctaatgcctgatgatctgaggtagaacagttttatccccacacaactactccttcctcccatatgtgaaaaaattttcttccaaaaaaccagtccctggtgccaaaaaggttggggactgctggtgtaaggatgagatagctgttactaccactgtgtccacaaaaagaacaatgtagttagactggaaataacatgaagacagaaagattctggctccttgatggcatcatcaagctgctgaaagaaatctggaatcaccaactcttaagtttctgattttggggaaaaaaattaatctgtattgtttgtccattagtcagtttgttgttctggtggttacttaaagttaaaagcatcttgaattataacatttttgttttaaatttcattcgtaatttatctttatatttaacattcatcttaataaacttttttaataattaccagttttcagaacacatagaaatatgatatttgaaaaattatggtagctgagatttaatgtgccattatatattatgctctgtatttctccatggttatatacacatattttcctatacttacaatcgatatattcttttcttcccctagcttataaggttatcctactgtgagtgaagatgagagatatgacatagccctttctgtgctgtgctcttgtctccatatcattttgtccacattatttatttcaacatatataattttcctcttctttggagaaatcataaatgaaatgcttcctgtgaggaaaacttacattcaatttttgagtagccagggttcctgccagagagataacacttgtccagctaatgcattactaaaaagcaaacaaacaacaacaacaaaacctatgtatctattcttttcattctctctaaaacccttctctacattgagaggatagaagaaatgtgctgtgcaccccttcctttattaatagatagtactgggccaggtgcggtggctcacgcctgtaatcccagcactttgggaggctgaggcggacagatgacctgaggtcaggagttcgagaccagcatgaccaacatggagaaaccccgtctctactagaagtacaaaattagctgggcgtggtggcacatgcctctaatcccagctacttgaggggctgaggcaggagaatcacttgaacctgggaggcagagattgtggtgagccgagatcatgccattgcactccagcctgggcaacaagagtgaaactccatccccccccccaaaaaaaaacaacactgaagaaaagacgacttttcaactcctcttagttggtccaaatgcacccacttcctttcttagggagagaagacatgtgcttttatccatagagtgtataattggcatctaaatttagatatcaggtcagtgcaaaagtaattgtggttttgtcatcactttaatggcaaaactgcaattaattttacaccaacccaatactttggaggtttaaagtaagtcttactgttaattgtcctgggccaaaaacatgaataaacaaaaagaatttcagacaaagtggtatgtatggtcatcctacccataaaaggtctatgctctttggatgcttggcatcttttcctctaaggaaatcccacgtggtcctgggcagagttgggggtgagagtaggtgtagggaagtgtgtggtgttaacaatgatttcccaccacatatcccctgatacggtttggctgtgtccccacccaaatctcatcttgaattgtaacttccacaattcacacatgtcatgggagggacccaggggctggttactgaattatgggtgtgggtctttctcctgctttctcatgatagtgaataagtctcattagatatgatagttttataagggagagtttccttgcacaagctctttctttgcctgctgccatccacgtaagacgtgacttgctcctccttgccttccaggatgattgtgtggcctctccagccatgtggaactataagtccattaaacctctttcttttgtaaattgctcagtcttgggtaggtctttatcagcagcgtgagagtggactaacacattctgtaaggcactgaagtgatccaagctgtttaatccaaaaagctagttaatatatttcctgtaattttgtttgctttggaagtgagaattttactcaagtggtatcaattaagttttcttatatgacctgatttttcttttgaattgtagcctaagatacagtgaaggttaccagctgcaattttccccaccatatgtatacagtctacctttcagtaaagtcattatatacaagggagcagagtcaaaagataaataatttctggacgagtcattcctggatccagctgtgcttgaaattagcatcataatggagcatcccagttttatgagccataaaaattctatatatgacttaattaggcagagttaatttttttacttgcagttgacagtattaaaatggcatttttgtcatcttaggatttaaaagaattgggatggagtgaagagggtaagaaccaagagtaagaggaattaagataggagattatttctattgtgaggctgatcatgatgagaatgtatgaattttttatattttaatgtgcaatatgcttttaggaatgcatattctctggagatataaactatattcataagaattattacaaagctaatacattctggagatttatacttatatttaaccattttaaatacactaatatccagagaagtagtagaacattatgatatgaaaagatgatgagcaaggaaattatatatgcatggaaaaatatgtttgcaaaccaattcctgatttcagcctacctgaattgatataaatgtatattttaatgcagttaaaataatggtctgggttctcttacactgcaattgctaactatagctcatgtcatattctcagggttagtgcaatcatttacctgtgccaggcagctctgaataaaaaagatgtacatttactggatgggagaaatttctatatgagcctacaggatgcagcatcagcatgtcagcttcctgaactcttttattagtagttattttctgtgtaaaattttattgttttttaaatctctaatcacatttagtgagtaaacaactagaaataatcacttaccaattcattcatcagaatattattttacatcaactagcctttaagaagtagctaaatttctttggaaaactaaatactgtttaccatttctctttgccaccagactaatagaaagttttaggtatatctcactgctaaaacccaggctgaacactaagcaattgggagattgaaatgaacacatcattatccgagcaatgaaacattgaaaatcagacactggagcagtctcgtgtttgaatcaacaaataaaacagaagcattaagatttcaataaggtgcttaaacaacttaaagcagaacgattttagacaaatcacaatattgaatcctctctgggaacatcagtcctgtatgtaatcatggatctgaaattgacttcatgggaaattcaccagaagaccattttctaatttaacagaaaccaagaaacagcagtatgaaatagtaaaggtgtggaatattaagagtcagagttttaaagttcttgacatcagacggcgtggagatgagtaagatcactgagaattagatatgtgaccttggtaaatgacagatgcttttcatctataaatatccacaagctttttcatctgtaatatttggattacattagaaccaaaatcgtaggtctttttaaagatgaatgtaaataataagtgtaataataaatgaaaaaataaacttattagaatgctgtcagaaataaggctgcttaaatgctagtgattttttaattctctttttttagttctcttttattgctatgattgttgttactgaaaaattaaatttacattattaatagtgcaacaggcatattgttgagatgactaaggttaatctgtctccatttgcttaaatactctaaaagaaatacagcttgctattcttatcacaaaagtatatttttaaatcttttaatgtttctgctaaaatagaaaatgtgttaagatattagacagttacagttaacaagtttgaaatattaatattgaaaaactatactaggaagtaaaaatcatttggggatcctaaattctcagggtagctacacttcttgtgtaacagctatagaatctcagaaaaaagagaatcaagagaaaccggcaggggctacaaggcattttccaacccagtcgtggaagcatcacgtctgccctgttacttcagttgaggcatagagacatatatcgtatttataaccctaaaatctattttgagttgtggatgggctgtcaataaagaataacaaatatacataatcaactttggtaaaatgcttgagaaagggaaaaaatcaaaagtgaatcattcattggattcattatgaagatttcattgctctagacatatgattctgactcatataatggtaaaagagacatttaaccttcttttcccaaatattctcatattataagtacatgattgtctgctttcagatatttatgaagtttgagatatttataagaaaattctttataggcagggcgcggtgactcactcctgtaatcccagcactttgggaggctgaggcgggcagatcaagaggtcaggagatcaagaccatcctggctaacacggtgaaaccccgtctctactaaaaatacaaaaaaacattagccgggcgtggtggcgggcgcctgagtcccagctactcaggaggctgaggcaggagaatggcgtgaacccgggaggtggagcttgcagtaagctgagattgcgccactgcactccagctctggcgacagagcgagactccagctaaaagaaaaaaaaaaaaaaagaaaattcttcataaatgttgagttgcattattcctcatgagcataataatactattaacatgggatgaggtcttggagtgttacctagtttatacttctttgtgacagttatgacaaacatttgtaaggcattttaataaaggtgaagaaagagtagtgaatggaatgtcaaagatgatgccaataaagaggtaaagttgatttttttctaattttccaacttataaaagaaaccacttactgtgtaactgtgagacatattctacttcaagaagtaatatttacataatttaatactgaagtaactgtatgtccgaaaacatctcatataaaaatgtaaattacatcacttgaaaattcttcatatcatgcctatttttatgtaccaaattttagtaaagtacctcctgacaaaagaatttctaaacaaaaatgactacaaacaacagtaatactgagaaaggtcaaaattaatgcaaaaaaagaacatattctcacatgaaaggcagtttttaacacacacacacatattgagagagacagagctagctatactgaatttctagaagttatttaaactctacaagataaaattatcttaatacaggtaactttgttttggaattgttcattatgttcatgaagaatactcaacaactttataaactattaaataaacaaatagctatgtacagattttctatatgtataaatcactacaaaggaaagatgctttatggcactataccaatgattatcactttgtggcaagattatggctaatattttttatttgtgcaatcctttaaaaatattctgataatgaacatacattgtttctatagtcagaaaattacatgataaattatattaaaactcagttaaataaagaaaaaaaacgctagtattcttcaaactttttttctttaccagaggttttacttcaaacggcatttgttattctttattggcaaaattgttcaaccgactccttataggtaggaacctttttgcttatttaacctccagttggtgatcataagggtttatagaatgcatgagtgccttcatgaataaataaatggttttaaggaaaaaacatgcttccgtaagaaaaaatatctaatttcctgacatttgcctactaataattgatgtggtcatgccaatcgccctgtgaattacagggtaattataaccattgtatagccagttatgcttaaatggctgattaattaatcatgtattttgcatacaaatcttgtgttctctggatccagctaggtggtgtgttctctcatacactcatagccttatgatggctggcactgatgttatctcacctacctggtatttggactgaaaagactaaaaactaggggcagaaacagctgagctccttgccctccccctggtcttactagtttctctttgtcatggcctcgaggtaaccacactgcttgtgtgacaaccatagactcccagaaaaagaacatcaagaaaaactggcagaagctataagctgttttcctacctagccatgaaagcatcatttctactctattatttctgtctctattggttgaaatgatcataaaattctgtctgtgtttaagagagtgtcatagacataacttcttggtaagagaaatatcatataatttggaaatatggtctgaaaccactacaatctataggttaaagtacaacggcttaagggcacttaaaaaactgattgataataaattaacacagtacttctaagagtgcataatctgagtcaaatcatgtggaaatgtcagataaaccaaaattgaggcaaaattacaaggtaaacgatttataatcatcaaaaagtaaaggtcataaaagaaagatagactgataaaccgttcagaaggtacaactactaactataatttaggaatggattctggagggggaaaagtagaaatggagaaatagctaaaaataattttattgagataatttatgaaatttcagtaaagcttgtggattagcaaattgttttacatggagtttaatatcttaattgtgataatttaccaaggttatataattgaatattcataggaaatgctgaagtatttaggggtaaggctctgaatgtctgcacattttctctcatggttcaggaaaaacttgtaggcacttgtgtgtgtatgtgtatactttgcactaccttatatatacagaaagaaaggaaaatagaagaaatgatttagaagatctaacagttaagaattgatgagtccagatgaagagtatacaagcatttttttgctcttactgtaattttcctgttatgtttgaaattataacaaaatttaatgaaaaaagacactttaccatcataaaacttttccagcaacacactcaacattccagatttgccactatttaattttgaattataagcatatttgttaaatccatacttgtaactttaataatatgcttacatataatattaggactccatatatttctataactgccttttttttttgagatgtagtcttgctctgtcacccaggctggggtgcagtgccacgatctcagctcactgcaacctccgccttccagggttcaagcgattctcctgcccctcagcctcctgagtagctgggactacaggcacctgccactacacctggctagtagtagaaactttagtagagatggggtttcacaatgttggtcaggatggtcttcaactcctaacctcatgttctgcctgcctcagcctcccaaagtgctaggattacaggtgtgagccaccacgcccagccaactgctttctttttatagaaatcataattgcttctcatttttgtttgctttgttttctattttaccatcactaatttatctgacaaatatctcaaagacatgacaaatcaatgtccaagagaaaaatttgagtatctttctttcagaaagtgatggaacagtgaacaaaaaattaggatttttaatgtttataatacattattaagaaatttgatctcataaatatatatctagaaccatggcccaaggaaatagaatatattttgtgagggtaccatggactactcacagaaattaaccagtttttaagcctcaaagaaattttaataattcccccaaaccagaaatcatcatttagaacaaattttaaaatccaaatttaatataatttgatatctaacaaaatttcacagctaacagaaatattttcattgggaattttagaaaatactgttaagaagttaatgagttaaagagaaaatataaatttaaatgataatctagatatatagccatgcaaatactacatagcaaaaactctggtttaatcaaacattctcagagaaaattcaaagtttttaatgcatctataagaaaatattaaaaattaagtaaactaaatctttaagtagctacaaaatgaataaaataagaattaaaattatattaataaaagtggtaacacattaatttaacattaatttaaaaatacttaacaaaacctagatttttagttgttgtatttatcccttgaacaatgagtagaaaacttttagccagtgtgactaaaaacaaagagaaaccccaaaaagaaataaataacattaattacatgaaagatgagctggtgaaaatgtggattaaatgaaagattcataggagaatttaactttatacagcagtatgcttataaacctatactaagtgaatgctttttcaaagaaaatataaacttacaatattgttttgaggaaagggggaaaattggaaagcacaaattgtcagagaatatagtaaaaattttgactcctacagtcaccaagcctgagctctagtatcatgtgtactataaaaattttaagaaatatgtaaattcatgttgtataaactgtctcagaacatagaaaaaaggtgcttttcacatctacctacaaacctagagtaacctgatattaaaataattcaggtaagcacatgtacccactaaataaattatacacatatctttgaaaatcatgaagaaatcacaaaaataccacagcaatatattaaaaataataaaatataaaaatgtatcttcacgtttattgtttgactaatagaagaataaatacaaccttattgtctggcaactccttaatgagttatgatttacctatattatgaaatattatattgttatcatgaaggagccaatttaactattcgtgtagacagattccccaatatggttaactaaaaaagccagtaacttaaaaattggtttcaatgtctttctaacctaaaaaaaaggtccacatgaatattatagatagataaatgcttacagaaaggatagaatggttacgtatcactctgttaattgtaattactctggaaaaaagactaaatagttgccaggagaaagatgttattttaagaaatattatagtctacagttctatattacttgaatgcctcatattgagaatgtatctgtatatatgtgcagttcaaaaattatgtttgtttttgtttttttccaaagtacctaaaaataagccattagattagagagtagattcatgggaataatcagagagggagagggaagagagaatatgaaagataataaagtaaaataaatgaggaagggaaaatacagggcaaaaaacaaacttgtaaaaatattcataaaggctaggcacagtggcttacgcctgtaatcccatcacatcgggaggctgagacgggagaatcgcttgaacccgggaggcagaggttgccattagccgagaccgcgccaccgcactccagcgtggtgacagagcgagactccgtctcaaaaaaaggaaaaaaaaattcataaaatacatatcagagaaaagttcaatattgttataagagattttatatatcactgagaatggaaaattagaacaaaatgaatatgaacataaagaaagacatattagtgaacaataaacctaactcaatgttttctcttatttatcattttgataatctacagttacataaagtaagataccaatctttatcatattgcttatcaaaagattttgctgttattgtttaatgttgagataaagttctgttaattggcatacactggcatacaggcactccaagtgtactggtggaagtgaaaattagactttaacaacaggttttaaaagcttacaaaaatttgcatttactttgagggagcaatttccctgccaagaacttattttaggacagttattctcaaaaacacaaagatgaactaatgagatgatttttagtaggcagaattctaaggtgacccacagtcatgtatataatcttctcttaagtataaatgaagcctactaatattatgaaatgtcactttgtgatcaagttttatggcaatagagaaattaactgggggtgggccttaatctaatcaggtgagctcattaaaaacagtattttctctgatggggcacagaaagggcagaaagattcattctggctggcctagaaggaagcaataatttgcattgtgaacaagggggcaaggacctaacgatgcatctaagagctgaaagtattttctacctgacaaaaaatggaaacctcagtcctacaaccacaaggaaatgaattttgccaccatccattgagcttggaaggaaaccctaaggcctagagagaaactacaaccccaacaaacactctgattttagcccagtgagactctggacagagaaccagtcacgccatgcctgaacttctagtctacaaaaactgtgagaaaataaatttgttttgtttcatacttctaaatcagtgataatttgttatgcagcaatatgaaactaataccatattcatgaaatcgtcatttatgatagcaagtaaatggaaacctcctctacatgtagcgataaagaacaggtaagcaaaatatgacatactacacacagcaattaactctcatgtttgcaaagcctatttacaaacttcgtaagaactatgtataaaattccgtgtgtgtgtacatatgtgtgtgtgtgtttgtgcattttacatacattcgcacagttttgcattgcatattattcattaggggttgaattctgtctctcagaaaaggatatttgaagtcctaattctcagtacccccgtatgtaacgttatttagaaataggatctttgccgatgaaagtaagatggggttattagagtggactctaatgcaatctgactggtatccctaattaaaatcagaaaattgggctaaatggagagaaatgcaccaagggaagactatctggacacagggagaccaccatctataagccaaggaatgcctgatgctaccaaaagctactagagaggaaaggagctttcccttacagttcccagcaaaaaatcaaccctgataacaccttgatttcagactagcaccaaactatgaaacaataaatttattttgtttaaaccacccagtttgtgatagtttgttatggcagccaggaaagtaatatagatacctctatgttcatgtagatggaattgcaacaaaatttaacagtgactgtctcagttattgggaatatattaggcgggttaatactcaatttttaatatttggccacatttaacctataaacgtggcaatttgacatgtttcagttcattaatttcttctatattttttgtgctcatcttaatttttaattgtctttcttttcatttttttgagacaggttcttgttccccaggctggaaggcagtggcgtgactgtggctcactgcagcctcaaccttttgggctcaagcaatcctcctgcttcagcctcctgagtagctgaaaccacaggctcataccaccatgcccagctattttttttttttttggtagagatgaggtcttactatgttgccaaggctgatctcaaactcctaggcttaagtgatcatcccgcctctgcctcccagaatgcttggatgacaggaatgagccaccacacctagcctcctctaaatttttgaagttttcataatatgtgttatttccatagccaaataaatttgataatcacaaaaagtagacaaccctcttcaaataagcaaatgttggagattatttatattcataaagatgttaaaccaagatgaattgctaacttgaaaatcatttcctttcctatattcctttttctgcattcagtctcttcatatttaccttaagatgttttatagtttatgcattatttgtatatgtcaggttttaaattgaaatattagaaacagacattattggaaacagcagttttctgtttctactagagcaaaataactaatgggagattaatattaatagactatgcactgaatttttcttataaaagttcaattgtctaataaattaatgatacctctcacttttacaaataatatgcatatctctacttgctagtgttgatctgatcattcaataatcatttaaggattcattgaaatccaaaaattggctaagaaacatgctactgttgtctagagggaaagacaggcatcaaacaagcaattacaaaaatgtatggttagtcttataatgggaaacatgaattatatggaactaaccaagtcaaaggtgagaaaatgccctctgaggaagtgatttgcaaggtgaagttttccgatttggcaggataagtaggaccaagttgcagagggagctggggcttgcactgtatagaatgattaaaaatagaacaaatgttgcttgacaaagttctgtgattttagttacaacacctgaaaaatgttatgatgctattgtcttttaaatacatgatttcttttgacatgaatcctgattttttagaaatattttcaaatctgcattttctgtcacgaataaatctcattaactgctccactccaaatggccacttctgtcactgcaaatttatatagggacagctatacattattaacaagctatgaaaagtcaccggctaaatgtcaccaaagctgaggtatagctgcaccttgggattcatatagcaaacagtttagttttaatcatcccggaccacaggatgtcttgacatttgagcagcaactttttcctctttaacttgcactggaatcagacctctattatctcagccataatttttagcttaaattgtgatagaaagttttaccttctaaattaaaaacgtgaaaaaaatcgatccatcaaagaacttatcattcatgtaatcattgctcacctgcagccctcttcctcttaacccccactccaagaaaggtgatcaaggacagctataaaattcaaacatctttagacctgccagaaattttttgagctaaatgcttttctgttacattaagacctacaagaaatgaccttgctgaactgcattaagagagatgattgattttaccgtgaaatattttttattttgataaaataagtaggtttcatatttttaaaatatgcttttgaatctttttctgctcaaagtctaataatgttatcaggatatcaatctttgatgcctacaaagtgtctaaatttattaatattttataaaaaatatctaatgcatattatatatttgagtcttcttaagatctatcattttagcccttcattgtggagcattcacagtaattaacatagtaattagaaaaaaagggaaacagacatatcaataaagataatgtttgctatatatatgtgtcttataacctcatgctgtataccttaaaatggtcatcaatacaatactacaaatgcattacataacctgttctgaacaaatatgactggcttactgataatttttctatatatataataagtcatggataagcaattattaaaaaagggcttattgtcaaataaattggcttattggtatctatcatacagctcttactttatttaataataaatatcatatggtccataatgaatagtatagtgaatgcatacatcaaaataaaagtagatgatggaatttaaaacaatgatcatagcattgtttcttaactgttttatgagttaacacctaaaaatatgtaaatttataatatgtcttctttttatttcaccaaaaaatacatgtgatggaaaattgtctatggttgtcttcacctctttgaaaagttaacagcatcacttttatgtttgcttctattttctctattttatgaacaacattcaagtagtatttgtcaattacctattatgttatgaggtattgtaggtttcatacagtgatgagcaccatggacaagatctttgtagatattacaatcaaatacagagagaaaaattagtatcacagaaaaaaaaataaatgctgctatgttttacgatggtgtctaatgagagatacaactttattgagtgggttggtgggaggtggggaaagaagattttcccatacctgttcttttgagagtgagttaggggagcattagcaattattcttgaataacaggcttaactcaggcacatatttagtcaactaaccctacaaccttgactgattgatggagaatatggtaggtcttgagaacttttccaagacaggaataccttagttgggagtctccagaaacagaccttgagcaaaaagtttgagtagaagtagttttttaggagatataaaacacacctaaagttgagtaagttggtagatgaaagagaatgtagaaaatgaaattaaatcaactattaaagtgggtgcttagaggttattcccctaggaaactctgatcaaccgtaaaaaacacacacttcagaattatcccacctgatagactaagaaagctaaggtgtgtatacccaaacttccatcagtaattgttgggggctgcatcctggattgggaggatgagaaggggaagggggttaattcaccagaatttctgttctgctttgcatgaaagtagtttctgaaataaacaagctcataaataaatacacagtttgctggaaattggctgtaaaaggttgaaatggtaggatgagaggagtaggagtgatagccacccattagacaacagcatgacagagtgagctaaggtatttgcatctattaagattatcagtctcccattattattgtgtgggagtctaagtctctttctaggtctctaaggacttgctttatga

SEQ ID NO: 2516 - DNA, 26624 bp, Homo sapiens
aagcaatgcttaatattcacagatgaaaagctgtcagaaaattatgccatcagaattcctgtaaacaaggtacttttgttaatttctaactgattgggaaagtagcattattgaaccataattgatttcctcttttctattttgtgcagcccagtggttgtcttgtgtggtgtgttattgtaagatgattgcttaatttgtggaatctaaacagcctattgtattctagtagtctcacatatttatatgccagcatgcactttatgtttgcagtcaggtttagaattttatgtcaactattatttcattatttatggtaaacaaatttcaaatttgagacattaagtatgatcagaaatattacagtagaaattaaataatgatttatttgttaaactatttttcttaatctatgccctgcagttcaattgtcaattgaggaagttttagaacacaatagcaaaataggaactgcagtaacaaagcaagattgccaagaagaaaaatgctttttaaattattcctttaaaaaaaagtaaaggtcaaaggagtgtgaccagtatctgatatttaaattaacctaagccactgaaggtattcatatgtatgtgaatgaagttccaaatgtagactgggtaaaaactccaaagcaataatcatgttggctacaataatgcatgcaaatcaaggtaattggtatagataataaataattgaggaatcaaatttaggtacattttccacggccagtaaaaactaagcataaagaacattaaaatagtttggttatttgtccctgcccaaatctcatgttgaattgtaatcctcaatgttggaggtggggcctggtgggaggcgttttgatcatgcaggcagatccctcatgacttggtgctgtccttgaaatagtgagtactcatgagatctggttgttttaatgtgtggaacctcccctcccactccctcttgttcctgcttttgccatgtgacatgcaagctcctgcttcacccctgccatgagcaaaagcttcatgcgtcctccccagaagccaagcagatgccggtaccatgttttctgttcagcctgcagaactgtaagacaattaattctcttctctttataaattgctcagtctcatgtatttctttatagcaatgcaagaatagcctattacaaacattaattgatttgattactaaagctgacagagtattgtgcatgaaattgatctcgatatcaagaagtctggtttcttataaaaagtgaattttatttaatagaaacattgagagatgcagtgttcaatatggtaatcagtagacacatggttgaacacttgaaatgttgatgcaagaggaactgaatttttaatttaaattaactttaatttaaatttaaaaactaattcatttgagatatttaaaaacttttaaatatggttgacaacttgatacatataaatatctattttcaaccttcagtttcatgaaatgtaattacagatcaattccaatgaaaagttatccaaattaagatgccctgtaaatataaaatacatgtcagatttcaaagactaagttagaaaaaaagcataattatttaaatactgttttaatagtgataacatattatatattgttaaacatattattcatattaactttacttatttttaatatagctctttaacaaattagaattgcatatgtggctcgcgtaatgtttttattggatagccttgagaaaaaatcaaaatctgcattgactttacatgtattactaagaatatgttttaggacaatatactctaatttacatatattttctctatcttcatacacatctgcttcccacttaccccacctcccttattgtttcccaaaaatcagaaattctgatgatgtaacctcccttattgtttctcaacaaccagaaaatttgatggggcttgaaagacagaagtgggataataacagagagaaaaatatcttagatttttcttttgtgtggtataatggtgcatttttattactatcattaattaacccagaatggcaaagaggaaaaggatttttgaattggaaccagtgaagagtcaaagaagaggaggaatgcaaaaattttcaggtggagaactctctgtctgtaaactctgttcccaatgaccactacaagatccatgttccctccaagagagctgagaaaacatcactacattcatcattcagaacagggtgagggaaggagccctcgacagaacacgcccagagttacaagttgtcctcagagtagtattattgccattaggaaaaattggccaactgtgagtacagtgtgaatgatctggaaagataaagagaaaggtagtaacaataacataattgttttcctggccatgtaggagtttggctgaagttgtccttaatgtgacttttttaagccaatgcttatttccatcaattttggtttcctactcaattctatttttatcagataagattaactcctatacatttactgaaattatacaacttttacatcttctctttcatggctaaagaatgaatctaggacttatctactgatattagatatcatcatttggcattgtctcaatatactgtggctcactatgggcagctcaaacactatattgcctctgcatcagaggcaattttgaattgatttgtttgggtttgttagtctcgaggaatctcaagatatgatttttaccaaaatgagtgtggtttctttccagctgtttgttaatttaaaaaaaaagaaatgaaaatgaaaactattagctaagttcctaaccttttaataaattggctagaaacacaatgtgctatttcaaaacaatgatattttctaatatttcataagcactaaattttgcatctttttacatgtactgatgccttagtccctcttatgttatttgaatttgatgaacaacctggtatctttatctatgtttaaaaatacatctcttcaggggagagcaaaagacaaacaaaaataattcccattacagtctcagcaggtagaaatgctcttactcaaaccacagacatttcttaaagcaggcctcacagctgtaatcttcaaatacttttattctaatagcaaggcataatgtggtaatttcaaatttgctttatcatgactgttttaaatggtgaatacatattttttctaagcaacagtatattattgaaatgaaaataatatatgtgatcattatgtgtcagatactgaaatgaccattttctatatctcagtagccccttttaacattccttctagtaaatcactatgatttctacttccaaggtgacaaaagcaagcttagtggggacccatagctaacctaaggcaacaaaacagggacatgttggagcctagagtcttccaagcctctgtttccaaactcatgcccttacttgttctgttagtctaattcttgtaatggccattatttgatattttattgtaaatttacaacaaatactttgctctattatataaaatactatcatttggaactgaaacttctcaatattatttaaagaaatcattcaacaaacagattttattttatcctacactatgttcactaaaaaactgagaaatataaattcattgatatgaatttcacttaaagagaattttgacagcacaaactttcacattgttttctttttgattggcaatatgaatttagtgcccaaagtactggttatttaaaaaaatgagattcattgatttttaatctacatttttctattcatcttgagattactaaacatgggtcacaattttaagaacatctaggaaaataagacttcttgtaacaagaactgctgaaaaccctttacttcaatttgacattttgtgctcttctaaatgtatcctaatgcatggtcatgctacaaaatgactatcattagggctgtcacaggccatggctgtgggaataccatgactgatgctaagctatcagcactgtcggtgcaaggtgtattctcagtaatttctcaaactgtccatggaaccaatttctactgatctctaagtcataaaactttacaattaccctgagttcattaataatgtattacagttctcattctcaatcacaatttcatcagatccatgtctcacaggaaggttgacaagtaagccacaaaattatccatataaatgtcaagatttattttcctaacataaatgatctaacctagtcaagcatagttaataataaaatcattctttctgagattaccattcacctgattgccatacccattttggccttatatctcaacctctctaatggtggaggttatggatatagtccacataaataaaccaattatttatgagtcatgttcatttctatattaaaaatacaaaaccatgaatacttatattattgcttattactcctctgtaataggcacaaaactaaattggtcaatttattccatgacaatgaggtaagtactaaaagggaaaaatatgttaaaacagtaattttagttacagatatctcaggttgctgttttagcaaaaatcataacatactctacttcaaatacagaatctcagaatatgtccaaatgggaaattaagtattaaggcactggcaaaattattgcattgaaaatgaacagaaacttgcttctacattgcatttttcctacactctgtgcataaaagtttattttgataatgaaggatatatgtaataaacagtttctgagttcttgaagctattccccccattgttacattactatcagcctgttttgatatattatattaatcatatcataattttaaaatatatgattttttcactgatatatgaaatcttaagtaacatattaaataactaattacagaaacatttattaatctaagtaaatgcatgcaatggactgtaatttatttgctttgaggcattttatagaagtaaacagatagataaaagaatgcagatggggtttcagaagcggcatattgataggcgaaatactatactatctttcaagactacaagtggagaatgttaatatattctgccaaattttatatactgtccatcttaaaaaaatcacattgtttagagtagtttccctcctgagaaaaaaacaaagttggtgacaccacttgacagctccactgaagcaggaaacataattgcattcatttattcattttctcagtattagactcacgaacctttaaaagggtggggtggggagtccttcaatagaagtccttcagtagaaccaagaaatcagtattctatgatttactacttcataaaggtaaataagtcagtgaattaatcaaaaatttaaacagtgtatttttctctcaattggctatacaacctagaatttatatctcctaaaggtaaattgataatataaaaatctataggtagcatccaacattatgactctttacatgactgtagaagttgtgatacatttagaattattgttagcaaaagtctatgtaatacagcatatttgttttgtttcctagataaattgatttatattcaatgatttgtctgtagcagataaaataaaatacataactgatacctcgaatattattttgttttgataactgttactttttcaaccctgttttcctaatcattatctttatttcctcctattaagaatactttaatcttactcattttctgtctgaacactgaaattcatcaatgagagtaaacattgaaccaaaaaaatattccttttattgagactggtctctaagtatgctttctattagagttttaattaaaatcactttcataatatacttttttatatttgtataatatatgatactatatttgattttcctagtattaatctgaaggtgataattttataatttgccaaatttttatattactctaagccataggttgacatgtatatttctcagatataaatgttcatatgtaccagaaatatttttaaaagacatattagaatatatatattttttaaataaaatatgctgaaaaatattttcatttctgaaacttcatttatctttggcaagagtcagtcagtatctcatgattaattcagggctgaacccaaacgacgttcaaattagcatgtcagcagaagaaataataacactatttgatactggtcttttcccttagaatcactcaaaaggttctctaagacagcacacagagtcctggttaacttctgaaaacattctttttcactgtaaagccagactattgttaatgacaattgccattaatttactatgaacttacatataagaataaagattctgacactgcattttccccaaatacgatgaacagtagaaaatcagtagaaaatattagagaaaagctatacttagaatccatgtaatctttagattgttaaatatctgtttcactcaaattgccaatttaaatgtgggctttcttctgaaacagtaaatgctactccaagaaagtaaaaccagtagtgaaattttattcattttactttttaaaataaaaataatatctgccctagagcttattttgtcaaaacatcttcttcactgtcgtgtatcctatggtatgcccttcctattctaagtgtcagagacaaggaaccaaatcaaattcctcatacccctggaaatgtatcaggtttttacttccctacaatcatctacaatttaaatgcaaatttaattttgtcagcatttcatgacattgaacgtagataaatgtctcactatctcagtgagtgttatgaaagtttaaaaatattcttgaaataaagttagtgttttagttggaaaaaactatagcatacagcatgctgaaacagaagaggatgtgcaagaagtgtgtagtagcatgggcatcattgtggaggaataagaaagagggtgtgttgctgggacagtgaaacacctcatcctgctgtctaaatctcaggctatattcctaagggagagcatctgggggttctccactgattgaattgttagaattctgagaatactggaatcaaatcttagaaaaaaactgatttttagtctgggaatctaggtcattagatgtctcaactggtgaacagaagaaaattataaataagaaattatgagtgatgagtgaagccagaagtcatgacaaaggtgaagagtaaaactaagaagtactggaaagttaatgaggcaccagacatctcaaacctttaatattaatcttttagtgaggctcagccagagctttcttgcttttatgacaacattcaatcagagagtaatcatatctcacagcatttgtgattgatctgaagtaaggatctctatttctcagtgttctttctcacttaattttctgtttggttttccctatgatttcatatttgaacctcctttcagtggaaagaacatctgtagtcccatgaattttctaatctgaaagggctacagaaatgaaccatcactgtgcttcaagccagccagaacaagatttatcacttgctttgtgtgtgatcttgaataggtggcttaaaatgaaataatgcaattcccagtttctgaaagtataaaaattaaataggataactgaaatatgcccagaaaaattcaaggtaacagcatagcttaatctccctcccttgatctaaattgtttgatgacttttttaaaaaaaatcttccagaacacaactcagatatcttaactcaaagttcaaggctttccatagtgtctcatccatctgcctttccaggtccacttttctctattccctttacgtagctttttgtttagtcaaatgggaccatttagtttatttttcttttgctatgtctgcctttgctcttgcttctttctccaactctatacttgcatagttatcctttccttcaaggaccagctcaaatattactgcacttctatatttctctcccttcccttcccaaaattaatctctcccttctctacgtctataaaaacatttttttgtcttctggagtacctggcttaatgtatcctcaccttctcctctttttttttttttttaaatccttctctattgtctcatttcctctatagttttaaatatgatagtttgaaattaatagatgatggcaaaaagaagactacagtacatggtgaaaccccgtatctactaaaaatacaaaaattagctgggcatagtggcacatgcctataattccacctatttgagaggctgaggcaggagaattgctggaacccatgaggctgtggttgtattgagccgagattgtgccattgcactccagcctaagcgtcagagtgagactccatctcaaaaaaactaaataaaaaaaaaagaagactacagcttacatttgtatcttagccaaagcagcttctttcttctaagctatgctactgctgcatatgtttggtcaaaattttaggctttcatggtttcttttttcctttttggggggatgtgtatagcatagatcacatatggaaacaaacgcaaaacagaaaatacaaatgggaatgaaaagggaatggaagcagagatattatttccaaaagcttaaaaggagaaataaggattgaattgttttaaactgaagaaaacatcatttatatagaaagagcaattagattatgcgatactggtaaaacgagtcagtggaattagttcacagaattatgaataaaaggtctgtctgcattatgtcttccttaaatctattgtttgttaaatttccaattatgtacatgagcataaacacacataaatacagatatatatgtgtgtggtggtgtgtgtgtatataaacatttgtaaatatgtatatgtgggttttttttttttaacggagtcttgctctgtcgccaggctggagtgcagtggcacgaactcggctcactgcacctccacctcccaggttcaagtgattctcctgcctcagccccctgagtagctgggactacaggtgcgtcccacaacacccagctaatttttgtatttttagtagatatggggtttcaccatgttggccagaacagtctcaatctcttgacctcataatccacctgccttggcctcccaaagtgctgggattacaggcatgagccaccgtacccagccatatgtgttattttttaacgcggtaacataatatccaggttaggatgtttaaggatggatatgtgaaatgtgttttccatcctctcacacactagatcccatatttcactttaacaggtatcatatttctcccttttcattattgcagatcatcctgaaagcttcatcacctttggtttggtttattttccattattccaccaaaatgactattttgtttaggccattggtgccctcttattgccaaatccgatgggtatttgaatatcttttcttagttttcctgtgtgcagcattcaaaattgtcaacaattccttacttcttgaattagttccacacattggctttatgatactacacagctgtgcatcttacctaactggctccttcttctcattcttttcactcttcctctttcacccacctcatattaattggaagactcagctgagtggtatcagatgtcaacactcatagcagttgagtgaatgagtggtgtagtcctgaagtggagagatctgagccatgggccagaatacacactaaacccctcatgtctattaagtgagtactaggcaccaaaaggaatatgtatatttgcttgaataataaatgacctctcataggcttccatttgtgattttctgatcacattcttcatattctatcattccatgcacatgtctaagctcaatgatatggtttgactctgtgtccccacacaaatctcactttgaattgtcatccccataatccacatgtgttaagggttggaccaggtggaggtaactgaataattaggacagttttccccatgccgttctcgtgattatgggggagtcttgtgagatctgatggttttataagagtcaggcatcttccctgtttgcactcactccatactcctgtcctgtgaagaaggcgtctgcttctcctttgtcctctgctattttagtgagtttcctgaggtctcctactaatctggagctgtgagtcaattaaacttctttcctttgtaaattacccagtctcaagtatttcttcacagcagtgtgagaatggactaatacagtaaatcggtaccacagagagtggggtactgctataaagatacccagaaatgtggaagcaactttggaactgggcaataggaagaggttggaacagtttggaggggtcaaaagaagacaggaagatgtgggaaagtttagaacttcctagaaacttgttgaatggttttgaccaaaatgctgatagtgatatgcacaagttcatccgtaagtggtctcagatggagatgaggaacttgctggaaaatagatcaaaggtcactcatgctatgctttagcaaagttcctgatggcattttgcccctgccctagagacatgtagaagtttaaacttgagagagatgatctaggttatctggcagaagaaatttctaagcagcaaagcattcaagaggaagcggggcatgaaagttcagaaattttgcagcctgaccatgaggtagaaaagaaaaacccattttctggggagaaattcaagcctgctatagaaatttgcataagtaataaggagcccaatgataatcaccaagacaatggggtaacgtctccagggtgtgtcagagaccttcatggcagcccctcccatcacaggtctggagggctaggaggaaaaaatggtttcatgggccaggcccagagtcccccttctttatgcagcctcctgacatggtgccctgagtcccagctgcttcagctccagctatggcaaaaaagggccaaggtacatctcgtgacattgcttcagagggtgcaggccacaggctttggcagtttccacatgctgtcgagcctgtgggtgcacagaagtcaagaactgaggtttgggaacctctacctagatatcaggggatgaatggaaatgcctagatgtccaggcagaagtttgctgtagggccagggtcctcagggagaacctctgttagggcagtgcagaagggaaatgtgggattggaacccccacacagagtccccactgtggcactgcctagtggacttgtgacaacagggcaattatcctccagaccccagaatggtagatccacctatgactagcaccttacacttgaaaaagctgcaaacactcaacatcagcctatgaaagcatccaggagagggtgctgtgcctgcaaagccacagaagtggagctgcccaaggctgtgggagcccacctcttgcatcagcatgacctagatgtaagacaaggggtcaaaggagatagttttggaacttaaaggtttaatgactgccctattagattttgaacttgcttgaggcctggagcccctttgttttggccaatttctcccatttggaatgggtgtatttacccgatgctggtatccccattgtatctaggaagtaactaacttgcttttgatattacatgttcataagtggaagggactttgcttgtctcaaataagactttggactttgacttttgagttaatgctgcaatgagctaagactttcagaggccaggcatagtggctcatgcctgtaattccagcacttctttgggaggccaaggcgggagaatcacttgaggttaggagattgagatcagcccagccaacatgacaaaaccccatctctactaaacaaatgcaaaaattagccgggtatggtggcatgcacctgtaatcccagctactgggtaggttgagtgaggggaattgcttgaatctgggatgcagaggttgcagtaaagctgagatcacaccactgcattctagcctgggcaagaaagcaaaaaaaaaaaaaaaaattatatatatatataaataaatacacacacacacacacacacacacaaacacacacacacactttgggggacagttggaagggcataaggccataattctgttttgaaatatgaggacatgatatttggaagtggtcaggggcagaatgatatgctttgtctctgtgtcaccacccaagatctcatcttgaattgtaatacccataatccccaggtgtcaagggcaggaccaggtgaaagtaattggatcatgggagtggcttaccccttgcaattgtcatgataatgagtgagtctcatgagatatgatggttttataagcatatggcatttccccttcttacacttctttctgccaccttgtgaagaaggtgccttgcttcccattcaccttccaccataattgtatgtttccttaggcctcacctgccatgcagaactgtgagtcaattaaaacttttttctttataaattacccagtcttgggtacatctttacaacagtgtgaaaatggactaatacactcaccaaatacagtaaggtctttgtggattagaaatatactggatttgactttatattctctacattgcaaagcagagtaccttgcatatagtatgtttttatttaatatttcctaaatgaatggaaacagaagagaagttaaaggataagtcatgggagcggctgatgcagtctctaccagtgtgtcataaatcccaaaatatttgaaagaaattatagtacagggatccacaacacaaagctgctgtcccaaagatccatttattctatttacttgtcaaagtaatagacaaagtaatagacaaagtaattgacaaagtaattgtcaaagcaattactttgacatccctacactgtcattttctggtctataaattaggggtagtaatactaacctgtcataaggtctgagaatgcaatgctctaatagggcctagaacacagtaaatattcaataacatttatttgttattaataaaaccttcatgaagttaatatttcatgtataatattctgtacctttttcttcctttaaaattaattgtacatgattaaacatgcattttttagagtataagaaataaacactaattgttaaattatatttgttcatattctggattaggagaaatttaattctcagtttgtattataaattttaaaaactgccaggcacggtggcttaagcctgtaatcctagcactttgggaggccgaggtgggtggatcacctgagatcaggagtttgagaccagcctggccaacatggtgaaaccccatctcccctaaaaaaaaaaaaaaaaaaaaaaaaacagattagctggacatggtggtaggcacctgtaatcccagctactcaggagactgaggcaggagaatcatttgaatttgcggggcagaggttacagtgagcttagatcactccattgcactccagactgggtgagagagcgagactacatctcaagaaataaataaataaataaataaataaataaataactgcttaataataaaaagaagttagataattcatacatgtattttgttacgattaaaaataatctgacaacaaatgagctgaatatagtaattatgaaatcaattttatggtttgttaaaatgctaaggttaatcttcacgtagtttgagtttttattgtatttatctgcttcataattttgattagtgtaaggggaatggctgtggcttctgtctggagtaggccaaggctgacatccagtacagcacgacacagcgggtttggagcagaggcgcacaaccccatgcactacataattacatttatgtagccattcggttgtaacctgtttgtgtgagctcatacctggctttgagccactgttgtctgtgaaaaatataactgcactgctgactctgtaggagagagaaagaataagtccacatcccacctgcctacggtccctcgagtgtttttcagctacccgccacccatctactgacttccctcggaccccagcttgggttgaaatctgaaaattaggttaatataacttttaatattgaaaatagtatttattatagcttttaatttatatttttgtgaattatttgacccaatctgtgtaagaagatgtacattagaatataaaaatacaattaccagaaaaataaaagataatttttggttctttcatgaaacatagaaactcaagaacgaaaatgaataaagctatattcaatccagtcagtcttgaattcatgtaaaatttttagtacttaacaaagttgcaaagattcatactattaaaacagaaaagttgtagaagtggtctaacaatgaaattctcagaaagttagaattgtcttgctttatttctcaggcattcctaacattatgatttctgtgacaaaaagtaataactactcatatatttaccagcgcctgaaaatcaaatgtgttataacatgaattatcatagaagtatatgactatgcaattgcaaatgcaaaaagtcatgcaacacactattttaataatataacaatcatcttactgccaatgttttcatttcactaatttcattgaatcttatcttctgataactgtttagctctttaattagatatcaaataattacacttttgaaatgcagccaggcatagttttttagttgccgtgatagcatatagtcatctttatcctgcacattttgtgttttatatccaagcacgtatctaattatctttctgactgaattgactacttacagcgcaggaagatctaacacaggtcatttgcaattgtgcagtcacaagtcacaaaaagaatgaaaaagagtgaagaaagcctaaggttcttttgagaaaccatcaagtgaaccaatatacacattgtgggagtcaaagaaggagaataaaaagagaaaaaggcagaaagcttatctaaagaaataataaccaacaacttcccaaagttttggaagcaaatgacattcagatttacaaaccccctaatacattgatgcattatcatcaaattatcagaagtcaataccaaagataattttaaaattaataagagaaaagtgacatcacatacaagcaaccctcataaaactatcagttggtttctcagcagaaacctttcaggcaagaatggagtaaaaggacatactcaaagtgctgaaagcaaataaaacacctaccatgaatattatccccagtaaacctgttcttcataaatgaaggaggaataaaacactttcccagaaaaaccctgagagaggtcatcaatagcaggcctgccttacaagaaatgctaaaaggaattctgaaagaatactaaacagcaaaatgaaagtataaaacttaatgagtaaatgtaaatacatagaaaaaacaagaatactgtaataccataatgatagtagataattctaatataaaagttaaaagacaaaagtactaagcataaccacaaaaatatgttaatgtatacacaatataaaataggtaaactgtgaaatcaataagataaagtacatgcatggaggtaaaagtgtagaaattttatactgtttgaatttaagttgccatcagcttaaaatagactgctgtaagacaagcatgcctcatggtaaccatgaagaatatatccctaaatatacacaaataaaatatatcagagtatgtcactaaaaaacaaatataattccacaagaagatggcaagggaaggaaatagggacaaaatacctataaaatagatagaatataagtttttaaaattttaattaaaagtcctcacttacaataattactttgaatataaatgaattaaacttcacaattgaaatacatagagtgcctgaatagatttttaaaaataaagatctaactttatgctgtctataagaaacccaccttagctttaaggactaacacaggctaaaagtcaagagatggagaaagatatcccatgcaaactgcaaaccatagagagcaggttagctatacttgcatgagacaaaatatatttaagtaaaaaggtgttacaaaaatatgttgataagttttatttagttagttcagaatgtatacatgtttgaaaacatcatattgaacataataagtaataactttcacaggaaacaaagaagattatataatgataactggtcaattcatcaggaagataaaacaattacaaatatataggcacccaacatcagagcacctaaatatatacataaagcaaacatgacttatatgaagggagaaacagacagaaaaaaatcacagcaggagattttaatactccacttcaataatgaatgggatatcttaacgaaaaaaaaaaaaaaaaaaagcaaaccgaggactaaaacaatactatagaccaacgggacctaacagacacatatgaaagattccatacaatagcagcaggataaacattgtttttaaacatgcacagaataatctttggaacagatcacaattgaggccacaatacaagtcttagtaaatttaagaagattgaagtcttaccaagtattatttccaaccacaaagaaatgaaactgagaataacagaagacaaactgaaaaattaaaaagaaaaggtaagtaaatgatacaatcttgaacctacaatggtcaaaaaagaaatcaaaatagaaattagaaactatctcaaaatagatttttttcttaaaaaaattaaaccaacagaaaaacttaaggcatgcagcaaaagcaatattgagggaagtttatagttataaaagcctacactataaaagaagaaagatcttaaacaattaactctatacctcaagaagctggaaaaggaataacaaattaagcacaaaattagcagaaggaaagaaataagatttgaagataaatagcctagagaaacaagaaaaaatgtcaacaaagtaaagagttggttttctgaaaagataaaattgacaaagctctaggtacatgaactaagaagagagactactcaaaataaaaaaaataggagatattacaactgatgctacagaaataaaaataattaaatgagactactattggcaattcctcaccaaaagattggataacctaaaagaaatgtataaattcctagaaacatacaacctactaagacttatcgtgaaaaaagagatagcctgattaggccaataacgaagaaaaagattcaatcagtaatcaaaaatttcttaaaaagccaaacctgcagaagtaaacagtaaaagggtggtaccagaggccgtagtattgggggactgggagatattagtcaaaggacacaaaatttcagttagacaagaataataatttcaagacatctattatacatcatggtgactgcagttaatatccatatattgtatgattgaaagttgctaagataatttaaatgttgaaagttgctaagagagtttaaaagttgtcaccagaaaaaaaaaaaagttaagtacatgaggtaatgtgtatcttcaataatgtgatttagccattctaccattatatataaatacattaaagcatcatgttgggcacaatgaatatacacaaattttacttatcaataaagtatatctttatctttctaatgaagaagagcccagtaccagatagcttcactggtgaactctaccagacaaagaataattaacattaattcttttcgttaacagaatgaaggataaacatcacatgatcatttcattagatgcaggaaaagcatttgactaaattcagcatgctctcatggtaaaatttctcaaaaactatgcatagacggaatttaagtcaacatgataaagactatatatgaaaagctcatggctaacataatattcaagggcaaaaaacggaaaacttttcctctatgatcagaaacagggtgagaatcgcactctcacaacttccattcaacatagtactaaatgttctagccagaacaattagacaagaaaataaaataaatgccatccaaatcagaaaggaagaattaaacgtttatctgtttggagatgacagggtctcatatgtagaaaaccctaatgatcccccaaaaatctgtgagaaatgataaacaaatttggtaaaatttcagtatacataatcaacaaatgaaaatcatggcttttaaaaatttagttttttaaatggtaagtataaattacatatatacttaaaatcagttgtgtttttatatataaacaacaaactaataatgaaattaaagacataatttataataacattaaaataataaaattcttaggaataaacttaaccatggaggttaaagacttgtacactaaaactaaaaaatatgatgaaagaaattttaaaagacataaatacatggaaagacatgctgatttcatggtttagaagaattaatattgtaaaaatgtccacaatcacaaagtgatctacagattcagtgaaatccctgtcaaaatcccactgtcactttttacagaaatagaaaaaaaaattgtgaaatttgtatgataccacaaaagaaccctcatagatgaaacaatgttgaaaaagaataagctggagacatcatactttcagaattcagatattacaaagctatgacaattaaagtaatttttggtagtgttgtgttagcataaaaatagacatatagagtaatcaaacagaatagacagcctggaaataaactcatgcatatttggtcaattgtactttaacaactatgccaagaatatacaatgaggagtgaaatgttttcttcaacaaatgctattgagaaactggatatttacatgcaaaataatgaaattggacccttatcttacaccctacaccaaaatcaactcaaattgggtgaaaaacttcagtgtaagttcttgaaactttaaaactcttagaaaaaaattatgaggaaaagctcttgacattggccctatcaacatttcttggatatgatgccaaaagaacagccaaaacaatagcaaatataaagaattatgactacatcaaagtaaaaatcttctacatagaaaaggaaatgatcaacagcatgaaaagacaatggaatgggaaaaatatttgcaaagcccatatctgataaagggttaatatacaaaatatataaggtactcctacaattcaaaaacaaaatcccaaataatctgatttataaattggcaaagaatctgaataaacacttctccaaagaagaaatactgatggccaacaggtatatgaaaaaatgctcaacctcacgaatcatcagggaaatggaaatcaaaaccactatgagtaattaatcgacagctgttaggatggctatgatcaaaaaacacaagataacaagtattggtgaggatgtagtgaaattggaatcttcatatactgttggtaggtatgtaaaattgtgtagtcactatggaaaacagtatgcaaaattcctctcaaaatggtaaaaacagtactaccacatgattcagaaatctcacttctgagtatccatccaaaataattgaaatcaggactcgatgaaatagctgtgctctcatgttcatttcagtattatttacaataagcaagatagggaaaccacctaaatgtctattgatgataaaatgatggtggatggtgaaaccaagtgtggtacatatgtacgattattcagtcttgaagaagaaggaagtcttgctacatgcaacaacatggataaacctgaaggacattatgctaagcaaaaataagtcagccacaaaagactcatgttgtatgattctactaataggaagtacctaaaataaaataaaaaaaaaaacaaagtacaatagtgattatcagatactgggtagaagggaaaatgggagttgttcattgggtaaaaatttccgttatacaaggtgaatgatttctagaaatctgctgtactacattgtgctcatacttaacaaattttccctgtaaaatattatgttgtttctgtgtgatgttaactaacacaagcacgtatttttgcttttgtttttaatttccacttttaaataggatcgtcatatctcaaaatgtcctaccaatatgtagggacagttatctcggaggtaacactcttttgtaaaatgcagataaaaggaaatgaaaaaagattctaaggaagaggcgcaatataagaatgcttttcttttccattgcagtagtcaggatatataactggatagaattgcctctgtttagagaaataaaaagaatatattggaatcagtaaatgcattttctttgagtaaaagggttagcgcacagatatttgtaactttggagatgtcactcctatagcctcggggttttagaagcaaattctgtgcttgagatgaatccagctgagatcctgtttctcttaatatgagaaagaatgacttataaaagaagatttaaagtacttgtgtaagctttgaactagtcaagctgaaacttaactcccatttcgtctagtaaagctcttagtgccagaatgttttctggttgtagaggataaatgacaatatgtaccagcagtaaattggcttatcttttggaccagaagagatactataaatggaagctaaatgccagttttgacaagttatgaatacaactcccaagaagccaaatacatttttaggattctgaacagctttttcttatgtagtaattagactctggtagaacagcaactaaatggtgtttacaacattacaaataaattttaatttcatccatatcatttcaccccttaggctgaagagtgatgaaacattatttatacttctattcagttctttctttttaagtggaggaagagctaaaggcaaaattcctataaacaaaaggaagctaaaattgaaatctgtaaggaaattataaagtttaaaaaaataataacaattttttcatatatgcaaagaatagcagagtacatatttatttctttgtatttgcagaaacaccatcaagctaagccatttgcaatgtaaatgtttaatctaaatattgtatagaccaaacaagaaatgaagattatgtatttcaaataaaatacaacaccagtaaagaatatatatctatatatatacataaacacacacacacctatctgtagttaaatgtgagagaaaagtatgtgttcaccaaattcaaacaccttaaataatctatatttataaattatatgtggcataggtcttagtgctttatgaatatacaataaatgctttgaatagatcaaatgcctacgaaaataataaagagagtgtcatcttaaaaggtgttctagtggcaatggatattttgccatctacatttatgaataaaataaaaatgtcatcaagattacatattgagattcattctttgataaacagcagggagtaagaaaatcatattctctaatatctggcacatatttgtattgctgtttcaaatagagagaagaataattaaaaagaaagaggtagtacattaagataaactttgctaaagaaatactaagtacctaaaaaagtagatgaatggcacagtattggggttaaacaacatggggatgaacactgcaaaataaagaattttgactcaaaacagtagattcagctaatataactgatggaatttccagggtaatgggaaatactcatattaaatgtgagattataagtattttgaaatatgtttaagtatgtgggatgggcatgaaatagagtatactttctactacattaattgaaatgtgtttttattacaaaacataaaaatattgtacaccaacatatctccggactgctgcaaatcagagggtttggtaattctcaataacttattttatcaaaggcaaaagacaagagatgatataggtttcaagaacaaaactggaacaaattgatcaacacttcatggcaaagatgaaaagactgacaaagtaagatgtagtgacaatgacatgtgattatccaattatctgttggaattctcatttacataaaaactagattgaatattcttgataagccttctcccagttgatatagagaagatactttagatttaattgttaccaattaagaactatttacaatgaaccagagatgaagggcacctaagaaaaaagtaaccctatgaccttttgtgcggacagttcacgattaccagatatgatgcaaataatattataacagcattctgaaaaataggcattaaaaatgttaggatttcttggtacaacatcatagatcacttcaagctaatggtcaggtttttgtccttaataaataaaagaataaaggtacaagctttttgttaagtctgaaaaagaatacctgacaattttaatcagaagtttttttaatgaagaacaaaaaaagagtcataaggcattctaagatgaatgcacattttaaaatgacattcaaagaataaaaaagaaagtcaaggaatctgtgccacatattgctataattgagtatcacatcaaataatatgatttcaatgataacaaagatgtttggaaaaattgctaaaggtaacaaaaaaaggaacaaaattatgttgctgtctaaacagaaaagaaaatattctatagtacaaggcttgagagactttgttatattttgttttgttttgttttaatataaaaggaacctgttgtcaaatgacttgcccaaggtcatatggttgttcagaaacagaattggaaaagtctattgctgacttcgtttgttttaccaaatcaaaactgcctctataaaagctccaaaaaaaaaaatagaatagagacccaaggtatatcataggaatcttaagatacatgaaagctgacaagaggaagtattaattggtcttgtttttaatcactcaaggaatgtgattagaaaggtagaataaaaagatgaaattaatatgacaatagatattcactccaatattcaaagatgaaatgagatacctttgggaagtactgaattattcctctctcaaaatattcacacttgagtaataaatattagtcagaaatgcaggagttgggattcaagaatcattgggatggtaagaataaataaaattttgtatctgagaagtcaataattaaaattacatgtcaaaaggaatgattctggggaagtggcaagcatttatttacctgagaacttaatagcttaatttcctaagaatttgagaaccgttcaagtaagccttagtttgaaggctgaggaacgaggcaatataatattgaaaacatttgaagtttttaaattagttaatgagccactacaaattacaaaccactgtgtgcctgataatatagttggtaccttgtaagtgaatgcaaagcaaatagatgaaagagcaaattaacttttagaaaaagtatttaaaaataaagtggtccttcttcattactcagcttttcattctaaatttatcaacaggccatatgacgtattatttgttttcattttcattactccacttaaaaacatgaattttgtttacatacaatattaagaaagaaacagccaaatctaaagcagtaaactacctcagataataaatagcatttattcattgtgttctgtttgacctttatgtacttacttcttggtttgtgagttgatgagagatctctaaattacactgtcctggaccaaattgcagagtaccttgtctgctttctgacttggagtcacagttcatcttgaccttgctattggtataagtatcagattgggtaatgaccttatttttttgctatattgcagtccctagttatccacttggcatttatggtcagcttttcatttacagcctggtgctgacattccccagacaatactgtatgttaccctattagcattagtgctcgctatccaaaatcatgcactaacataaatcctccaggtctcccagacacattgtgctgtgaaattcttatgaacttgaaacaatttaccagataatcaactgttttatctaggagtataccacatcattattcacatacctgctattttcccactgacatgaaacatgttttctttcaaaagtcaaaagaaaaattaattatattttattgtgtttataagagcaaattactttgtgaggcatagaaaaaactatctttgaaacatagcagtacaattagacttaagcaaatagcacttgtaagatttttgaagatatttgatttctattctatacctttaatgactttgagaaaatatgtgtagcttgcatttcaaccatttaaaagcaaaatgacttacattaatattaatttatatctcctgaagcatatcactcatttttaacacagcattatgcattgtcatatttattcgatgctaattttttaagtgacaatattctaaaagcaattagcaattttattgtagtacaaaaaatagacaaacccagtattcatttcatttttttaaagtcaaagaggctgaagaatatcatggctctttctactttttttatgtagctataaacaataggcaaatatttatacagaaatttaatttcctttaattaaatatacttcaatgtcctaatttatgtataaaatataatgataaataaaagtattttttaaactttaaatttttggggaaagtttaacaggaatgaatttcagttcaggcttgataatttcacacagagaaataaaaattaagttaaaatgctgaattttaaaactctgctggcatatcatgacagcttttcagggaaaacatctattttcctttaataagattatgaaaattaaagctcattattgtgttacaaagatatagtttaacaaatgctattaatttcattggtcttaattgttttattaggatataattatttaaaggtgacaacattcataaattagttttctttaaatttgttcaattgcagatgtgacatgacatgactgtacaaaagtgtgtggtttaaacactggtcacctaacttattaaggatctattttgtttttcttgttttaacatatggcagtagttctcagagtgtggtctttgaggttggcagtatcaccatcacctggaaacttattagaaaagcaaaatctctggcctctcatcctagctgactgaatcagtaactggggagagggtcaagcattgttatgtcttaacaagtccaatggataattcagatacacattaaaggtcaagaatcattaacctatgagttttcagctgtggtgtcatattagaatgatcagaggtgttaaaataaatacatgcataagtcttatgctataacaattgaaataaattatctggtgagaagacacagtacttattaaagaaccatatttctaatgtatagccagggctaagaaccactgattttacctaacatccaatagagcttttttattcctttttcctttctctggacctaagagtgttctttcactgaccttttcattcaaaaattactatctgatcaccagactctaatagtcaatgccaagtcttcccatttttgcctaacatcctgatgggacccatgctgttgacttattttgtattgtaagtgacatatcaatttaaataaactactatatccatacacaaataacattgtattagtgatttttaacaaatacaaaggtgacccacaaagttcactgcttctttaggctactcatcttatcccattagatcttttttccagtaagtatttagatgatgttatgcagtaaaaacgcattataagtccactgaatttcctgctcacttaataacctagcttgttcctactatgctactatgctatagcattaatagtcacccccagaatcaaaattattacctaacaatgagattatgaaaatgtaatgctaacatagaaatgcagtcaggtggtaattcttcaggcctaacaaactcccagtcatgctagggatttactggtcattaaaaatgtttgaatgtccagaaattttaagtatcagtttcttttatcttgttgttcatgactctaagttcagtgtttctcaaactgttgtgatacctaagaattaacaacaaggttgcattatagaacattataaatacagtactttatttgtgaagtagataattttcaaaggagtttatgttaataagatgcttaagtattaaacattggaagtgattacactatcatcacttccaatgtttttctaaagcaaaaatagttaacgattcttttctgaatgttacttatgaattcatgctttgtgggagaaacagattattttacaaaatgtcttataatgtgtccttcaatgtttagaatgttgtttctttactatatttaataaaatatcaattactgacacattttaatttacatctttcacataccatttctaaataacttcattgcaaacctcatagtatcaagcccacaatttgagtaaatgctaacatattttttgttgcttcaagtctctcttactcatcctaaatgcagatgttgaaaagtttttaaaatgtaagaatttttctcatcatggaaaaaattggaagtaactgttttactcaatatctt

SEQ ID NO: 2517 - DNA, 6582 bp, Homo sapiens
ttttttcaattttttttcaatttatggtagaacattgattagaacatttccttccataagaagtagtaaataatcaacctcagaattgtattagtcattacataggaaacagttacagatatactagagtaataatacagaaatacaaaatgaataaaactttaaaatatgataaccttgcatgagttgaaaaaaattttttcaaatagtccactcattacagatatgcacttcagatatgttttaattcatggtcctcataaaagagatcaaattggactatattaaaaatattaagacttcttatgatatccttctctttaggtttgattctaggtaattttataattatttcagatatttcttatatctaccttttatatcaggcattttaacgagatagttcagggacaatgttctctcctgggttaatttgggtacttttaaagttcagctccttctccccggatgacaccatggagctctcaacatctttacttaaagagataggatacatgtattaaaaacaagtacttggccaattagaatattatggagttagaagagaggcagctaaatttttaaaaaatgaaatgtgtttcttcagatttctatattcattattcaaatgcgaaaagtaactttttctttggatgaaaatctcagtgatagtgtgtgtcaaacatttttggtacaattgcataattaaactctccacctcattttaaggaggtctggtcatctgcatactgtcaaaaggatttttttgtgagttgagatagattgcttaaaaaagtcatcctaactctgaagagcagctggaaaaataaacagtcaggacttcagccaactatcaatctagggaaacttggtaaccaacaaagaatgaataaattcctttctctgttcttatagcagaagtaagaatagtcaagaactgacctatatttgctgatagtaagcttatccaaaatacaatagcaacaaccaacaaaaaactcactcatatttttccaggacctaggaggattcctgttttggccctccatctgcctgccttcttacgcctgaaaaattttctgcctgatcccaggtttagattggaaatgattatgaagaactgagcaaaagatagaaaatattaacctgtggatctctgtctccatctcctgtatctccccctgtgtgagtgcgtatgtgtggtcagtccctcctcagtaataggtggacactattttcaaatctgaactttcagaaattgatgttaggtttctcttttattttgtttgcaattaaagttaagatatatatctcattgagtgactattacaaagcctaaggtaagatcatggcctgtcttcctcaacattgtgtgcctggagttgagtttccacaatgtaatgtttttgatattctttcaatgagctgtactagttacatagcactaagagattacaaaagaattagagagagattttcctgaaagacaagtgactaaagatttcaccaaaacttactgaggctaaacaaaagttacttagtccatgggcctcttgtaatacccgtgattacatctgcaatcagaatgttggctgtctagtaaattatgtatgattctcactttgtaatgtggattgccttattttttaaatcagtgtttctgttgacttttgagtacaaggtgaaaacatgactttgcaattgttatagataacataagaatcatgtagataccaatttctaaacattagatgttcatattgggaagaataccagttagtgccttttgtgtaaaccagacctagtttaatgcctgttactccagccaagcaactgttcggaccctttttccttctcaaatgtgtcctagtatgaatgataaattagtaaagtatgtacacatgcaggatatggcattagcacgggctattcctgtctgcgttagaaatgggacagcaaaatgttacaagccaagatctcatttgtgaaagtctgcagtttcactaagcagttgacaaatggatctgctaaacgtgccaaccatgtcaaggtaaatgcagaattttaactaatgaaagttaaatccatttgttctgagatatgcaactaactaaacatcttgctgcttttggtttttcctgatctacactcaatccacttgtatcagttggttcagatggatctaaaagctaagactaaaaatgactgctaagaataaatcttgattgacttcttttgtgtattttatatacatttttagagaggacctatcaccatatttacattcaaatttatgtgttcagttagagagcttctttaatgattttcagctagcaagtttactttggtgtaaattttaaaataaaatttcttgaagcctttgtggatttgctttctattactactgtaatgaaacactacagatgcagtggcataaaacaacatttattctctaacatttccggaggtcggaaatctggaatcagtcttattaatgtaaagtcaaggtgtcagcaagactggattcttctgcaggttctgagggggaaatctgtttctttatctttttctcagcttctattggtagcctatattatttggcttgtaccttccttccttcagctttaaaaaataacactccaatctctgctttgttatcatatcaccttctctgtctctgattctgtatgcaactttttaataaggacctctgtgattatatcaggccccatctgataatcaggataatctctttatctcaagatacttatcttcaacgtatctgcaaagtcctttttgccatgttagataacatccataggttatggggattaggacacagaggacacaggggaaaatttgggtaccattattcagcccagcatactctggatgctcagaaactgttgaagaaagtttacgttctggtttctttcccaaatatttgtgaaactccttctaaagtactgagctttaccatatgtacagatagaatggctctaaatcctgttaataagcatcttggtagaagagctgctatcttgaggatccaaaacataatatgaaatagattcacataaataacctgaccttattttgtttttctttcacaaatgatttattcttaaccatagcaggcgaatttttaaataataaaacttgttaaaaaaagtttttttcaattatttttcctgtttcagcactagtaaagacatagtgacattctcaatttctctaagacatttaaaatgtctatatgtttcctttaaatataaatgttttaactattcacaagcattgcactaatttgaatgaattaatctatcacttcttatagttgttttaatttattttatcacttacaaaagttccgctgaaaaaaagcgagatacaagataagcttgcaactcctttggtgcttactcttgtaaatgaataatagcataaaaatcaaatataaaagtgtgagagaagaagcttatgaattcattattagaggtctcccttaaacatttcttactctatagctaatatcaattattatagccaatcaacagaaaacatgtggatttataaagtacttctcattggaaattagtcaatttacatatcatgcatgtaaaggtaacattggcatagcagtaattcctgagcatttctgtattagtccattctcatactgctaataaagacatacctgagactgggtaatttataagggatagagatttaattgcctcacagttcagcatgggtgggaaagcctcaggaaacttacaatcatggcaaaaggggaagcaaatatgtcctttttcacatggcagcaggaaggagaagtgctgagcaaaagggcaaaaaagctccttaaaaaaaaccatcagatattgtgagaactcactcactatcagaagaacagcagcatgggggtaaccgcccccatgattcaattacctcccactggttccctcccataacacatggggattatgggaactacaagtcaagatgagatttgggtagggacacagaaaaaccatgttaatttttatttttgtcctagatctattaagatactggtaaatttcctgtacatcaaatccttcacacataatggaagttatgtggtaactttgatttctattaatcttctcagttgaacacatctgaagctttattattgtttgctgcctaggaaagaacaagccaaaagggcccagataatactatttaaggttgaccaaaaataaagtttctaccactttgaatgactaacaattttatggcaataaaaccacatgagaatgacttaaacatgaatcctgtgaaagatgcttcttacgttatttgaaaaaattcttccaagtaaaagcacattgttgtttgcttatttaaaatatgagagtaatttaaattattaaaatatatcatagaactagaaaaacagtaacacatgcacatgaacaatatttaaaagtgaacagctagtttgaggatgctgctctctttcaagtagtactttaagcataagccaacttccctcccaagagtcagtacaagtacaggataaactactcaattaatgaagttctttcagagagccattgagaaatatgtccacgaaagagagagatgagaggagatgtaaggcatagaacaggacatgaatgaaatggatcatgatcgtatggtattattgaagctacatcagagcaattcagtggctatttgattttgttattttatgcttaatacatctgggatcctacctctttctccccgttttcttaaaaatgaagtggagcaagctctctgttattatcacacaagttcattctacttaacaaaactctttcaaatttttcacctacatgactaataatatacatagaggaaaaaaatcaagcaaatttaatgtaagcaagcatttcagaaggaagaactgaaaagcaaagtttgtgaccaagcagtacatatatatatatatacacatttgtgaccaagcagtgtgtgtgtgtatatatatatttatatatattatatatatatttatgtataatatatatattatatatatatatttatatatatatatatctcattctgaaccaaaagtgcttagtctgttccaacaaagcaagaaaataacaagaaaacaatttgtcctaaccaattatgtgcatctaactgtcagacgcaatgcccacatgaaccagaaaaagatttcccaatctggaatctatctcctgttattatggtctgctagtctgaaacagtttttcttttgtaagtctggggttctctaactttcataaagttgtatgcatttgatctttccttttttcttactattttccactttctgcaacctaaacttcctctaaggaagaatttttcaaccacaacgatattggcattttggactcaatattgctttattgtaggaaactctcctgtgcactgtaggatccttagcagcaaacttggcttctatagccaaacgccagtagcagccctgatctctacttgtgacaactaaaaatgtctttagacattgccacatattacctaaggggcaaaatcacacttggttccttcagggatcttcctgattctgactctaactattccttttcaaagatgtctgcgactctcagcacaaattatggcactgacaacccagtccctaagtgtgaagaaactgtctccgaagactgataaataatgaatatattggtgtgtttatttggtttggggtacaatcagaagatatctttcacagattaaaatgtaattggtaaggtgatagatggtcacagtatttctgtttaattcaggctttagtagatcagcatagcatgaatttcagattttgcaattttgtgtatatttgaatactaatattttgagtgtcataacatacttagcttacgcaatgcctcttctttctttctttccctccctccatttctttctttctttcctttctatttctttctttctctctcttttttttttttttttgaaacaggatcttactctattaccccaggatgaagtgcagtagcacaaccatagctcactgcagtcttaattcctgggctcaaagtgattatcctactccagcttcccaagtagccaggactatggatgcgtgccaccagatcacactaattaaaaaaaaaaaatagaaattgcatctcatgatgtattccaggctggtctcgaactcctggcctcaagccatccttctatctcagtctctttgttagtttggattacaggcctggctgtaacgcttctttctttgaccgacttttatattttttgacataaaaccataatgcaaattttttttatgtatcacttaatttttcccaccttgcaacaaatgcatcttttcccatgttctatgtattgctataaaatgtaatctggctttccaggcttggtcaatttagctctgactatctcattactaagaaagagttctcctgctcagtttctatagtctgcgcacttcctataagggagtccctccaaatagggttccaccaactacatttggcataatttgcctttagg

SEQ ID NO: 2518 - DNA, 151756 bp, Homo sapiens
atgaaataggttttatttaagggatttggggtcttgattttaaatgtatgtttatggatatgggaatgctgtgggaaaaaaaacatataatcatggataaataatcagattagaaatccagaatgcattccagctgtaggattcgtattgttgttggccggctttgttctggggatggggggaaggggtgcagtgtatccaaacttgccgcatgtaactacacttcccacaggatttgtttttttagcataacaacaaatgcttatacacttaaaagtgagagttaaacagtgtttctttattttgattagccatccagtagtttaaccctgacttttttccactctggttttctaacctcaccagtggcaagagttgaagaaaaacccttagttttcactgggaacctcataacttttttttaacttttattttaggttcaggagtccatgtgcaggtttgttctataggtaaactcatgtcacaggggtttgttgtacagattatttcatcactcaggtattaagcccagtacccaatagttatttttttctgctcctcttcctcctcccaccctccccacttaaggaggccccagtgtctattgtcctcttctttgtgttcataagttctcatcatttagctcccacttataagtgaaaatatgcagtatttggttttctgttcctgcgttagtttgctaaggataataacttccagttccatccgtgttctcacaaaagacaagatcttattcttttttatggttgcatggtattccatggtgtatatgtaccacattttctttatccaatctgtcattgatgggcatttaggttgattctatgtctttgctattgtgaatagtgctgcaatgaacattcatgagtgtgtatctttatggtagaatgatttgtattcctctgggtatatacccagtaatgggattgctgggacaaatggtagttctgctttcagctgttggaggaactgccataccgcttttcacaatggttaaactaatttacactcccaacaacaatgtataagtgttctcttttctccacagcctcaccagcatctgttattttttgactttctaatgataggcattcttactggtgtgagatggtatctcattgtggttttcatttgcatttctttaataatcagtgatattgagctttttcttcatatgcttgttggctgcatgtatgtcttcttttgaaaagtgtcgttcaagttctttgcccacttcttaatggggttgtttttctcttgtaaatttctttaatttccttatagatgcaggctattagacctctctcagatgcatagtttgcaaatgttttcttctattctgtaggttgtctgtttactctgttgatagtttcttttgctgtgcagaagctctttagttcaattagatcccatttgtcaatttttgcttttgttgcaattgcttttggtatatttgtcatgaaaccttgctcattcctgtccagtagggtattatctaggttttcttccagagttcttttagttttgggttttacacttaagtctctgatccatcttgagttgatttttgtatatggtgtaaggaaggtgtccagcttcaatcttctgcatatggctagccagttatcccaacaccatttattgaataggtagtcttttctccattgcttttgtcagctttgtcaaagatcagattgttgtaggtgtgcggccttatttctgggctgtctattctgtttcattggtctatgtgtctgtttcagtgccatgctgtttgagttattgtagccctggagtatagtttgaagtcagagagtgtgatatctccagctttgctctttttgctcagaattgccttagcattttgggctcttttttggttccacatgaattttaaaatagttttttctaattctgtaaagaatgtcattgataatttgatacgaatagcattgaatctgtaaattgctttgggcagtatggccattttaatgatattgattcttcctatccatgagcatggaatgtttttctattagtttgtgtcttcactgatttctttgaacagtgttttgtagttctcattgtagagatctttcacatccttggttagctgtattactaggtgttttattcttcatgtggcaattgtgaatgggattgccttcctcatttggctcttggcttggctgttattggtgtataggaatgcaagtgatttttgtacattgattttgtatcctgaaactttgctaaagttgtttatcagcttaagaagcttttgggacaagactgtggagttttttagatgtagaatcatgtcatctgcaaacagggatacattgacttcctctcttcctattggatgccctttatttctctctcttgcctgattactctggctaggacttccaatactgtgttgaataggagtggtaagagagggcatcattgttttgtgccagttttcaaggggaatgcttgagcttttacccattcattatgctgctggctgtgggtttgttacatatggctcctattattttgaggtatgttccttcaatacctagctattgagagtctttaacatgaagtggtgttgaattgtatcaaaagcttttttctgcatctattgagataatcatgtggtttttgtctttagttctgtttatgtgattaatcacatttattgatttgtgtatgttaagctaaccttgcatactcacaatgatgtctatctgaccatggtggattagctttttgatgtgatactggatttggtttccaagtattttgttgaagatttttgcaatgatgttcatcaaggatattggcctgaagttttctgtttttgttgggtctctgccaggttttggtatcaggatgatgctggcctcatagagtgaggtggagagggccaggcacggtggctcacgcctgtaatcccagcactttgggaggctgaggcgggtggatcacgaggtcaagagatcaagaccatcctggccaacatggtgaaaccctgtctctactaaaaatataaaaattagctgggtgtggtggtgtgcacctgtagtcccagctacttgggaggctgaggcaggagaatcgcttgaacccgggaggtggaggttgcagtgagctgagatcgtgccactgcactccagcctggtgacagagtaagattccatctcaaaaaaaaaaaaaaaaagaatgagctggggaggagtccctcctcatcaattttttggaatggtttcagtaggaattgtaccgtctcttctctgtacatttggtagaatttggctgtgaatctatctggtcctgggcttttttggttggtagggtatttattactaattcaactagagagaccattattggtctgttcagggaatcaatttcttcctggttcagacttgaaaaagtgtatgtgtccagaaatttatccatttcttctaggttttctagtttgtgtgcatagagaacttcataactttcatccagttcagttacatttgagggtttcttctaacaaatgcatagtactttccattccccttccctcccaccagtacacataggtttgtttggttgtttttaattggttagtctgatgtaaaaatggaaagatccgttaggcatcgatttggagtgtcaggttcagatgaaggcaagaggcagggaccatcggtccttagtatctaaatgaacacttcaggatggccagcctctgcagacatcttggatcggacaccactcaccatgaatgttgcctctctgacggaccacctgttgacccaggagaagccaaagctggagagccccagagtgagggaaggagttattctggaaatgtcacctcccattttctaatttgggatcttgactctgaatcttcatttgaatgcaggtgaattagaccatctctcatgttctttccaactctaaaatttcatccaagcttgattccctttatgggcccatgaggtctcagaggtcatgcaggaaaattaataataactgtgccccaggaattaaaggtcaggaccctggaaataaagtctggagacttaagtgtacaattgctaggagagccccaacatgtgatttttcttcctctctaaaattatgtatagggaagatgattatctactagaggtgttgtattaattaagtgagataatgtgtaaaacgtacggcacagtactaggcacacagtagtttctcagtgaaaggcattgaatgaatggctaagtgcataaaaccatcaagcaagcaacttaccccaagcatctcaattagcaaggcacagagccaggatgcaaactgagatcctctgattttaagtctagggctcattcccctgttatcgtacctactgatatgtccccaaagttggttgtctggtagttaattgtggtcattctgaagcagaagttctgcctagacattcattccaaattatctggttcaaggtaaggaatctcatctcattgttggaatctctcaggtggttggcaagagcttgtgtccaaattgtacacaaatcacctgggtcttcctcctgtattaggtccagcattcatacctttacttatttccattaagcatttattgagatcttccttggagtatatgctgtaaagataataaatcttgcgtctgtaatctttcattacagaaatacaaggcagggtccttaggcatctgggaagatgaaacaggcacacacaagagttgaggagcagcacaaacattatgcaaagagtcaaagagaattcctcaaatgagaatgcaccgtggaacaccgagaagagggggcttgatggggactgggagatgagctacaactctatcttgaagggttttcctgaaggggaagatttagactgttccctgaactataatgttcttctctcaggtaccctgctgagtgcagggaacagtctacatcaaaaatagaattctttactcaccaaaatggtgctaatactagtagttttcaagcattatccatatcttcttacacagttgttctcaatgcatggccatgagcatcaggatcacctgtgggttgtggtataacaaaaaatatatttggtctttgtctctggttcccagcacaaagctcctaagactcttgaaataccgtgagtgataggagcatcttttttatacataaggagctcctttcaagccatatgtgagtttatgctaataaggtgactcttatggtttggacgtatgtgtctttccaaaattcatatgttggaatctaagacttgacatgatagtattaaggggtgggggcaagccgggcgtggtggctcacgcctgtaatcccagcactttgggaggctgaggcaggcaggtcacctaaggtcaggagttcaagaccagcctggccaatatagtgaaaccctgtctctactaaaaatacaaaaattagccagtcgtggtggcaggcgcttgtaatcccagctactcaggaggctgaggcaggagaatcacttgaacccgggaggcggaggttgcagtgagccgagattgcgccactacactccaggctgggcaacagagcgagactccatctcaaaaaataaattaattaattaaattaaattaaaaaagaggtggagggtctaggaggcaattaaatcatgtggattccaccctcgtgaatgggatgggcacctgtgtgaaagagctcaagggaaccagctaggccttttgcccttctaccttctgccatgtgaggacacagtgttggtcccctctggaggatgcagctacaaggcattatctgcagagcacagccctcatcacacactgaatctgccagcaccttgatcttagactttccaacctccagaattataaaaaaattaatttcgaccgggcatggtggctcacacctataatcccagcactttgggaggccgaggcaggcggatcacgaggtcaggagattgagaccatcctggctaacacggtgaaaccccgtctctactaaaaatacaaaaaattagccaggtgtgatggcaggcacctgtagtcccagctacttgggaggctgaggcaggagaatggcgtgaacctgggaggcagaggttgcagtgagctgagactgcgccactgcactccagcctgtacgacaaagcgagactccatctcaaaaaaaaaaaaaaaaaaatttctactgggaggccgaggtgggtggatcacctgaggtcaggagttcgagaccagcctggccaatatggtgaaaccctgtgtctactaaaaatacaaaaattagccaggcatggtggcgggtgcctctaatcccagctactgaggaggctgaggcaggagaatcgcttgaacccgggaggcagaggttgcagtgagctgagatcacaccattgcactccagcttgggcaacaagagcgaaactctgtctcaaaaaaaaaaaaaactctattatttataaattacacagcctgaggtacttggttatagcagcacaaatggactgagacagtgggcccatagttttatgggaaaggctggccgcaacagaaagaccaggcatgtgattagcgggttagaactttcagccccaactcccaacttccaggaaagggagagggactggagatcatgcctacaaaatgaaaactcttaaatgatgaggttgggggaacttctagtttggtgaacacattgataggccttgagagggatgcaacagagagggcacggaagccctgtgcccccaccccttcctagccctgcagatctcttctatttggctgttcctaaattataccctttgtaataaggcagcaattataagtatagggttttcctgagttctttgaatcattctagtaaattgtcacacctgagcaggctggggggcctgaggaaactttgaatttgtagccaagttaagcagaagcccaggtagcctggggtgctgagacttgtggctggcatctgaagtgaggacagttgtatgggctggagcccttcaacctgtggagtctgatgctaactccagatagttagtgtcagaatagcactggtgtcagagaattactcttcgaaaacagcataggggtatttattgcaattcagattcctaagcccacaggacaaactgctgaatcagactgtaggtaggaccagggaagctgcccaggtgattctgaggcacatcaggttttgtgaaccactatcatagcttctgctttggcaatttccatatcaaacccagagtctatcctgccagaggcactaagctcagaaccctggcaatgaaccagcttgccaatggtacttctcctgtggaattggagagactgaacaatagacacttctagcatttgcgtcccactatttcaagaagcatcttcatcagtccttcccacctggcttctttctacatgacccctttgggaaaattctgtggagccaaaagggaggggtgtatgcctcaggttagctctttcctattaataaatcctctccagtttaggaagcccctcatcagcctgcaaggcttccatatctctagaggctttaaggctgtgtctgctcatgttggggaggggggaatacccaaagaaaagtgtggaaagtccatgaacacccccatctccactcaggcaggagagggcattcctcaggcccagaagcctctacaagcctgaagagcagggacacagagtaaaaatatttctgtctttggtcaacaacatgcacccagatggatgttttttaatacagtagagaataaaaataaaagcaaaatacacaaaaaaatcgtccgcaatcctaccacacaatgacaaccacggttggtcctgtatttgcatttacttccagtctttctctacacattttattttgttttattttattttattttattttaattttattttgagacagaggctcactctgtcgcgtaggctggagtgcagtgatgcaatctcagctcactgcaacttccacctcccgattcaaatgattcttgtgcctcaacctcctgagtagctgggattacaggcatgtgccaccacacccagctaatgttttctttttttttcttagtagagacagggtttcaccatgttggccaagctggtgtcaaactcctggcctcaagtgatccacccacctcagccccccaaagtgctgagattacaggcgtgagccactatgcctagcctctctacgcattttaaaaacaagcctgagatctgttttcatgttaatgactagtttccaggacagtaaacagaaaagcacagtttcttcaggttcctctcagcagagcacgtggctttcagcatccaacagcttttgttccttgtgccatggaaaacctactctctcaaggaaggcttttttagtttttacttgcctgttcattaaaaaaaaaaaatccaaacaatatcaaaatacatagtctttctccatcccatggttacagattcaccttttcatataaaaacatataggatatacatctatactgctttttaatctataaaaaattgagtaataatgtagattctctttggtgacttattttttaaacctaccaacatactgtggataccatagattttttagggagaaaaagagaaagcagaaataaaaactgggctagaaagtgaaaacggcttctttaatctggatgccaggaagaaagtatgtacgaggtttgctatgctaattgaaaccacatcccaagactattatatactttgtcctaagtatgggattgagaaatgtaactacgtgggttgccatttcttaaagcacccagaacaaataataaatgtatggaaatatggcctaagaaaaggtgtaaaataagtcttaatcacatgccatatgtgattaagcatatggcataagcctgaaattatactttctttttttaaacataaaatagttagaaaatagtgaatgccaaaactagatttaccttttcctttgaaaaaaaccaatcaattagttctcttttttttagaattttatattatattttatttttttgaccttgagaaagttactttttttccataagttattggggtacaggtggtatttggttacatgagtaagttcattagtggcgatttgtgagattttggtgcacccatcacctaagcagtatatactgcaccatatttgtagtcttttatccctcgcccccctcccacacttgcccccaagtccccaaagtccattgtatcattcttatgcctttgtgtcctagtagcttagctcccacatatcagtgagaacatacgatgtttggttttccattccggagttacttcacttagaataatagtctccaatctcaaccaggtcactgcaaatgctgttacttcattcctttttatggctgcatagtgttccatggtatatatataccatggtttatccactcattgattgatgggcatttggattggtaccaagattttgcaattgtgaattgtgctgctataaacatgcatgtgcaagtgtctttttcaaataatgacttcttttcctctgggtagatactcagtagtgggattgctggatcaaatggtagttctactcttagttctttaaggaatctccacactgttttccatggtggttgtactagtttacattcccaccagcagtgcagaagtgttccctgttcaccacatccatgccaactttcatacatgtccgtgtgaagagaccaccaaacaggctttgtgtgagcaacatggctgtttatttcacctgggtgcaggtgggctgagtccgaaaagagagtcagcgaagggagatatgggtggggccgttttataggatttgggaaggtaatggaaaattacagtcaaagggggttgttctctggtgggcaggggtggatctcacaaagtacattctcaagggtggggagaattacaaagaaccttcttaagggtgggggagattacaaagtacattgatcagttagggtggggcaggaacaaatcacacggtggaatgtcatcagttaaggctgtttttacttcttttgtggatcttcagttactttaggccatctggatgtatacgtgcaagtcacaggggatgcgatggcctggcctgggctcagaggcctgacattcctgccttcttatattaataagacaaaacaaaatagtgttgaagtgttggggcggcgaaaatttttgtgggggtggtatggagagagaatgggcaatgtttcttagggctgcttcaagcaggattaggggcggcgtgggaacctagagtgggagagattaagctgaagggaggtcttgtggtaaagggtgatattgtggggatgtaagaagaaacatttgttgtatagaatgattggtgatggcctggatacggttttggatgaattgagaaactaaatggaataagagaaggagaaaaacaggtataaaaggtctaagaattgggaggacctaggacatctgattagagagtgcctaaggagattcagcatagtcctgccagcaaagattatttatttacttcaagagtttagagtggcagtttggggatagcaccaggagatatcagctgtgatggcttggagaaacagtgtaaaccggcagtgtaaacaagagcagggcatgtatgagtagttgagaacggtgaataggagtatgactggacaaaagatagtagggatgacaagtttttttggggcacagtctaagttggtctggtgtcaaatgagactggggcctaataaaaaggagcgtctatacaggagcttaaatgggctgtaccttgtagcattgaggacaggcctgaattctgagaagcaaaagtggtaaaagtattgtcagtccttttaagttggtggctgagcttggtgagctgtgtttttaaaagatctttagtccgttctacttttcttgaagacggaggaccgtaagggatataaagttttcactgaaacctactaagagcctgaaaaactgcttggctgatttgactaataaaggctggtccgttatcagactgtatagaggtgggaaggctaaactgaggaattatgtctgacagaaggaaagaaatgactgcggtggccttctcagaccctgtaggaaagacctttacttattcagtgaaagtgtctatttggactaagaggtattttagtttcctgactcaggcacgttgagtaaagctaatttgccagtcctgggtaggggcaaatcctcgaacttgatgtgtagggaagggagggggcctgaataatccctgaggagtagtagaatagcagatggaacactgagaagttatttccttgaggacaggtttccacgatggaaaggaaatgagaggttctgagaggtgggctagtggcttgtactatagcataacctgcctttgctggtatgcggcgattaggcctggtggaactgccatcaataaatcaagcgtgatcagggtgaggaacaggaaagagggaaatatggggaaatggggtgaatatcaggtggatcagagagatacagtcatgggtgtcaggtgtggtatcaggaataatgtgggaggccggattgaagtccgggccagaaacaatggtaattgtgggacttaaagagtgagtacagctgaaggagccgggaagcagaaagtatatgcatcaggtatgaggaagaaaatagattttggaagttatgagaaatgtagagagtgagttgagcatagtttgtgattttgagggcctctaaaagtattaaagcagcggcagccgctgcacgcagacatgagggctaggctaaaacagtaaggtcaagttgtttggacagaaaggctacagggtgcggtcctggctcttgtgtaagaattctgaccgcactaaccatgcctaggaaggaaaggagttgttgttttgaaagggattgaggtttgggagattaatcagacacgatcagcagggaaagcacgtgtgtttttatgagaatttggccgagataggtaacagatgagggtgaaatttgggcttgactgaagtaatgggggctgtctgtgaagccttgcggcagtacagccaaggtaatttgctgagcttgatgggtgtcagggtcagtctaagtgaaagcaaagagaggctgggatgaagcgtgcaaaggaatagtaaagaaagcatgtttgagatctagaacagaataatgggtagtagagagaggtattgaggataggagagtatatggatttggcaccacgagttggataggcaaaacaatttggttgataaggcgcagattctgaactaacttgtaagccttgtctggttttaggacaggtaaaacaggggaatggtaaggagagtttataggctttaaaaggtcatgctgtagcaggcgagtgataacaggctttaatccttttaaagcgtgctgtgggatgggatcttgacattgagcggggtaagggtgattaggttttaatgagatggtaaggggtgcatgatcggtcgccaaggagggagtagaggtatcttatacttgtgggttaaggtagggggatataagaggaggacacaaaggaggctttggattgggaagaagggcggcaatgagatgtagctgtagtccaggaatagtcagggaagcagataatttagttaaagtgtctcagcctaataagggaactgggcaggtggggataactaaaaaggagtgcttaaaagagtattgtctaagttggcaccagagttggggagttttaagaggtttagaagcctggccgtcaatacccacaacagttatggaggcaacggaaacgggcccttgaaaagaaggtaatgtggagtgggtagcctccatattgattaagaaggggacggacttaccttccactgtgagagttacccaaagctcggtgtccgtgatggtctacggggcttccgaggcgatcgggcagcatcagtcttcagccgctaagccgagaaggagtcagtcagagagccttgggccagagttccaggggctctgggagtggctgccaggtgagttgaacagtccagtttccagtggggtcccgcacagatgggacatggcttaggaggaatcctgggctgcaggcattccttggcctggtggtcagatttctggcacttgtagcaagctcctgggggaggaggttctggaggaagcctggctgctgtggttcaggcgtttggaagttcttgtgtgctggagatgtggctggggtttgtctcacagtggaggcaaggaattgcaacttttttctattattgtacaccttgaaggcgaggttaattaaatcctgttgtggggtttgagggccagaatttaatttttggagttttatttaatgtcgggagcagattgggtaatacaatgtatattgagaataagatggccttttgacctttcagggtctagggctgtaaagagtctcagggttgctgccgaacgagccatgaactgggcagggtttttatatttgatgaaaaagcctaaacgctatctgatttgggataaataaaaaggagcattaaccttgactatgcctttagctccagccacctttttaagaataaattgctgggcaggtgggggagggctagtcacggaatgaaactgtaagcccgaccaggtgtgaggaggggaagcgataaaaagattatagggtggaggagtggaggctgaggaagaattgggacctagcttggcctggctaggaggggagaggtcagatgggtctgtagaaaaggaagattagaaagactcagcgatgcttggcgttgggactgaggggacaggcgggagatttgggacgagttgcattgggcacagagactaggaatggactgatgtgtaaaagaatgcctggacgtcaggcacctcagacaatttgcccattttacgacaggaattatttagatcttgtaggacagaaaaattgaaagtgctgttttctggctatttggaactactgtcgagtttgtattggggtcaagcggcattgcagaagaaaataagatgcttagattttaggtcaggtgagagttgaagaggttttaagttcttaagaacacaggctaagggagaagaaggaggaatggaaggtggaagcttgcccatagtgaaggaggcaagcccagagaacagagagcgtagagacacggagggaagtggtttgggggttcttgccccctagaaaagcaggacttgccgctaagggtgaaggagaaggggttgaggggtacttgcccctgccccaggaaagcgggacttgccgctaagggtgaaggagaaggggttgaggggtacttgcccctgccccaggaaagcagagaaggggtagagacaaggagagaaggggttgggctacttgccccttccccagaaaagcaggacttgccgctaagggtgaaggaccaaggcaggtgtccctgcgtggtctgacacccttgaaacgtgggtgtataatcagagaggcgtccctgcattgattaaacaccaagggaaggctgccttcccagtccgtgaccggcgccggagttttgggtccacggataaaacgtctcttttgtgtctaccagaaaatgaaaggaattgaaattaagagaagggagagattgaagcgtagcgccaagattgaaaggagaaagaggttgagggatagtgagggaagttggagaagagagtaaaaagaggccgcttaccggatttgaaattggtgcgatgtttcttgggctggtcggtctgaggacctgaggtcataggtggatctttctcacggagcaaagagcagcaggacaggggattgatctcccaagggaggtcccccgatccgagtcacggcaccaaatttcatgcgcgtctgtgtgaagagaccaccaaacaggctttgtgtgagcaacatggctgtttatttcacctgggtgcaggtgggctgagtccaataagagagtcagcgaagggagatacgggtggggccgttttataggatttgggaaggtaatggaaaattacagtcaaagggggttgtcctctggtgggcaggggtggatctcacaaagtatattctcaagggtggggagaattacaaagaaccttcttaagggtgggggagattacaaagtacattgatcagttagggtggggcaggaacaaatcacaatggtggaatgtcatcagttaaggctgtttttacttcttttgtggatcttcagttactttaggccatctggatgtatacatgcaagtcacaggggatgcgatggcctggcctgggctcagaggcctgacaccaacatctactgttttttgattttttgattatggccattcttgcaggagtaaggtggtatcgcattgtagttttgatttgcatttccctgatcattagagatgctgagcatttcttcttatgattattggtcatttgtatagcttcttttgagaattatctattcatgtccttaggccactttttgatgggcttgtttgtttgaaaaaaacaatcaattagttctatgaagtactgagtgtctctgtgccaggtactgcagtaggagatgggacatatcagtgaacaatagccaaaggtctacgctattcctgaaggtcaggtattgcgacagacagttgactacaagcatgtcaataaaaagagttaaactctgtaaaatatacgaagagatttattctgagccaaatataagtgaccaaggcctatgaggtctcatgtcctgagggggtctcaggacccctcaggaggtcctgagaacatgtgcccaaagtggtcaggatacagcttggtttgatacattttagggagacatgagacttcaaccaaatacatttaagaaatacattggtttggttcagaaaggtgggtcaacttgaaggggtagggggtggcttctaggttacaagtaggtttaaaattttcctggttgacaattggttgagttcatctaaagtcctgggatcaatagacaggaaatgtctgggttaaggtaaaggatcgtggagatcaaagttcttattttgcagagaaagccttcaggtagcaggctcctgagagaatagattgtaaatgcttcttatcagacttaaggtctgtgtagacattaatgctggagaggcataatgaggcatgtccgacccccatttcccatcgtggcctgaaccagtctttcaggttacattttaagagtgccctggcctaggaggaagtccgctgagatgactgggtggggggccttagaatttatttttggttgacaggcaaaataaataggttttgcctatgttcaaataatatgtacttttcaaaaagaaaaaaaaggagcagctttaaggggtgtaggagttggtgcggaggagtggggcagattgtagtattaagatgggggaatttggaataggcttcattgagaacataaacttagcagaaggcacatttaagcaaagtcctgaagaaggtgagggagcgggccaagtagatacctggggcagaggacactgcctcggtgttggctatgagttgagttgtgccatccctcaaaaaagatatgttgaagtcctaacctccagcacctgtgaatgcaaccttatttggaaacaaggactttgcagatgtagtcaagaggaggtcacgagcgtgggccctcatccaatggctggcgtccttctgagaagagggaaatctggacacagatacccagggagaaggccgtgtggagatgcaaagacacacagagggaagaggccatgggaagatggatacagagactggagtgatgctgcctcagccaaggaacgcctgggcttccagaagctgggagaagcagggcagggtcctcccacagaggcttcagagggcacgtggcctgccaacaccttgacttccaacttctggcttccagaactgtgagaaaatccatttctgtcatgttcaggcacctagtttggggactttgttatgacggtcttagagactaatccggtgttcaggacacagaaggagtccatgtggcctggaggagagtggcaggggtgaagtgaggagtggagcaggaagcctttgggaggaagttgagggcccacgagggatccagctggccaaggtaaggacttgaatctttttctagtgaaatgggtttgtgagcaagggagtggtaagatctgactggtgttccaaaacgtctctcactgccactgcactgaggataaattagacagttgcaaggaggccaggtaggaggcgtttgcagtaatcctagtcagaggtgaccatggccatggtaacagggacaagagatggttggattccccatggatttcaaaggtaggatttgctgatgggttgaatgtggagtgtgaggagagaaaaagggtcaagaatgactgacatgcgtggagggtaacataaccagagagcagctcagcttaggggacttggcacttggatcattcaagcagcatgaaacaaaccaacaacacattacagacactgaataagtaaaccaccattgtttacaccgcccaagtgaagcactaagcaaccctaggccctctgattgggcattaggatgctatttttaaaataatttcgatttattgagaaatcatttaaaaccctatcttttttgtacttatccttttctctggaaaacaaaaatgtaaacacatggtttcctagttttttataccttaataaggaaaaatcacctcagatatacaggatgacatctctggatttaatagagaatagtaaaatattttctgtcagtttcatgatgatgccatgagggcatacatgcagacactgatgattcaatgagcgatagggcccctaaatgcaggaaacacttatgagaacctgctccttgtgctgggaaaggcttggagggacaaaggtgaacagtgtatgctcccattcgaggagaagaaggcaaagatggaaacataaacacacaaaaacagggggtgtaaagtagaaatacaagttgtggcagctacaatgaaataaatcattaaatcttgaattatcaggggatattacaaattagagataatatttaaattaggtatgaaaatatgaaaaagattgatgagcaaagaatgtaggaagaatatgcaaggctgtgggaacaccttgggcacaagcagaggcatgagaataaactgagtgttttcttgagtgggatgaccaaggtccaaacataaaatagttgaaagcaggtgttgggaaagagacataagaagcagcagacacgttgcacatgccctgtctacctgcccatacccattctctgaagctctgctgggtcccattgcctctgccaaggacagaacaggcaacatgaagggtgggtaccttcctcagagccaactatttaattagctgaccatcagccaatcaggtgcttcacctcaggtctcacataaaagacacagagactagatacatcttaaagatgctggtggtgacctctgaattgaaatgcaatgtggagtaatcacgttcaagtcaaagtagggagagggattttgaaagaaagaaaagcagaagcaatcatgagaaaggccagggtaacccagatggagaaagagtaagagacagagggagccattctctatattttagcacctgggaggtccaggtgtactttctacaaccaggttttatgcaattgtcctatattttataatgaatcctcttttcacctgagatggtttgaatgggcttctgcttcttgccactctagacagggatcacagaggtggtgaagtgaagagaagggcattgaatgctgcactttggagtaaagattttatttctatattgttctcttcatatctcttcatgttagaaatcagggagccaccttttgcccaccctcttccccaagtcctccccatgtttgttccttgctgtgtctctcaataaatgctctggtttcagaaactgtgtctgtaagacttatctattggtccttggaaccaatcagacaagttttctttcaacatgaaagtagcatgattggccctgtttttggcttttctggtcagtgacaatttccatgtatccacattggccgtaatcctacacatcacttcccctctttgataatgtgtgccctcaccttaaatgtccccacatcatatcccttcccagctgtttctccttctctgtaaattaaagcctctaacttcacatggtttgtcctatcactgaaagtctccatcttagatttatacttgtgaacttcacatccacaagctaatggaataaaaattatttgtaagcaataatgtataagaaatggaagattaatgctgcatttttagctcaacccatttgctcatacttgtattctaattttagcttaaacttttctgtgattattttttgctacatatccattgaaacaaatcaatcaatacaaaagtggtttgtagaaaaatagacttttcttcccagctctgtttctaccataaccacaaaagaaaaccaagttaacagcctggaatgtattctttaaatttctctaggtttatacaaacatatataagataatacatatatatataatcccatatatacatatgtgggatttgtctctttaaaatgattggattatgacatacaaggtactctacaaaaaaatttttttcttgtaacagtatgtcttaaacatcttcccagttaatatgtatagattgaactctctttcttgacagttgcataatattccaatgtgtgagtaaatcataatttgttcaactgtcctccatcaataagcgttaatattttattttcaattttttgctatttcccatacatctagccttattggctggggcattttatttctgtagaatagattacataataatatgctctttaaacaaaaatatattgacattaaagatgaattacctttgcttctcatctagaaataactccattacatctctaagtcctattctatattgtagaaatgggtagctagaaaaaaaaccacttttgaaaagaggaaaatgactcatgtttttgtctttcccgctgagtgttcaccactgctctgggctgttgtgggcagaagtagcgtcacagttataggcattttaatagaagaagtaggtgtccttccttctgaaaatccactctgttgtggaataaagctggtctcctttaaagcaccacgaatttaaagaagagcaaaggaggcaccaagcagcaatttccctcacatcactcaacctattaagcctcttctcccaaacgtgggccaactgcaaaagagtgttctttagaaatgttcccatttctgccaaggctaaccagggatagtttcttgtaatggttagcataactcctggcatgttgctaaggtcaagtctcaacctttagccaagggaatgggccaatttagaagaaaacaaagttcaactccattgggtggagcccagcctggtgtcagaccctttgaggcccagtctgggatgaggttcccaactggttagacttatcttcacataccgaagcggtctggctaaaactaaatgggaactgcagaatttttgtaaaccacgttgcactttgtaaaaaaattttaactctcccctagccccaaacctagctaggtaacagccgaagttgatttcagaatgttaactgcagttctccatgcacacagttgcattctctgcagccatatggtcatcttttctaggtggatctataagaagatcaggaaattttattattgctaaatttttggtgaaacacatattaagatgatgagagatgaaaatgacaaagtggtggtaatgaaaacttcctcccttctcatctgccagtgattctctgtccaggaacaagggtaatatatttgacatttggttcattgaatgtgcttcagagtgaaattgtcagaattgcacatggattgctactgatattacatatgttgcaagactctgcagggtgtgtctcccagagacctttccctaatggtaggaactagactgtgagctttttctcaaatatactttggatgatcatctgtttccctgcaagtgcagaaggaagttcacaaagcaccatggaaaaaaacctaagaggagtccaaggctgaaatgaggtaacatgatactaaagatacaatcaagaagatactaaagatacaaccccttccctgactaacttacattccaggatctgctggagatactctctctaggcagcacttcctcttatccctagactagatgagggccctccaggatgtacccacagcacttgctacactgtatggaaactgtcttctcactggctgtttactccaggacaagaatggtgctctttcttgctccctgctgtatccatggcaccaggaaacagtgcctggcatggaggaggcacacagtgaggctaggtacaagagagaaaaaggaagggctgaagggggtgatgtcaatgggtacaagaaggtgcaaggaagttcccaaatctagaaatgcagagctgattgcccacttgttcataaatcttaggggttttttaattgtttgggggtggtttttgtttttgttttgttttgtttgtttgttttttggttttgttgttgttgttgtttttgttttgttttgttttgttttgttttgagacagggcctcattctgttgcccaggctggagagcagtgacatgatcacagctccctgcaggctttacctccaggctcaagtgatcctcccacctcagcctcccaagtggctagggcaacaggtgtgcaccaccacacctggctaaatttttttatttttttattttttgtagagagggggtctcgttatgttgcccaggcaggtctcaaactcctgggctcaagggatccacctgctttggcctcccaaagtatttggattacagacatgaaccacaatgcccagcctataaatcttagttttatatatgtatctatagataaagagaagcaataatgtaagatatgcttcttagaataaggtttcaggaaacatgtaaaagagagctctctgggctgagtgtggtggctcacacctgtaatcccaatagtttgggaggccaaggtgggtagatcacctaaggtcaggagttcaagaccagactgggcaacatggtgaaaccccatctctactaaaaatacaaaaattggccaggcgcagtggctcacgcctgtaatcccagcactttgggaggccaaggtaggcggatcacgaggtcaggagatcaagaccatcctggctaacatggtgaaaccccgtctctactaaaaatacaaaaaaattagtggggcgtggtggcaggcgcctgtagtcccagctactcgggaggctgaggcaggagaatagcgtgaacctaggaggcggagcttgcagtgagcaaagatcgtgccactgcactccagcctgggcgacagagagagattgcatctcaaaaaaaacaaaacaaaaaaattagccaggtatggtggcaccacacctataatcccagctgcttgggaggctgaggcaggagaatcacttgaacccgggaggcagaggtttcagtgagccgagattgcaccactgcactccagcctgggcgacagagcaagacaatgtctcaaaataaataaataaataataaagcatagctatgtactatatgaagacctaaaattcaaattacattttatttcttttaaaatatgctgaaatagttacaaacaaaaagttacaatgtctggaattcaaaattactgggggattaggtaggtaggggtacagctgaaacaaaatcattatttattaaaaattggtgaaactggctgacaaatacgtcaggttctttctactattctttttacttttatttatgtttgaaactttccatagtcttttaaaattacacaacaattagatgggttgcaagtataaagtgtcttgttacaaaccacactgatgccacctaaattttttttatatactttaagttctgggatacaagtgcagaacgtgcagatttgttccataggtatacacatgccatggtggtttgctgcacccatcaacccgtcatctacattaggcatttctcctaatgctatccgtcccctaggcccccaccccacaacaggccctggtgtgtgatgttcccctccgtgtccatgtgttctcattgttcaactcccacttatgagtgagaacatgcggcgtttggttttctgttcttgtgttagtttgctgagaatgatggtttccagcttcatccatgtccctgcaaaggacatgaactcatcctttttatggctgcatagtattctatggtgtatatgtgccacattttctttatccagtctatcactgatgggcatttgggttggttccaaatctttgctattgcaaatagagctgcaataaacatacgtgtgcatgtgtctttatagtagaatgatttgtaatcctttgggtatatacccagaaatgggattgctgggtcaaatggtatttctggttctagatccttgaggaatcgctacactgtcttccacaatggttgaactaatttacactcccaccaacaggatgccacctaaatttttaacttaaacacgctattgctgtagctccacccacccttgtctcagccctcagcgactcaccccttctgtgctgacttgcttttatattttatttattgttctctgcagccatttccattcatagggcttgagacacttttcagccgacagattgtaactcgctaaggagccctgactcctcctatcctgcttcccacttacaagcaaaaagcccttttgattaatttctgacagctcctgcttagattcactcagaactaattacgttggtacaacctactcagacaaaagcagctctaaaagttctgcaccagccctagatttcaagagtaggcaacatcctgtttaggaaaagaaagaggtagccccagacccaacgaattctgtcttcttcaatttagacaaaaacctgattcatctctgtgtcccctgacatccaacccggcacaaagccttccacagactgggagctcgagaagttcttgtggagggcatgtgtccggttccctcaacactccactttttcaaagatactccagagcagaagcgagttaacaggggcttgcttctcactgtaaccacacttgtcagctcacactcatctagagttttcagctgccaccaggcacagagtcctactgaagtccacacccccatgcatatgaagccacccactttcctgtatcccacacagccaaaatgtcactcagagacactcccaggttggtgccacattgtctccagctttcaactccacaaaagggcttctcccctttcacagatcattattttaacatcttactattttagaagccttctattttaaaaatagcaactatcgccagctccttctactgaagcaccgttgtctaaaatgtgttcaccctccagcgaggtgccggaaagggaggaggctcaaaagttccctatacctctgacaaggtcctcttctctgcactttgggtgcattttcatgtctagaaatacatctggaatcagtccagtgtattaaagagttagtccttatttgtaactttgctttttcttcctgatatcctataaaaacttgagccaacttgcttcagtccattgaattttataaatgaacagaaataaatattttgcttctgagttttaccgagaatgagaaaggattcaatttactcttaatatatccttaagaaaaaaattatttaacttagtaaaaaatgtgattttctgggaattcaggaggcttgcatttttctttttagcttatctgtatttccaattttttcgataaggagcatgtattattttgtcattttaaaatgtagttgtcattttttcttccttttaaactaaggtttctcaacctgagcactattgacattctggacttgatgatgctttgttggggctgggcggcagggggcgggtgttcggggggccctgctgacaccttgatttctatattaaaagactgaaatgggcaaaacatgcacctgtctggtgcactgcaagatgtttcgcagcatcactggcccctacccatggccagagcccagaggtgttcctacagaagtctgaaaaaacatccgaattggtggaaccggactcccatgcttaccaactggactccattgctcctcagatgaaagagaagcagagcagagagaaggggaggtagtttaatgtgaggggagcaatttaagcagcaatatcataaaaccgtcatcatcagaatgtgcagggaagagggtcctctgctcccgactcaaagggtactggaaactcctgttcctttccacatcaaccttccttgaattcatcagtctgttccccactctccaagtgcatgctgctgttgactcttccaatggcaaaagccatcccacaattgcactgtgcaggtgccctgaatatatgtagcagagttgcatgaggaggagaaactcagaggagaaagacagagagtttccacaggcaccttgggagattggaagggagtggtgaggaatgctcagagctttggaagggcggagcaggcagtagatgcccctgaggctgagacgggagcgaaatttggccatttagagaagaccaaacacttgctttacccacacagcaccctgggctggggcagcacctcagaaacatgtgcctggttacctggcaagtttgagtcagcacctgaatttaacacaggggccttgagccttggccaaatctccatgcccaggtagcccagagcagtaaaccttcttgccttttcgcaagcatatcaatggggaccagtgtggactaaagatcgccagatttgggggcaaccctaggaagaatgtcaggaaaaatgttaaaagactgaaatgggaaaaaaaaatggtactgggtatcttgtctatcacatctttcctgacctttgagctattttactattaatattttgtagttgtagaaaataggtactgttggccgggtgtggtggctcacacctataatcccagcactttgggaggtcaaggctggcagattgcctgagctcaggagtttgcgaccagcctgggcaacacggtgaaaccccatctctactaaaatacaaaaaattagctgtgcatgatggtgtgcgcctgtagtcccagctacttgggaggctgaggcaggagaatcgcttaaacccgggaggcggagattgcagtgagctgagattgtgccactgcactccagcctgggcaacagagcaagactctgtctcaaaaaaaagaaaaaaagaaaaagaaaaagaaaataggtagtgttgtgagttgaattgtgtccccaaaagatatgtccaagtcctaacacccagtacttcagaaagtgaccttatttgaaaatagggtcattgcaggtataattagttaagaggagggcatactggagtacagtggacccttaattcaacatgactggtgtccttataagaagagaagaaggccgggtgtggtggctcatgcctgtaatcacagcactttgggaggccaaggcgggcagatcacctgaggtcaggagttcaagattagcctggtcaacaaggtgaaaccccgtctctaccaaaaatacaaaaattagccaggcatggtggcaggtacctgtaatcccagctacttaggaagctgagagaggagaattgcttgaactcaggaggtggaggtttcagtgagccgagatcgtgccactgcactccagcctgggttacagagggagactccgtctcaaaaaaaaaaaaaaagaagaagaagagatacagagacatgacaggagagcaccatgtgacaatggaggcaggggcgaaagtgccacagctgcacaccaaggaacaccagggtttacaggcaaccaccagaagccagaagagacaaggaaggatcctccccagatcgcacagggagcatggccctggtaacaccttgatttcgaacttccagcatccagaaccaggagacaattcttttctgttgtttaagccccccagtttgtggtacttggttacagcagccctaggaaactgatacaggtagtaacgtggatgattcttgcccactgaaatgcaaacgaattttgtctggtggaacacagttgattattgacctgtggatattgaccagatttgcgcctatttgtaagttcatttcagcattcctgatggccgatatagtgtatggtttgaattctcctttgagccagtagtgacatcttcctgtttcctcattaacgagttaagtaaaatctttcacattgttcatttttgaatttatttgatagtcatgattttacatttatttttaaattgtccttaaacaaatcaaagggctcctcaaaacatcatcaagattaaacttccttctctttacgtccttatcacagaaacacagagttggatttcattctacttagaaaatcaaagcaatgtaaccatgattgcacccaacgtagagaaggaaaactcacttccaccacagggagaagtgagcccaatgggtagaattacccaaaagcctaacgtggaagcctctggtttgttttattttatttttctgtttgtttgtttgtttgtttgtttgtttgtttttgagatagtcttgctctgtcacccaggctggaatgcagtggtgcaatcatagctcactgcagcctcaatctactgggttcaagcaatcctcctgcctcaacctccagagtgtctgggactgcaggcacgcgccaccacgcctggctaatttttttttatttttagtagagacaaggtctcactatgctgtccaggctgatcttgaaatcttcagctcaagtgatcctcccacctcggcctcccagtgtgttggaattataggctgttttatttcgttttgattcaaaagaacaaaactacaaagaacagttttattcattgttattggccttaatttaaatatatttttttcattcaaaacttcattgagtctccacaaggccagcccggacagactttgagatccaagtcagttgctattcccaaggaactcagaaatgagtgctgaatgcaacatctgtcacagagtgagtattcggtgtttatcaaagattattttctcaaaaatgggatataccgccagctcacagaagactagttcgtcaggttttaactgtagtattatacaaaaatgtccccaagtagcaaaacattttatgaatctgtctgtaggtagaaattctatacattataaacacatcataatacaacttatgcaatagaacgccttactagaataaagaaaatgaactggaaatgttctgcaaaattagtcatttgttgttgttttcagcctttgttttttaaaaaacaaggcaggcagtaattatacatttgaaaaatgtataatttcaatgtatacatttgaaaaatatataattcctggaaatgaaggaattacagtagccttaggcaaagttacacttgccgcagttttttcttgactcccctttatcatccttcctctccttcctgggatactcataaggctcagcttgtctctcaaaggagcccagtgctgctaaagtctttctgttacccctccttaaacatcagctttcaaatagctgtcataaaataaacacgtaaattcatactaattgagatgactaaagacatgcaatgagttatcactttgggagcatatttacgttttaatgagaacaactcaatccattaagcacttaggaagtatctccatgtccaggccttgtgttcctgctgcggactttatgtcagagggaagagctaaggctcaaggctgctgttcagattattttgtcccacagagtattcccttggtgtagtactctcccccttttcctaaggatgtggcttcctgggagctgtagtgattgctagctctcttctggaactagccacccagcaggtctaccaggctccaggggctggcactgggagttgtgtgcacagagtactgtgatgtgaactgtctgcaggtctctcagccgtggatatcagcacagtatttggggtgtctcccaggtcctgcaggagtaatccacttccttcagagagtttgtgggtcctctcagccttcctggtttattcctgcagtagttctggagcaaaaaaccacgatgcgagtctccacacactgctctgtccatccatgtgggagctgcaatctagtcccgcttcccatccgccatgatccctcttctctcttgctgcagactctaaatagagtcctactcccagtatgggggaatgtaaagtgaggcatccacagagcttctcttctcagctgcaggctcttccagcctgatgcctgcttgagacttccgacctaaacaaagctctcaccctccccacacacaaacaaccagttcctcctcccatgttccccatttcagtaagtaaaatccactatccattcagcctcaaaccaaaagccaaagtgatggttacgattcttccctcgacttcccctccatgtctaatccatcagtaagactgtctgctctacctccaaaatatctcccaaacccagacgcctcgctccatctcctagtctaagccaccatcatctcacattaggaatggaaatatcctcccaactgggctctgatttccagcttgtccttttataatctattctctacacagcagccagagaagcctctcaaaaacataaattaaatcatggcactctcctctaatgactttgcattgcatggtggacgtaaaatctgaacttctcgtcttgaccccaaggcggctacatagtctggccccccgacctccctgctctcatttcttgtctttcctgcccttgctgactctgctccagccacgctattttcctttcagctctctgaatcaaccaaacttgtcctgactcaggacatttgcacttgctgtttcctttgcctgggcttgccaaaagttctggcttctttgtatcatttaaatgtcagccaaagatcacctcctcagagaggcttttcctccccatcatgccctgccacagctcccttttcattgacttcatcacacttggcaccctttagacctccttgcttgcttatccatctccccgcattccccaccctccaataaacatcctcgggaatggaggctccatgcaagcgaggatctggtctgtcttgttcattattacatctcagtttatattaagcacacagaacatgcttaattaatatttatcgaatgaatgaaaacccaagatagaaggtttgggggagaaatccttctcagcccctttcaaattatacctatcactgcagccagttccctcaatgggcaaggccagccagtcctatgtaaaagaaagatataaatgatagcttccaattacagatagctttagaaactacaaagaaagaaaataccctagacacagttccaagtaacagacaggaaagcctgcaggaagttcagtatgaaaggaacattggagtcaccattcaggatagaaaaagaaagggaaaaaaaccaccaggccctcactccatttgagagaaatatcaagaatatccaagtacttctttagatactccaaaagaaggagtttgaaaaagaatcgtcagaaaattttgagcttatattaacattacttattaaaagatctgaaaagagagttgtgcagatcatcagacccaaactcctgaatgcaaagaccagtcatgactcatttgactaaagagttatattaggctgctaagaccagggagcagacagcttaacaattgaaattcatcccaaggaagcaaggggaagtgtgctccttcaagggcaaaggagaattgaagaagatgcaaactaatcctttaaatgcatcaaagacatctaacagctgagatatgcatcgatgccatttgatcatcacaatgtaaaaaaattgcccagggtaacataaaggagagtggattctgaattttctgctttgatcttaagaagaaagtggaacagtcctatatccaaataggcggatgtaaacaactccaacaatgatcaccatgacaaaggacaaaggtcatttgtccagagaagactggagcagccacactaccattcccttctgcatggtgctgtacatgaaaacagttgagacccttgaatgcttatgaaagagcccactgggggcaggcgcggtggctcacgcctgtaatcccagcactctgggaggccgaggcaaggggatcgtgactagcctggccaacgtggggaaactccgtctctactaaaaatacattagaaagggatggtgccgcacacctgtagtccaagctactcaggaggctgacgcaggagaattgcttgaacccgggaggcagaggttgcagtgagccgagattacgccactgcactccagcctgggctacagagcaagactccatctcaaaaaaaaaagaaaagaaaaagaaagggcccattgggccaatcacactaaggcttctgtgattctctggaataaatagatttgttaacaaccccaagccagctatgaaggtcatttcaactttaaaggatatgaaacaagattctccaccaaaggctattaaaagttatagacacagaagtggttctgagtcaggatacagagtatggatatggctaagaacatctctgggctcagagttcgtaggcaccatggaacaagtagggactttgaggccagttctgggccaaattccagttctgccacttattaactgcgtggctttggcaagttccttaagatcattatacctccaattactcctctctaaaatggtgatagtcatactgacatcgtggggtagagtgaggattcaaggaagtcatgtatatatatatttttgtaagtgtgataaagtctagtacctggcaggggttcagtaaaaagtagtttgcttctcccttcatggggatcagagctggactcatctttaaagggcctgaaagaggccaatgacagaaggttttctggctccccgcatgccaagctcacatataaactgtaaaatgatttcagagggtcatggaagaggaagaaacgaatcagatcatgtctaaagaagacaggtgacttggggggctgaagcatgagaatcttttgaaccctagaggcagaggttgcagtgagctgagatcacgccactgcactccagcttgggcaacagagcaagactctgtctcaaaaaaattaaataaataaaacaaaataaataataataaagaaggtaggtggagagttcatgccaggaggactccccagggtgcctggctacctgctgagttcagccctgctctgggaggcaatgaacagcccatgtcagggttacagttctggcccaaagtaatcctaataacatctctcattatatagtgctttctctatgctgctcaggattcttagcacttaccatatattatctcatttaatcctcacaacaatcctaccagatgcaaactatttttatctctactttacagataaagaaactgagtcacagataggataagtgacttgtgcctgcatctactctgttcccagtctctgttgtgagtctcattctctcacctgtactcactgcttgctttctggaatccagttgaataattagtatttccggagagcccccatggctttaaaacacttgtccaagttagcaatatccttcaaaatttaaattgcacatacatttgacccagcaatttctttcctaggaatatatagaaataatcactcaagtatataaaaatattgtagcacaacactgtttgttgcagccttgtttccagtgctaaaaaattggagacaagagggagccattgtggctccggctggttgcgctggcactcagggtaggcgaggctacgagttcgaggccaacctggtccacattggttgaaaaaaaaaaattaaaaaaaaaaaattggagacaaactcaaatagctaccaccatgaaattggttaaataatttatggggcaccatgcaaattagggtcctatggaggcatggaaataatgtgtagctctctatgcactgacctggaaagacgtcacaatgtatgaaatgaaagaagaaaaagattgaatgaccttgtttttgtaagaaataaataataatcatattacatgttattagtctgagagaaaaaagtctgtgtataaccaagctagtcctagtcattattatttcttttctttttttgagatagagtcttactttgtcacccaggctggagtgcaatggtgtgatctcggctcactgcaacctccacctcccaggtttaggcaattctcgttcctcagccacatgagtagctgggactacaggcacaagctaccaccccagctaatttttgtatttttagtagagatgcggtttcaccatgttgtgcaggctggtctcgagctcctgggctcaagtgatccacctaccttggcctcccaatgtgctgggattatagttgtgagccactgtacccggccccctactcattatctttagaaatttttctttcatttcatattccttttatactttgtttttttacaagcacatattaatttaagaaaaattgagacaggctctcattctgttgtccaagctagagtgcagcgaggcgatcatgactcactgcagcctcaacctcccaggctcaagtgatccccccacctcggcctccaaagtagctaagactacaggcatgtgtcaccatgcctggctagttttttaaattttttttgtagagagaatctccctgtgttccccaggctagtctctaactcccgggctcaagtgatccttctgccttggcctcccaaagcgctggaattataggcgtgaaccacgacacctggcacacatattaattttaaatcagaaaaaaataaagatatgtatctttactctggtctatactttgtctcatttggtcctgtgattaccctgggaggtatgtaaaacaggagaagaaactgaggctcaaaggaggtcaaatgacttgcccaaggtcaccctgctgtcaaagaccacgtcggtaacagagtccaatccatctgacccgcagttagtgctgcagaacactaagtccctgaattaaacttttaacagtagcattagcccacccttattcaaagtcatgatgcatctttacctgacaaactgtatgagttctgtggttagacctcaagaaagatgcaaaaggcatggaaaagattcagggagaagaaaccgcaacagtctaaacaggtggtgcgatttctatacatgggacagagagagagggcttggattttaaagttgagagtatttaagactaaagtttactctttaatctcaaaaccatagaagaaacagatgcatggaacagagatctgttctttaagttccaggactctaaaatgagaagacattatttaaagtttgaaaatactagctttgggtacatataagatattatcagtagaaagtattagaccaaagctgacacaaggtgaaaatataaataattgacatttatatcacttcataaataataagtcgataactgtgtaatctgggagcccagggccaggcttgacctgacacaaaacacccctcagagtcactgcagggacagaatttcaggctgtgggccaccagcatgactcagtgccacatttatgattaactttatcttccttttccattccttgagagcagtaagatttctaatattttaaatcatgtgctttgggtttagctttcttttttcaaagtagatcattttcagctatttgaatttgcttttgtattgttgctgaagacaacaccttattgaacccattattattgtacattattgtacccagaccctctcctatttggtattcagcaaatcttgtgaccttcagttattcttctcttggatatttttgtttattatatgtattgtattttcaaaaattactctcaatattgaatgtattagagttaacaatatcattatcctaaagattcaggctactctccattttatacccagctcttgtttatttaaacataatctagtctttgtcaaatctatgtatccccaaatctatgtctgaaattttcatctactaaatcattatatcatttactaataagttatatactagaatataattatattagtgtaatataataggtgatattagtaaactaccttgagatacagagatataattggtgaggtcatgaagaaggcacaagcatgtcactaatctctctccccacgacccttcagaatgttctttctgtcttcctcagcatatacaaatgaagcaaaagactgtgcactttaagatttattttctttttcactctgattctttccaaattctccacatgcaattttgacaaatgcacaaactacttgtacagagcggttttgctgccctacacatgcccggtgctccacccattcatccctctccccccacccctagcaaccactgatcttttactgttctatagttgtgccttttcctgatgccatacagttggactcatacagtacatagcctcttcagattggcttctttcacttagcaatatccatttaaggcttttccatgtatttttatggtttgatagctcattctctttttttctgttctttttttattaacttttttccttttatttttagttgacacatgtatttgtatgtatttatgggatacaaagtgatactccaatacatgtatacaatgtgtaatgatcaaatccaggtaattcacatatacatcacctcaaatatgtatcatttatttgtgttgggaacattcaaaaccttctctgccagtgttttgaaaatatacaataaattactgttagctatattcatcctacagggctatagaatgctagaacttatttctcctatctagctgtaattttgtattcattaaccaacctctccctatcctcccctccccactacctgttccaacctctaataatcacaattctactctacttccatgagctcaacttttttagctcccatatataagtgagaacatgcattatttatatttctgtgcctgacttatttcacttaacataatgtcctccaggtttatccatgttgcctcaaatgacaggattttattcatgtttatggctaaatagtattccattgtgtatatataccacattctccctacttattcatctgctgatagacatttaggtcgattccgtatcttggctattacgaatagttgtactataaacatggggtgtagatatctctttggtgtactgatttcctttcctttggataaattcccagcaatgggattactgaatcatatggtagttctattttcaattttttgagaaatctccatactgttttccataatagctgtactaatttacattcccaccaacagtgtataaaagttcccttttctctgcatcctcaccagcatttgttatttttgtctttttcatagtagccattctaactggggtgaaatgacatctcattgtggttttggtttgcatttccctaatgattagtgatgttgagcaagtttttcacacactagttggccatttgtaagtcttttgcaaaatgtctgttcagatcctttgcccactttttaaagtgaattatttggtttttttttcctgttgagttgtttcatttccttatatattctggatattagtgccttgtgagcttaatagtttgcaaatattttctcccactctacaggtttgtttcttctttctatcaattgtttcctatgctgtaaggaagctttttagcttgacataatcccatttgtctatattcgtttttgttgcctgtgcttatgaagtgtcacccataaaatctttgcttagatcaatgtcctgaaacatttcccccatgttttcttctagtcattttatagttttaggtcttacatttacgtctttaatccattttgaattgatttttgtacatggtgacagataggggtctcgtttcattcttctgcatatagatatatagttttcccagcaccatttattgaagaggattttctttcccccagtgtatgctcttgactcctttgtcaaaaatctgtgatctgtaaatagatgcatttatttctagattctctattctgttctactgctctatctgcctgcttttatgccaataccatgctattttggttactatagctttgtagtatatttttgaagacaagcagtgtgatgcttccagctttctttttgctcagattgctttggctatttgggatcttttgtggttccatataaattttagaatttttttttccatttctatgaaaaaatgtcattggtattggtattttgatagggattacattaaatctgtatattgctttgagtagtagggccattttaacaatattatttattttaatccacaagcatgagatatcttttcatttttggtgccctctttgatttctttcatcagtgctttttagttttcatcatagagaagatcttttacctccttagtagctcatttctttttagcactgactaatattccattgtctgaatgtactcaatgggatagggaaagagatgaataggtgaagcacagaggatttttagggtatgaaactattctgtaggatacaagaattatgcttttgtaaaaacctgtagaattgttcaacacaaagagcaaaactttatgtaaactatggattttaattaataataatgtgttaatagttaatattggttcatcaattttaacaaatgtaccacactaatgtgagatgttaataacaggggaaactagtggatagtggggcttcatgggatctgtctgtactatctgctcaattttttcttgaatctaaatctgtcctaaaaaataaagtctattaatttaaaaaaaaaaaacaaaaaactttctaagtgtttttccagcatgaagatgctgctgccaatgctctaagcccctcctccaagagtgatggtgaagaattaatgtttcttcttctaactctcaatggcctgtcctgtgagcagggaaataggagtatctcttttcaggggtaataagcaactaccttacctctggagagactagtccttcccccatcccatgtggtcttggtaggatggccagtcacattgtctcttctcatccaaaggatgagcatgtaacccagagaggccaaccactcaccctcccagaaacaaggaaacacaggggcaaaaataataggaatgagtcactctaatgaaagagccacaaagagaatgttctgtcattcctgctgcctgcttctacccaagacctgatgattcaactctatctgcacaggttttcaacatgtttgcaaaaattccttttttcttgaattagccagagacatttgggtatctgacaaccagaactccactgagacatgcagggaaaaaaaaataccaaaagcccagtcttattgctatggtttgaatatcccttcaaaaactcatgttgaaatttaattgttaaatttaatttaaattgtcattgtagtagtattgggaggtggaaccatcaagaggtgattaggccatgagggatctgctctcaggagtggattgatgtcattatggtgagagtgggttcagtcatcatgagagtggctttgctataaaagcaagtttggccccctcttgagctctcttgcccttctgccttccactatggaatgtcacagcaataagagcctcagcagatgccaagcagattatggcaccatgtccttggacttcccagcctccagagctgtgagccaaatacatttcttttctttataaattatctaccttgtagtattctgttatagcaacacaactggactaagacagtcatttataataatttctacctaagtaaaatggttaaaattatctaaaagagaaaacaagggatgaggaaacagcatattgctaatgtttaaggaatgctttctacatgccagactctgagctgggcacaggagtgcagagattagtaaaatataggttgtatttcagagacacagaatgatcaaatgtatagaatgtgggcttgggacagacctgggttcaacctctctagtctgctcttacttcctgtgggcccttgttcaaatcacttaaccctcatgcagcttagtttcatcatctcaaaggaatttaaaaagtctatagccataccaccctgaatgcacctgatctcatcagagaaataaaaagagcctagctttcatgaatattgctgaaattaaaaataattatgtacagcaccactatggcgccttgtacaatgaagacataaaataaactgacttaagaaatggaaagttaccatgacctttgaagccttgggttgcccattcctaattgcctctcccccaaatttctctcccacaaagaggtaatctttttcgtgtcttattatgttctttttcttgtatcctaaagaaaatattgcttgggccaggcatggtggctcatgcctgtaatcccagcactctgggaggccaaggcaggtggatagcttgagcccaggagttctagatcagcctggtgatcatagtgaaaccccattttgtatgaaaccccattttgtatgaaaaatacaaaaaattagctgggtgtggtggtgggcgcctgtggtcctagctactcaggaagctgaggtgggaggatggtttgagcccaggaggcagaggttgcagtgagctgagatcatgtcactacactccaaccagggcaacagaacgagaccctgtctcagtttaaaaaaaaaaaaaaaaaaaggaagaaaatattgcttgggtttgcctgctttcaatctttagataaaaggactcatgcttgctttttctgcctcatgctgtgactttcctttgttcactcaaagcacttttgagattcatccatattgactgtgcagctgtagttcattcatttcgtttcactggtgaatggcattgtatggcataaatataccacaacttaattattaattcattctcatgttgatggtcatatcaattgtttccaaatctttgctgtgaacattattctgcaggtctcctggtgtttcgatgcaagagtttctcaggatctctgaccggaattactgtatgtgcatacattcaactttgcctaagtaatgacaacttgttttctgatgtggttgttctaatttgtactccaaatcccatatatgagagtctgcattgtgcccaacactaaatatcagactacattttttgccaattcgatgggtataaatagtatctcactgtgattttaacttccatctccctgattactaataaggttgaaaatcatcttatatgtctattggccattcatgcttttggagaattcctatttgtgtcccgtaactaattttctattgggtcatttgtctttttcggctctattctaaggcatactctgtgtattctggaaactaaccttttgtcagctatacatgtgcaagtaccttttcccaatttggggcccgtcttttcaatctctttatggaatcttttgatgaacataagttcttaaagtcagtggagtaaaatatattcatcttttcctttatgacataattttttaaagaaaatatttttcaattcacttctgatgcatctctcttaattgttaagcaatttttttcctgaagcctgcatatcatcaaggctaagccatgaggcttagtgtcccagggaagaaagggcaagtcccgtctagggtagggaaagaaagcagaaggaaatgacgtaagggtgagttcccaccagggagaatgaggaatctgaagcccttccaggagaagtggtggtaatagagagagatttgcagagaaggaggcaaagagaagacgctacctgagtctctcagagactaagcactgcctccaccttgggccttacactggccagaagaacataatccaaaataagagagaagctgaaagtgaatggggcttgtgccacttctctgaaactgtggaacaagaccatctcacagggtattcctttgtcaagatgtgacacaaagtgttccacgtctctcccagttcctttgtagaatgaaggggattcagatggtccagtgggctctcccactgagtgacacagaagctagttgaccactgagggccaagagaactgccatatggctggcaaggctagtgtgaaagtgatccgtagcagagaccacagaatggacattccaggccagaattggatggagaatatggaagaggattagagcatctgcacagccagcaagggtcaatgtggagctcaatcagcgaaaagaagcctaccagctcctgatcaggccaaaggataggccatgagttatgtcagctgcagccttcaacagcagatgccagcaggatgcctggaaatgagatgattaattcacaattctgaggaggtcagcatgaacacagacaacagcacaaggaccatcacctgaaccagccatcctcccctactgccatgaggatgggtaaaccttccctatgcctctagagaaaggataagagaaaggctttcaaagaagagaaacagctcctccccacacacacagccctcatgaaaatggggccttgagactaagatgagagtagttagagaaaataaaagcaaactacctttttctttttgcatatttgagagattctatgtacctctctactccgcttcaatagttattattatggtcctcattgtatatgggaagtctgaacatgcaaaaaaagattatagtacaatctaaatacagtaactgagctatacacaatatacatagagcccatagaaaaggcagaaattagctacatatattagttttatattgctgtataacaatattaccacaaacttagcaggttaaaccaatacagttttacttatccacagttttactttccatggtttcagttactcatagtcaactgtggttcaaaaatattaaatggaatatttcagaaataattcataagttttaaattatgcatcatgctgaatagcataatgaaatcttgcaccatgccgctgcctcctgcccaggacatgcatcattcctttttccagtgtatccacaccatatatacttcccatctgctaggcacttagtagctgtctcggttatcaggtcaaaaaagcatagtatatgcggggtacagtactatccacagttgcaggtacccacggggagtaggtatccacggggggtaggtatccatgtagctgggtcctctgtaaggcttcaatcaaggtattggccagggctgggtccttatctgaaggcttaactgtggaagaatctgcttctaagcttacaaggttgttggatgcatttaattccttgttggtggtggactgagagcctcagtttcttcttgctggtgtcaagttccctgccacgtgggcctccccaacatgactgcttgctcatcaaagccagcaagggagttcctcagcaagatagatattagagtcttatgtaatgtaaccatggaagtgatatctcctttgccatgttttattaatgtgaagcaagtcacacatgctgcttacacttaaggggaggagatgaagggtgaatgccaggagacagggtcatgggagtgccttagagactgtccactatactaggcaaggtgggtggctggggaagacatgccagatgtgacttctcagaggagacacaatctgagctggcttttgaagaaggttaagagccccagaattgcttggcagccccagaacctagtcaatgtttagcgttataggaggaaagaacaaatgtttgtgaatgacagtattgacatcgggagaaaagtctggtcacccttataggaaagaagattgtattttacatgaggcaaaaacaagaaaaataattgtcaaatctcatctcaatagcaataagtaacattaaagcccttctagcaatattaaaatgggagaggtcactgcattaatgtctcagcaagcctcaccaggaaagcgtaatgaacatcaagggcactgaaacgacaggagatgatctaatgcaggaagctccccaaatactatatttatacaaatgataaataggtttcaagaaaggagaaaccaactaatgttgatgactagggaaataaataatattagaactttacactgcagtagcatctttcatctgggatcctaaaaagctttaagagtaattaaatttgggtgctgcatcaaagtagacccatttttaaaacaaaaatatggattttatgcccttcagcagatgtagcactgaatagtctcacagataatgaaacaaaacctggagattattttctcttgaagaatgttttatcattgtttccaaggttctaaatttgtaactagctgagtcttacggaaatgcagggtggagccacatttctttctatatattggaaaagaggcagcagtttcagcccaggtggagtgtgtggggattgggggttagaagcagtccccatggaaaacccacctagggaacaggaagcaaacattgggtcgcccttgacatatgaaaaaatgacatgacatttggaaagcatccatctgtgtcaaactctgttctggttttcaagtatcattgttggagtgcctctgagtctcaaaagccttctgtgtttcacattgtttccgtgtcagagacaagtccatgtttagttacttgggagcaagcctccattcctggttggtggtctcagtatgctaccagatcttgccatcttaccatttgaagctcctgtgaccatgttgaacccactcgcaacctgggtgtgtctgtgggaagcctgcatctcacagggacattaacacccctgctgggagacttagcgattcagacaggaagtttcatcctcaaaatcaagtctcatatgcacccttccatgttccactgtgccttcaagatgtgtgaatcagcttgctgcttcggcagcagaacgtggagacagctttccacccccggttttccacggggcaatacacggaccatcgtgtgagctggcggtgcagaagcataaagctccttggccatcattccgttcacaatcattccgttcacaacagggccatgctgcatctggggaaaggccggtgatcatgtgagcatgagtggtcatggtctataaggaggatacaaaagaatctcggaaatagacaccatttattcaccagttcctactagaagaaataagttttgagcccttcaactaaaataatgtgaagaaatattcctgaagttagataggcagaggattaggaatgtgggaagatgcttgactgaaggttcaaccgatctcctgtgtttaatttattaatatggagttctagctgggcatctgatactcaaagacaagggaacaaagcttcacagcctgttacagctttggacttggcccaggctcatgcccatctccaaagcggtcaagtcctatttgtcctataagaagcacctgctggccaggagcagtggctcacacttgtaatcccagcactttgaggggccaaggcagacagatcacgaggtcaggagttcgagaccagcctggccaacacagtgaaaccctgtctctactaaaaatatgaaaattagctgggcgtggtggcgggagcctgtaatcccagctacttgggaggctgaggcaggagaatcgcttgaacccgagaggcagaggttgcagtaagctgagatcgtaccgctgcactccagcctgggtgacagagcgagactccacctcaaaaaaaaaagatgcacccgccgttgacaacctccccaggcttctcatctatgagtcatccaccctccccaaactcctcaccatttatacatgcctccctcgagaccctcatccctgtgtccattcaattttagcagtttatgtacacgtcatatcctcttttcaatcagaagtaactcgagggccctcgcattttggctcgtatatactaagtactcagtaaacaccttggaaaatgagtgaatggctgtttaatacctattaaaatacagagaccaaacgtacactcgcccctccggatctcacttggggagcagtgcctttgtgctcaggagggctgccatgttcctaaatacttcggaatacacagaattctggtatgctttctagagaccagatatacccaagcttcagcccaatttcagtttttaaaaacaggatcaagagggccagatgtggtggcgcatgcctgtgatcccagcattttgagaggccttggagggcagatcacctgaggtcaggagttcgaaaccagcctgtccaaaatggtgaaaccccatctctactaaaaatacaaaaattagctgggtgtggtggtgcacacctgtaatcacagctactcaagaggctgaggcacaagagtggcttcaacctgggaggcagaggttgcattgagctgagattttaccactgaactccagcctgggtgacagagtgagactctgtttcaaaaaaaaaaaaaaaaacaaaacaaaacaaaaaacaggatcaagatttacgccttcctgaagaagttgagtctggggtcacagtcattagtatcatgcttcataatgaccttaagcctctttcaagtgtgtgatattctattaggttgatgcaaaagtaattgcggtttttgccattcttttttttttaaaaaaaaggcaaaaaccgcaattacttttgcatcaacctaatatatgcacagtttcataagctctctgagggcaggacttctgtctattctgttgatgttattgttacccacacacactaccttgtaaggaagtctgcccacactgggcaaacattaactattgactaagcgtatcattttattttaacacaattaggaagccctgcattccaaggaacccctttagccaaaagctgctgagttaggtcaccagactcagcacacaccttttctaatctgcttcttcagtccctatgagccatacaatgcattctctcctgcctagagttggcaatttcaattatttcttttccagaaagaaataaaagtgtctggactgaaatagatttccctgtttggaaactaatgcagtgaggggtctatttgttacaaacactgataggcagccttctccacagaggtgagccgtcctttcccatgggctcctctttgctccttcctctacaggaatccatctactctggttcatgtacagaaggttactgtggtttttccaggaaactgctgcctgatgagggaggcaaattttctgtgtacaaatttgaggaccatttgtgcagaaacagacataagtaacagaatataagccatattaatgtttttatgactatacttgggccttctcaacaatggttaagtgttgccaaactagctttacttagtgttggcaggacaggagctgtaatatatagttctttttgtcttggcaataagtctggcactcctgccagaatctactctaaaggaaatgaaccagagacaataagtccattcaaatgcactagcgatttcttccagcagggatttttcaatttctaagttgatacaaattttaaaaccacctattttaagtagggagtgggagttttattttccaaaagaagatgttatatttaccaatgtatttctgacatctgtccgcaacaagaaatattatagtgccaggtaattgagaaggtgtcagaacaaaacaaacataaaacaaacaaaaacagagagagatgtattcctttcaaaaggatgtaaacacaaaatataattgatgggcttcattcagtcagccgtttaatttgcggtgtttaagtacttacataaaatgacattactgctgtgctattgtctcgctggttccatgcattttatttatgaccatgtgtctttgtgagtgaataaaaaaatgtggagttgctagcagcaaaccttacacatttcaaaacccaaaaccaagaaatccttgaaggaccacctataaaaaaaaactttgttaacacaaggttcaatatttgcctgggttggcacaatcctacttggaggggaaaaaggaggcggatttttctggctttaggaggcgggatttcaggtaaaccactgtgaaggtgcctgtctacgcctctgaattctagagcctagagccccctgctggctgaaggaggaagagacctgaatggacccgatggccatcatttcaaactcctcattttccccccaggtcattcattcatgcagcaaatattcgttgaggcttgctctgtgccaggcactgttctaggctctggggataatctgttcaacaaaacatacaggtctttgccttactggagtttacactgcaaaaaaagaattcaaatggccggacgcggtggctcacacctgtaatcccaacactttgggaggccgaggcggacggatcacctggggtcaggagctcgagaccagactggctagcattgcaaaaccccatctctactaaaaatacaaaaaattagccgggcgtgatggtgcacacctttagtcccagctacacgggaggctgaggcaggagagtcacttgaaccccaggaggcagaggttgcagtaagccaagatcacgccattgcaccctgggcgacacagcaagacttcatctcaaaaaaaaaaaggaaaagaaaaccaaataaccataaactataatgtcacatagaaattgatactaacagataaactatgaatcacagcacagcagggagaggaagtaaagagtgatgggaggatgatgtatttttagacagaagaactgaataaataaaatgaagaagagggagaaattggtaggaggggcttccaggaaaggggcggagcgagtgtgagagctgggcgggggtcagggagtgcacggagcagttagcagtgcagaaggccccggtagctgagcgatgaaccgaaacttaaaaatgagctgagcccaatgatgcggagccttacatggtaagaattttggattttacagtaatccacggagaggcttgaacagagaattaactaaatttgctttccattctaaatagaccattctgtgtgcaacaagaactaactgcgagtgtgaaatctgagaggcccattttggaggctactgccatcatatttcaaacaattcaatcaatgaatttcaccaaactgaaattcctgctgtttacaacaaggttcagagaagaataaaatatcttggtctctgccctcagagagctttcaatcaacttgggaaaataagataggcacacttcaaattaaacttacgagagacagtgaaggattgttctggcttgtacacaagagcaataataatgaagatgaaaaaggtggtgtcaccagcagccaagcaccagcttgaggcagtttagcttcatggttaagagcacaagcgctagagccaggctgctggggttcagaattctggtgtcatttactagctgtgtgacctctggcatgtgccttggttttctctgtgcctcagttttatgacctgtagaatggatctaataataggaccttccttatagggttggtatgaggaataaatgtgtgtcaatgttgtgtagaaggtgtttacatcagtgttaggtaatttaccaaaactactcaaaaggaagaaatgtctccgaaatcattattactgcagtaggtcagatgtggtgtgatagtgacttacatatcagttgtggaaacaaaataaaaggggcagtatttctggaaggttaacttagaaggtttgatgacaacaagatggtaaatgaagcatacaaaggggttcaagatgaacatgagatctcaagcgtaatgattaggaaaacagtagaaaggagagaaaaagagaattcaggatgggaaattggtttgagaggcagggcaggttggatttcaggcatactgagtttgaagtggacaagtgattagaaatgtcagactagggctcagaagagagatcaagggtatccttatggattggaacctcttcctttgggggctatctttgaagccatggagatgacagataactaagacagaagtggctgaaaaaaaagagctctaagaatgaaatttaggagacatgaccatagttatggattagaaaagaggctgaagaggccgggcatggtggctcatgcctgtaatcccagcactttgggaggcctaggcaggcgggtcacctaaggtgaagagttcaagatcagtgtggccaacatggtgaaactccatctctactaaaaaaaaaaaaaaaaaaaaaaaaaaaaatacaaaaattagccgggtacagtggcaggtgcctgtaatcccagctactagggaggcagaggcaggagaattgcttgaacctgggaagcggacattgcggtgagccgagatcacgccactgcactccagcctgggcaacagagtgagattctatctcaaaaaaaaaaaaaaagaaaaaggaaaagaggccaaagagaggaaagcatcagaaaatcaggaagagacatgttattttagcaaaaatattgagaaagatggaaaagccactgtcaaacactactaagagataaaggataactaagtatgcctttggaggagatcattaagaagtcattgatgggccaggcaggtggctcatgcctgtaatccatcccagcactttgcgaggccgaggcgggtggatcacctgaggtcaagagttcgagaccagcctggccaatatggtgaaatgctgtctctactaaaactataaaaattagcagagtgtgatggtgcccgcctataatgccaactacttgggaggctgaggcaggagaatctcttgaacccgggaggcggaggttgcagtgagctgaggtcaagttactgcactccagcctgggtgacagagccagactctgtctcaaggaaaaaaaaaaaaaagtcattgatggcatcaagaaagagtttctcaagtgcagcttatcctaagggtctctgctaaatgtttgtcatgaatgctgtgctgtgccacccagatttctccatcaggacccaaggtgctgtctccccggggagggttgtaagctgacagctcccagcggctcggctgaggaaagccatcttgcccaaggtcgtgcccgcatcctggggcagcctgcagcaatggctggttgacttcggggtataaaagcccagtttcttcccaaaaagggacaactcaaaagggccattccaggtttcgagccatggagtcagctagggctgagtcacaacacactgtgactgcactgccgccagcctccccttccccacacagcgttgacgccagtgagaagaaaagacccccaggacactttaagcagcaatgccaatctctgagtcgggatctgcttccccaggaacccagaggccacaatgtattagaaaattcaataaaaataaaaatgataacatcagggaagagttttggcacaaagagatcaatatagcatttaacaggccaggtgcagtggttcatgcttgtcatcctagcaatttgggaggctgaggcacgtggatcacttgagttcagaagttcaagaccagcctggccaacatggtgaaacccccatctctactaaattacaaaaattagccaggagtggtggtgcatgcctgtaatcctagctacttgggagactgaggcacaaggatcacttgaacccaggaggcaaaggttacggtgagctgagatcgcccactgcactccagcctgggcaacagagcaacactgtggaaaaaaaaaagaaagaaagaaagagagaaagagagagagggagagagggagggagggagggaggaagggaggaaggagggaagggagaaagaaaacacaaagaaatagtatttaacagataaataaaaatagttccttagaaatagaaattctgaaattgaaagggtcaaattgagggaagtgaataggaatgggcttttctccaggaccccaaacctatcagacttgcaaaaaatgagatggtgccatttacctttggtgaaaatagagtgctgggtttcctaacccgattgatggtgctgtcaccgtataacctcacaatctcttttaatctctgcactcttgtcactttgctgccatctggagagaggattaatttgatttgtcccccaaggagattaatgtatctgattggattccagcacacggagggataccattctctaacccatcagcactgtccatggccagggtgcaaaagcccatcccacttctcccaagaaagaagcagctctgaggatcccgagacactgtggagatgatgcttgcaaagttcactttcacattgcgctgtctttctagccttcccagtgttgaaatatctctccatacgcccagtggaccttcccatagcctatgggggtggggcaggggaaattcactgcttaagaaaaagaatgttctttcatgcaaccaaatgtactatccaacccctcagatgcttggaaaggcagggatcatgcctgtttgtttacctctgtaccccaagaaaccagcaaagtgcctgaacacacagaaagtgcttgattgttgaataaatgatctaaaaactggtgctaggtggatcacgaatgaagtaaaagaaacaatcagtaaatataaatgataaagatggctagagacagtttggctctgtgtaaattatgactaagttggagtcctcttccggtcacctcagtgaatgtctcagtgatccagttgcccatggtagatacttaagaaaagctctttggactgaattaaactacaataaaacctcattggtggaagcccaaataaaaaagcatattcattggtgcaaatacttcagaagaagggacattattcattattcagcacaaggatatgagagtgacgaggaagagaaagacagggacaatttttaacaatgagaagaaaggaatccaaaggtggggagtctaaggaaaatgatcgattatccacattaatggaactattcggtttaaagcttcaagaattggcctgagggaccaccatgaaatttgctatctcaattaatccttgcaaagtgaaaataatacatgttagctgttctcaccattctaaggactttacatgtatcctcatttgatcctctcaagaactctgtgtgttaagtttgccagtactgccatccccattttacagatgaggaaactgaggtctagagaacttaagtgacttgcccaaggtggcacagctggtaagtgcagccatgggtcttcgaacctggacagtctgactccaaggccatgctcttaacctgttcactgtatcacctcctgcaaggacaaacattccaccttcttttcccctcttcaacccacaggtaagttctgtatttcctggtttttaaactctagaaagaatgctcttgaagaacaaccatatgacactttttaaagtgcaattgatatttaagactctatctctacattgagattcctaagaaatagcatttttaataatatagatgtttaaaacaaaacaatacagaaagtgggctgcatctgagggtaatttttttttttgtctattttgttcacagctaaatccgtgggcctagaatagtgcctagcacatggcaagctttcaaaaatatttgtcaaacttgtggttgaaccaaaacaagatatacagaatcccctatatgggtactcccacataaactttatggcacaattgagactccacctccagggcatggtttcttgggagaacccaagtggctaagtcttgccttgtatttgccttgtattttatattagaatcatcctgtgaggtaattaacgcagttttatgatgcttaatcaaagacacacaacttggccgggtacggtggctcacacctgtaatcccagcactttgggaggccgaggtgggtggatcacttgaggtcaggagttcaaaaccaacttggccaacatggtgaaaccctgtctctagtaaaaatgcaaaaaaaaaaaaaaaaaaaaaaaaaattagccaggcatggtagcacactcctgtaatcccacctactcaggaggctgaggcaggagaatcacttgaacccatgagacagaggttgcaggtgagctgagatcgtgctactgcactccagcctgggcaacagagggagactctgtctcaaaaaagaaagaaagaaaagaaagagagagagatggggggtgggaaattaaggaaagaaggaaggaagggagggagggagggaaggacacatacacagcttgctaaaacatgtcttctagcaaagatgcaagtatagtaaaagttttcttagcacaatgtgtccaagtctgatgtgtccaaatttgagttgcttcattaattacttgacaacttgacaacttttttttgttttttggggttgttttggtttgtttgtgtgtttgttttttgagacagtcttcctctgttgcccaggctgcagtgcagtggcacaatctctgctcactgcaccctccacctcgcagtctcaagtgatcctccaacctcagcatcctgagtagctgagactacaggtgcgcaaaaccacgcccagctaatttttgtatttttcgcagagagagggtttcaccatgtctctacaaaaaattggttaggctggtctcgaactcctgggctcaagcactcctcccacctcggcctcccaaagtgctgggattacaggtgtgagccaccgcaccaagcctttatttgtattttgaggcaagattgcttcatggttaagaggcatgggctgaatgaccaggcctgtgtatgtttgttaacctctctgagccttagttttctcatatgtagaatttaggtaatttattaacatctatatcagttaggttctaaccaggaaaaaagaaaccactctaggcatttcaaagagggcatttaatatgtggaactggttccctaggtgagggaagagtggggaagctaaatgggatggtgagatgacctggatacgagctgcagcaggaagccaccaccatccgtagggctgcagggacaaccagacagagcaggtggtgacagcagagcccaaaagccagggctactgggcactgggtccataggggagacacagctgctcctggagtcagcactggcatcagcacaggaaagggataaatgccctcacatcttccctcttcctgccctccagcctctgccagcgcctcttattggctgaacctaatgagaagccagggagcctgggaaatgtgatggctgtggtacagagcagagcaggaaaagggcagagatggacctgagagcaaatgagcaattcaccagctcaagacctcactgggctgtcatgagatttaaatgggttacacatgtgctgagcactccccgccggcacgtcatggtgcttaatgaaagttattattgttattatatgtaacaggccctgggctggacatgggtaacagaaaagacgtagactctactaccaagtagcaaccagtcaaatcactgtagcccatttgttttttagcaatgacccattccgtgggcctctagtgtgaaccttctagcagtctttatccccccatattgatacaggtgaccaacttcggagtatgcatatcaaccatcagcatcaatggtgaccaagaaaaacaggctaacattgacctataagtgtttactcttccagaataaaaggggtccttaaaaatgcaaaatattttatgtaagatacaaaatgatctgtcaataaaacaggcactgactccatcatcttacctgataaaggattgatttagtgagtgtgtcatttatgcagctgattgcgtgtctagctttaaggtatttgatgatttcctaaaaagacaatggctttacaactagaagcccattttaagaaagattttctcaaatcagagaggttcctcacacggatgacatgaaaccttggatgaagcgttcatgagtctggtcacgagcagagtcaacgggtgctgccaattagaggccaggaaatcttgtctctccatctcttcatttttatccctggccttggagtcgccaaatattagttctggaatccaaaaaacacattcgcgtgcctaacatgtagaaattactccaaaccaccaatgccaattactgctaatattcatagctaatagaaagataaagtggaaattgagatagtgacttcaccctggcagttgggcccagctacaccaggaaagcactggctattccttggcttctcatcctgtctctatctactcaaggagatacagaaaattggctgtgaggaaaaattatactctttactgttggagtaataatgctatcttaaatatcaagcatcctggagcattttaattaggtgggaagataccagaaggcatcatctgtatcttctgtaggacgactaaatgaaatagctgggagctttaagttcatctttaaagaacatgaatgaaaataatattttatatggagaaataaaggggaaagatggagtgagatcccaaaaattacacataaaattgagctggattaatggtctctttcctatacaaagtgaattggtttgacagctcaatgagtcagaagtcaccataggtttaagacaatggaatgactttgccattctcaatgctgatcaaaaacctttcaaaaagcatatttcctggacacaacaaatttcattctaattttgtttcctggttctgtctttctgatcctcggtataaatgatgtcaccattcccattagttaggcatgaggtactgccaacccataattacaaatgcctccccccggcattctgttacattgagctgtcagtgagtttcatctccaaattgtaatggcactatttgctttatttggtcttaggtgatgtaggatggatgcccttctaaacagcatgtgcatttaagatggcagagcaagaatgatttatatggggaataactccttagtctgtcaaagacctggcagaatctttctgggaaactaattgcagccagttccttccccagctcggaggtgaactattggcatctctgccagccatcataagatacaatctaccagccataagaagagaggaaaccagatctctcattctcaacactggtacatgcctgataatgctgtttctcaaaagccaattattgagatttaaatgtcccctatacaaacattcaccattttcttttgatcctacaaaaatcacatcacctttctgaactacttatggtgcatacaaaaatcatttttactctacagtcatgctgtgagctgctgtgaatgtcaggtctgtgatgcccctgtattctcataaagggcatagagcgggctgagaattcaatgggaaagggtaaggaaattatctgtcctcaacatcagagacgctttgccctgagttcagagttgtcctgtccactgaatgttctccctactctccttatcatggttccttctcctttgcttcttctcctggaccactgtttgaatgagatacacactgaactccttgtttgtcctctaacgccacaaaaccaaggctaaagaaaggggcacagtgcagaacatgtctccctggaagacccagagatgtcccaacatccctgggagaggcccaaatccaatcttgtctcattatccagaccagtagttatcagtgggggtgactgtccttcaggaaacatttgcaatgtctgaagacatttttagctgctacaactgggggtaaagggcattactggcatctagcggatggaaaccagggattctgctaaacatcctactatgcacagaacaggccccatagcaaagaactgtctgaccccaaatgtgaatagtgctggggcgcctatagtcccagctacttgggaggctgaagtaagaggatcactttagcccagagagtttggggctgccctgggtaacaaagcaagactccatctctttttaaaaagtcagtaatgccaaagttgagaaaccctgatctagattttaatcaaggagagggtttaggcaagtagctctctcttccagttggcaccaatcccgcatggaagccacaccccaggcagaagctctgtttaggccccacatttgcctgattcagcacatcacactttaatcatgtaattcaatttttcctaatttttttaatgttatttaggccctttaatataatttggcaagctattatagttgttacagctgctagttctgccctcaatactgatttcacttatgacctcagctggaataagatttaaagtttgagatgatgtaagtgaataaggattattagatttattcgtatggcaatttaaataagaaactgcctggcttagaataagtggtaaatgaaaaatgctagtgatttatagacctgtccattttaaagatttatatgatgtgtgggatgattaagtaagagacaggcctgattatatgaaatatgtaatttttgtaaatgcgatattggaagcaagctgctaaacagtgctgcatagcaactctcggctaagccatttttattacacaattattataaactggtatgcagagtcatgtgtgaattacacacagagtccttgctctaattctttttagctggatgggagcatgttcataggaaatgcatctaaaacttcagccttgaaacatcagtcccattggtaccccaaaaggcagggcagactggggatttcagacctgcatcagtgactgtcaggctttgagcaatgctctccttcataaagggcatggccaccatgcccaggtctcagcacttcaacttatgaaatggagatgctccatctgtcatattttagtgatacactttagggaaaaacgacagcagtcagaaaaagaaacgtaagacatcgtgacatagtttccttccctcagttcaaatactcccctcatcaaggtagcacatagtacctgaaaactcagagagcccagggtgattcacccaactcaggtcaggttgctgccccctttccagagcctcagaatcctgtggagagagttgagaccaggcgcctccctgaggttttggatatagtcccaaagtcagccctaggattgccatagaggaatgagcgatggttcagttcttatctatctctcaggagtggagaatatgtaagcaatgttaatatttaagttattttgacaactgcttggtacaaacaaaaaacagaacaaagcacctgtcttaggagagtagagagacctggtagtagtcagatttcttccagaaactgagtgtaggacttggtaaggtaaattgcctgcctctttaaactcagagttgttagaactcctttagccacatctcagggctggtaggaggggttaaggggataaatgaaaggagagccctttcgaaagcatagggcaaagcttcagaagacaaaatggaggtcaaagcagaagcaggaaacaccgtcattcaacagacatttatggcggccctggaaccctgctagggcctagggttgccaagaggggcaagccaccaagctctgggacgcccagggctgagtgtgaggatgatctaaactctaaatctgcagtgtttacacaacagattaagtgctgagggtgagcttaattcagctggggggtgggggctgtggtaacaaagtagaaaacttcacagaagaaataacatttaaaccagctcttacagaatgtggaagaattagagaaacagaaagaagcttctagtccacccagatgtagaaccaaactgcccctgagcccaccgtgagaaggagaggaaaattaccagcatgcattcggtttgatatcaggaaccggaaacacacattcaagcttgtggaggagagtgacagaatgttctgcgggtctcgaaacttccaaggccggtagggatcagaaactcttaaattcttgaaatttagtatccatcataaaatatgtggaattgttaatgaattataacaattatacttctttctctgatagaatgtgtaatttactaatcaaatataatattaacttttagcatgcccatgagttttaataaataatccccaatatagtgattttatttttatttacttatctattttataaaaacagggtctccttctgtcacccaggctggagtgctgtggtgcaatcatagccttgaactgctgggctcaagtgaccttcccacctctgcctcccaagtagctagtataggcatgtgccaccacacttggctaatgtttaaaaattgtttctagacatggggtctcactgtgtgcccaggatggtctcaaattcctggcctcaagcgatcctccctcctcagcctccaaaaacactgggtttacaggagtgagccaccgtgcccagccaacatagtgattttaataagataagtattttatttgacttaaacagtaaatgttttggtccagagtcctgataaactgattagtatttctgaaagatgcatgctgcccatcttcattaaatgtgatagcatgaagacagaattttatttaagccaaatgaattgctgttttgttttgttttgtgttgtttttgagacatagtctcattccatcacccaggactacaacctccacctcttgggttcaagtgactctgatgcctcagcctccccaataactgggcttacaagcgcacaccactatgcccggataatttttgtatttttagtagagatgagactttaccatgttggccaggctggtcttgaactcctgggctcatgtgatctgcccgcctcagcctcccaaagtgctgagattagaggcatgagccactgcacctggccatttgaattgatttttttaaattcaaaaatatctaatctgttagctcaaaatttattttaataaccccaaaatctatgtccagtttctccaagatgaaggcaataacaaaaggaacccacactgtcaaattatggctatctgcactcagaaaagagaaatatttttagttgccaactgaagacattgcatggagcaaaaattataggtcaaaagagagaagagcaaattaaataataagatgcatttgtttgaacttcatcctcattccttttttaaaacctacttatcagagaaaggtagggtttagatttatttcctaactactacattaatagataccctaacactttcctgatcagttttatgaattgattaataaggcaatcatggtttgggaaagcttttatatgccacctgatattgatgccatctataaaaagacaaccaaccgagcacctgatatccagtaaaggcaggttcaaaaattgcagtcttagaaagataatggagtgaccatgacctcaagtactttgagccaaatagcaactgtcaactcctgatagcagtatttgacctcagaggcacgtgacagcaaccaacctgaaacagccattttctcaaattctgttaaggataataaaccatgataggggaaatcacctgccctagtaaggaaacctcttgtaatcaatgacctagaaacgggcaccatgatttgagcagaaagcaggtggaggaactgcgggaatgtgctgctttatattgagggtccactagattttggcacggttgtttttgttgtagttattttgctttgttttgatcatttttagttcatctcctgaaaaatctcaacatacataaaagtagacagaacagcatgataagccaccatctaccgaccaggcagctccaacaattaccaaggcagtggtgccactctcgttccctctatactcagacatcatatcatctcatccgtaaatttgaaataaatatttaagtgcatatttctaaaatatttacatacacatttctaaaaataaagaccttttaaaaaccaatccaaaaccattatcactactaaaaaaaattgaccaggtgtggtggctcatgcctgtaatccccgcactttgggaggccatggcaagcagattgcctgagaaaagaccatcctgggcaacagagtgaggtcctgtctcaaaaagaaaaaaaaaaacaaaaaagacgactaaaaattaaccataagtctttaattgtatcaagtgtccagtcaatgtttacttttcccagttgtctcctaaatggacctgtccacatgtggcagttggctgccatcccattgacattattttaatctgaggttccctccccacacactttttctggctattcccttactgaagacattgagtcatttgttctaggggttcccacgttctgggctgtgccgcctgtgccctattgttttctgagaagtggtagttacacggaggcttgaatagatatgggcttgatgttttgacaggacagctttactggaggggtcatgttcctccaccagaagtgccatgtctcctttcatgatgttattggccattatgatcaatgggctctgataatataatataagctgttagaagaaaaccattgaaccaaaacattcagaaggttttgtttaaaaaaaaaacacactaaaatcctttttctctgtggtaggcactgtgttttcctgcacatagcacctcatttaatcattctaacaccctcatgaggtgctgatgggagcagatttgaacccagccagtgagcctccaaagctcattctcttagctaccacagaagcagatcgccttgagagtcttatcttatgggccggctgcaaaggagaagccccttttgacttaggtagcatgaataactgaaagaggtagaagtgaagcagtaaccaaaaaaatggttgaatcttaaaacacaaggtatacattcctataagactgatcaaaacaccaagtgggccagacacggtggctcatgcttgtaatcccagcactttgggaggccgaggcaggtggatcacctgtggtcaggagttggagaccagcttggccaacacagcttaaccccgtctccactaaaaatacaaaaattagctgggtgtggtggcaggtgcctgtagtcccagctacttaggaggctgaggcagaagaattgcttgaacctggaaggcaaaggttgcagtgagccaagataataccactccagcctgggcaacagagagagattccgtttcaaaaagtgactgtttattaactggcgaacgcaatcatctgaagggcgtgtcatctgacagaggaggcaagttggactgcagtcacagtgtcatcttggtacaggcatggaaacagaggctgaggaggtcccagacaaccttcatcaaatagggctgaaatagcactccgaatgtcaccaaagtgagtagaagccatgatgctctgtttaaagtttgctctgccctttgctcaaatcaacttagagttatgttacccactcttggtgggaagggttgccaaaattagagtcatttcattaatctcccaggccagggagaggtggttatatatcactccaggttacgttggcagcaggataatcattgcatttccgtagtgcataaagcagtatttctttccattcatttgctatcagagtctctataaaaacaccttagaactaaaatatgtttctcggtcctttagattttaacaagacttccttcaagacgaatatttttgaaaaattccaaagtatgaaaagtatggaagcttcatttcaaaggacatctctaaacaaattttttaaattaatatttttacaaaatgattgtctcattcctaacaggggaaggcaccttgtgattaaaaggaagaagaagagagggaaagggagaaggaaagatggaacacaggaagaagaaaggaaggaagggaaggaaggaggaagggagggaaggagggagagagggaaaaaatggcttaaaatatttagaatgtatttagaatatttttattacagtatttagggaatttaaatgtgtcaaaaacaaaataaaactgagagaaaccaaaattaagtatgtaggtagaaagtgatgttttgtcactaaatgtatttttgaaaataaaatcgggggccgggcacgatggctcagtgctgtaatcccagccctttgagaggccgaggcaggcagatcactggagcccaagagtttgagaccagcctggacaacagggtaaaacctcgtctctacaaaaaatacaaagaaaattagccgggcgtagtggtgcatgcctgtaatcccagctacttgggaggctgtggcatgaggattgcttgagcctgggaggcagaggttgcagtgaactgagatagcaccactgcattccagcctgggtgacagagtgagactctgtctcagaaaaggaaagaaaagagccaagcaaatttaaaatttcttcttcctagatctttctctctcagttcactgtaaatcactgtgtatttgtttaggattctaaatagaccataggtaatttataagttctcatggaatcttctgaacttttttaatggtgtttaccaacaagaaactgtgtcatatagtagagatttctgtaagctgtcctctgaaacagtattccttcccaattactttttaaaacaatgtgaaatccattatgtttgatacaaaaaaaaaattctaaaaaattgagtgaggtattaaaaaaaaaaaaaagatctatggccaggagcagtggctcacacctatagttctaacaccaggaggctgaggtgggaggatccatcgtgatcaggagttcaagaccagcctgggcaacataggcagaccctccccacctcccccacatctcaactaaaaaaaaaagtagccgggcatggtggcacacacacctgcagtcctagttacttgggaggctatggtgggaggcttgctggagccagggagttccaggctgcagtgatctgtgatctcaccattgcactccagccagggcaacagagcaagatcctgtctcaaaaaaaaaattaaaattttcttaaaaactagcaacaagatctagaagtgaatgtactgtaaaataaaaatcagagtaagggaataaagtcaagagacttgcgctatcatcattttacagctgttactggcaggaataaattgtttacattgcccagttccacatctttgattcttccagctcacataactcattattttacaaggtgtttctgtaacaactcactaaacagtagtccttgcaaacagttctgctgctctgtaatccaagattttggataacataattttaacataaacataatttcaataaaactaaagagctctttactgtgcactgaacaaactactcaggcagtagaggtctcgccaacaatgcaacagacaaagcaaagccgggatggctcaggcagggggcgcgcggatcactcactgcagacaaagggagaaggacccgacgcgcccacaccgcccgcgcatgccctgtgcccgcgggatcaggtgtagcggggtaacagttgaaagcgcacagacagctggagttagctggagtagccctgctactcaagctgtgtggtttggggcaagttgagtaatccttcttagcctcggttttcccatctgccgcatgaagaaaatgccaccttgcagagttactgtgaggactaaagagataacccacatacatcttcttagttctgctgtcgatgctcaataataaatggtatctgttattaccatatgccatcccagctcccatcatcatccccaataggcaagggacatcaccacagtgacacagctgtgcttagaccaaggatgcagagaattaaatggaaataaattgaaataatacccatccctctttagatgctcttctagaatttgggctgtctggaagtgggctactgtaagtgggttatccactcatgtgcctaatcctgcctgtgtattcaaggctcccttcctctgttcaggcaagaatagaaattggaatctgtgagtagtaagtgaagacgagtctagaaaaagcagcatggggtgaatggagccaccacactgttcagtggcagaaagtctgaatagacagctccaagctcagaaccatccacaatttcattattaggcttaacattctgtgttaatcaatccatcctaaaacccccacctctgaggcagacacagaggccaaatataacacaacccacataccatccaattcaggatgttgttcaaatattgatgagtttcaaaccctctaacaatataaagtattataagccacatctaaaaaccaaacttgaccttggagggagaaaacagccaaagacagatatgtattatataaatttcctttctgaagctacagggaaatgtcaaatcatcacagtttatttattttactttttttcttccccaaaaaaggaaaaggaaaattctggaatttaaaaaatcaaagagaataaaaatacaacagtacattctattgttctccaggtccaaaagtacatgcatatacttagctggcgaaagaaagaaaggaaggaaggaaggaaaggagggaaagaaaagaaaagaaaagaaaagagactttgacaaagaaaggcatttccctgggaatattctacctctgggaggacagtggtcaggcatttcttctatcttgctattccttgagcacagtcctgccaaatatcctcctttcaccatttgcagttaccatgagaaaaccacagagaaagctctggacagccatggagtcttagctggatctacaataaaaggagtcaggtaccctcccaccttcccagaaagactgtgctggggctcagaaaacaacaccccaaaatgaagccctcagcagcagcctcagaagcaaatgattttctctgaccttctcttgccctcctgtctctcagtcccattctcctcggaggctagccatagaaaccagaagccttttccaaagccagccataaaacctaaaaatattagtttaactttccctccaccctatctgtataaaaactggccatatgggctgggcacggtggctcatgcctgtgatcccagcactttgggaggccaaggcgggaggatcacttgaggtcaggagttcaagaccagcctggccaacatggtgaaaccccatctctactaaaaatacaaaaattagccaggcgttgtgcctcacgcctgtagtcccagctactgaagaggttgaggcagaagaattgcttcaacccgggaggcggaggttgcagtgagctgagatcgtaccactgcactccaggccgggcaatagagcaaggctctgtttcaaataaataaataataaaaattaaaactggccataaataaataatctgacctaccctgtttgatagtaggtcataagacccccattccagagagggtcctgccccacacccagaaggaagaaatgtgcgctcagagaggccagggagaatctagacaggcagctcttgctgggcttccccactcattctattagacttagatctatgcttttcctccaatcatattcccatatggctgtccatattttgttgaacctaagcataaaaatggacaatttcccctgtatctttgagtcttcatgctgaaggctcctgtgaatgcacgttaaataagcgtatatgccttttctccaattaatcaacctgcctcatctcagtgattttcagcaaacctttacaggaccaagagccttggcccccacaactatgacatgggataaaagtaaacttctacatgcagatgaatttggtaggctcagaaacatatacataattaacacaagattaagtgtccgtaatggatatttggggagggggcagagggaaaacaatcataagacacaggaaagctcagggatataaaacagctcagggaacacgtgcccctttgagaaggcaactttctgcttctctgctgtgtccgggagttcagagtctcaaccacatacagttcttaaggaccacctgatacaactgaaaagaccttggagctgatgcaacctcttcccacggggtgcctgccacagagatgagtgcctggagtggctgtcacctccagggaactctgagtgggccaaggaaggaagtcatcccctcctccattcaactcattaatcacagctgttaggtaaagagcccctaggggttcccacagtatagcaatagcctttccctacctacagccaagcctagtccaaaggtcttggaggccctggggctcttggtcagggccagcctcccaggctctgttcagtatgactgtaagagtgataagaatctctctgcgcaaaagttccttcttccacaccccccaaatgcacaacacccatcttcccaggctaaatgctccagagttctatctttgaattgccctgtccagaaacctcctttaaaatgcaaatacacataatagagattttgaaaaagcactttagcttataccagttctctaaggagataggaggctgggggaagaggcaggaaggaaaactgcctaggaaggggcagtctaagtaggggtccaggagaggcgctgagcaacccaggagagcaggctgactctgaggttgaaggggggattcagtggaaagtgatttctttaaaaaggaacatccagcgtgagacttagaccctggctaacgtccagaaggatctagaataggatggggagtcctcttacagtgatcatttcattctcgcataatttgtcctattttcaatgatctagatcagggcttggcaatctatggcctgcagccaagtctggtccagcatctgttttgtacctataagctaaaaatggtttttacctttttaaatgatgggaaatcaaaagaaaaataatatttcatgacaaaaaaattatgtgaaattcacatcttactgcccataagcaaagttttattggaacagagtcatgcccattcttttacatgttgtctatagttgccttctgctgtaagatatttccacaaagcctaaaatatttactgcctggccctttacagaaaaagcatctgaatccatgatctagatattggttaagaagatgtgctttgtggccagtgttctgggtggaagctgtgccacttaactcctcaggcaagtcccttaatttcttcatctgtaaaatgaggacaagtccttgtagaattagggtaagaactaaataagtgtttgaataaataaatgttcggcacagggtctggtgcatagtaagtgttcaataaatattagctgttattatgttttaatgtgattagacactgacgcataatcttattcttccacacttccctgtcccccattacaagttagaataatacatcttgttcctgaataagactggaaagtaatccactttggtatggccatgactaccaaaagatttcagaaaaatattaaatagcaagagttgacaatcattttgcatcaagctctaacctctagaaggtctatttcccatgatttaagtaaaagcaagtacattatcttaaaaccactttagcagaaaaagttaattaggcagagagttgatgtgactcacaataattctgataaagttacataggctcaggcaacaggagctgaaatgaatcacggcttgtagagctccctcactgtggtgaaagcaaccaactggaagttaagtaccttgggtagaatcttgtgctttgattcaagaatttccagttttttaagctgctcattagtgtcatctgaggcgtctttgagggatcaagttacagaataatcactggaaggaacaaagattagagtgccttaagggtaaaaagagaaagggaggatgatggaggggaagaaatgaagggaagggtcagctcctagcacaggcggcgtggttatactgccctcaaccagatgctgacctggcgcagatcaccaaatgctacaacatgtgagaaacacaaggtaatgatccttgttttccaagcttctaggctttgggttaaaataagaaggcaagaaacagaattctaagtacctgggtcagccaacaaaataataatagctaccatctcatgaattcatacaataaatgagccaggcagtctgctaaataatttgtgtgcattacccaatccagttacatagggtttcttagctccattttacagatgggaaattgaggattaggaaaatcaaataactttctacaacttacacagctagtgagcataaaagctgtaattttttatttatttattttattattattatttttgagatggagtcttgctctgtcgcctagcctggagtgaagtggggtgatctcggctcactgcaacatctgcctcccgggttccagcgattatcctgcttcagcctcccgagtagctgggattacaggcccccgccaccgcacccgtctaatttttatatttttagcaaagatggggttttgccatgttagccaagctggtctagaactcctgacctcaggtgatccgcccacctcggcctcccaaaatgctgggctgacaggcatgagccaccacgcccggctgccaaaagctggaatttttaaaatgtaaagttttaaactagacaatacatgcacacattactaaactcaaaaggtctctagtgaaaaataagcaaatctccttttctctctccatggaggaagtcgctactactagtttctcttggattcatccaaagaaattccatgcattaacaaacatgtgtgtacatgttctttcactcacaaatggtagcaaaatacactgtcctgtaacttgtttctccccctcaaactttagtaagatttttaagagacctttccgcgtctgcatatgtaaagctgaaacttgattccgactacccagcaccaaaactgtgctgataaccattttgctatatcacctctgggcacccccaacctttttgctacatcacctctggacgcctgtggggaggttaacagaaggcactggtgctaaactcagggtatgagcttcaagggggagttctcattgagctgctgctcttcttagggcatggaggtaaacccaaagagggacgagacctagtccttcccctccattcatttggagttaagacgcgtaggcctaatttcagtcatgaaagcagagagttgcacagtacagtgtccatggggttcagggaaagaaatcttggaaggtgagaactgttcagaaaggaagttgggaagcccgggtggaaaaggaatggcatgaggaaaggaaagccagtagctgggggatgtgtttggaggacccatgaggaagatgtagccaggtcaagtggaaccagctttgcaggcgtccctcaaagacgcttcagatgacactgggtagtctgattcaagtttcagctctacatatgcggatgcagaaaggtctctaaaaaatcttattaagggccgggcgtggtggctcatgcttgtaatcccagcactttgggaggccgagatgggcaaaccacctgaggtcaggagttcgagaccagcctggccaacatggtgaaacccccatctctacttaaaataaaataaaataaaataaatcagctgggtgtggtggtatgcacctgtaatcccaggtactcaggaggctgaggcaggagaattgcttgaacccgggaggcagaggttgcagtgagccgagactgtgccattgcactccagactaggggacaagaacgagacttcgtctcaaaaaaaaaaaaaaaaaatcttattaagggttgaaggagccatggtgtgaccacacactgttggttgtggaatatattacaagtactttgctacaaatagcagaaagattctcaggtttttgtccacttttaaaatgttaagggtggctctgctgctattagggaagtaggtcacagctacaggtattttcagagggtttgtgtctcgcccaccccccagggccagtggggaggttagaaaatccacttgaaacgctttcaactactcttccaggggctgagaacccccaccctgtcccaggcattctgaaagtgtatgagacgggaagcagcatattttgaaaataattccacatctacttctaaaaagtctaccctaatgtcacccttcttcactagcagagaggtgtgctttccagagtggacaagaaagtatattatcagctggattctatagatggattaggaagatgctgtatggtaaacgcacctgagagcaataacttcagcataccctgaggatggccctgtattgcagacgcacctgaatgtgtgctctgaactagggaatccgggcgtggccaagccagagattcattccttgtctttgaggaacatctgagccttcagcctctcccatggaacactggctgtgcagggactgaagccctgagtttggggttagatgaaggttgccaggtggaggtcctcgggggtagggtgttgagtgaaatggtatatacgctacaagctgtttgcaagcggcagtggttttcctgcacagcccgctgccactggactctctcccctgtatgtaatcccttaataaaaccccgtgtctcatttgctggctctgggtctcttctttggcctcttgagcctggtgccttccctactgaggttaataggggtttggcacaacaatggaagaccctgaagtcatttgaaaatgatgaggggtagacctacagcttccatcacattctctacagagactctagatttggattttgcacctaaagactgtcttcttgatgaaatagaaaatgtcaaagcacaaacatatgatggatatatttgttcactgggcatatatatttatttattgaggcggagtctcgctgtcacccaggctggagtgcagtggtgtgatttcagctcactgcaacctctgccttgggttcaagcaattctcctacctcagcctcctgagtagttgggattacaggcatgtgccaccatacccagctaatttttttgtatttttagtagagatggggtttcatcatgttggccaaactggtctcaaactcctgacctcaagtgatccgcctgcctcggcctcccaaagtgctgggattacaagcgtgagccaccgtgcctggccactgggcatatttatgtgtgtgtgtgtgtgtgtgtgtgtgtgtgtgtgtgtgtgtgtgtgtgtatctgtatatagctcaagtctcagagtaaaatggaattcttaaactaagtcatggtccagaaagttttaaatctgctgctctagaatatgttactccccagaatatagcaatctagtcctgaaaaatccaagcgactagatcatgcccaggtttgcaaatcacatattcaagggaaactgaacttcattcaggaagccacacatgacgaaggctgacaattgaagggaaaggagccattggcgactgaggccactgagggagtgcatgggaacaccaggcttcaggactgagcaactgggagcaggcactggcaacccaggctagacaagccagagctaaatggcatctgctgcctctttctgtgaagctgctgttctgagccaacagtcaatggggcctcatctagctcacgggcagctgtagttgatttgagtttgacacaggtgggccagcctctccgggcctccgacttcagtatgctggatacttcacctggatacttgtcaaacatctgggttcctggtcctggctccagaaattctgactcagttgggaaggggagagaaggagatggtagagttcacaaccaacccacacttggaaatcactggaaaaaaacaaagcattccatttccctgatggcaactagggcagtttccatctctcagcaagtatgtattaggcaagcatatgggactaggagtgtgctaggcgctgccaggaatgttttggattttttaaaaatatatcttagggccttctgttaaggagcatataagtgagctgtgtgatatgcttgcatgtgtgtaatttaattacgaaagggcaggaaaatagggaaataaaagggggagatgacaaatagataaaggtacacacgtccctttttctctcataacgtttggggagcaaaatcatgttctcttctattcatctaaaataacaaaaagggtagtgatgtgaatgaggccagggagttcctcagaggcccttccttaaacagaaggtgattaactaatagtcacagaacaagcatgtggagtgcaggtccagacaagcagatcccatatccaggcctgctgggaacaagaacagagagaggacccatctctgcctggctaatgtgtgacttaaagcatcgttagttcttttgacaaatattaagatggagaactgaacttcagcgctcattatgcagcagagattaaagcccagatgtggtcaattatgtgctcaaggccacacagatggagccaagacttgaacttaaagcccctttgatgaccatatttgacctacactgttttttcaagatatgaatagctagctggccacatatacaaaaataaacaaagctaagaccagcacctacagtacagtattacctggaacatggtaggcactcaataaatatttgtcagatgaattaatgtgccatttaaaagatacacaatattgggtcagacggctgtgaaagccttcgtccagcacctgatggcttccccacaaacatgcctaataatcaaacaagctgcactgatcccttttttatgttcccagaacaataataatagctaacactgttaaacacttactaggggccagacacttgctttacacatgttgacttaatctttataacaatcctatgaaacaggaactatgatcatcaccatttcacagaagaggaaactgaggcacagagaggttaaagcagcacagagccttacttcacaatgcttataagaaaaattctaggacaattaaattctaactgatgggtgcagcatgggatttattatccaaataggaatttggttgtattaaagcaataggaattagcctgtgggaaaaatcatcctaggctgtagaattagagaaaaggtcacagtggaggtgggatttaagctacttctgaagatagaggccagactgaaggataagggaaacggcataaacaaaggcctggggccaaaatatagaaggtgtgcccagagaccttctgcctggaatggaaactgtgcctcagggattagcaagacgtaaatttggatactgtggggtagagtcggagtacagaggacttagacacaggctagggagcttggttggttgtttaagaagcctgtctggtttcttgactaggaaatagcccaacaagaagtgaacttaaggggcattagcttggccaacagcctgtaagaacagtgggagagggcagcggcttgaaggcctggagaccaatatggcagaggctgcattaatccaggcctggagacaacagaaatggagaaaagacacagctgtgagaatatgttattaaaaattcagtagccatgctgagtacctcctctgggccaggccagttggggctatgagctcactagttggggctatgaggtaagtgtacctacaaggtaacctcgagaccaagcctgtgagcttacctcgctgcatcctcaccgcaaacctgggagaaggggtgttattgtccccatcctaaagaaaagaaaaccaaggccccaacttcacccacctatgcttccaatgacataaacaggctctggcaatgcattggatgcctcaatttcttatcaagaatagctcctttttgcttcttcaaagccatttgaggtcagggaggtagttggaggttgatatggtttggctgtgtccccacccaaatctcaacttgaattgtttctcccagaattcccacgtgttgtgggagggacccagggggaagtaactgaatcatgggggctggtctttcctgtgctgttcttgtgatagtgagtaagtctcatgagatctgatgggtttatcagggtttccgctttggcttcttcctcatttttctcttgctgccaccacgtaaaaagtgactttcacctccaccacgattctgaggcctccccagccatgtggaactataagcacaattaaacctctttttattcccagtttcaggtgtgcctttatcagcagcgcaaaaacgaactgatatagaggtgatgaattctgtttggtgtttattgtgtctgagctaacagaaggacacgctggttcagggagttgagaatcctagccagcattctcacagcatcatctctgagattagaggagcctgcccaactgagagatagtgactgtggctaggaaggctctgtgagaagggaagaaactggcccttatcgaccatccttgacctttgcatctcaaatctcatttaatccatataaaatgggtattgcttaggccctttgaaagctaacatgctgggccgggcacggtggctcacgcctgtaatcccagcactttgggaggccgaggcagatcagttacctgaggtcaggagtttgagaccagcctgaccaacatggcaaaaccctgtctctactgaaaatacaaaaattagctgggtgttccccgtctctactaaaaatacaaaaattagccgggcgtggtggcgcgcgcctgtagtcccagctacacgggaggctgaggcaggagaatggcgtgaacccgagaggcggagcttgcagtgagtcgagatcgcaccactgcactccagcctgggcgacagagcgaaactccatctcaaaaaaaaaaaaaaaaaaaattagctgggtgttgtggtgggtgcctgtaatcccagctactcgagaggctgaggcaggagaatcagttgaacccgggaggcagaggttgcagtgagccgagattgtaccattgcactgcagcctgggtgacaaagcgagactccatctcaagaaaaaaaaaaaataacatgctgagcattaagtagctagcccacagagaaactgggctagaccccagccagacacttcctacccgagaagccatacacagcagggtgcggtttggctcgtctaggaataagtgagcccttctcacggaactgctcttgagttgagggcccttttgccacaagctgtgggttgaaaggtgtaggcaaaagttcaccttttaatccacagcttggtgatccttttctgaaagaattctggctcttcaatgcaggtatagtcaagaaaagaaagtagtcaagaaaagtcttaccaaagcaacatagcttagtaaattgcatatgtacattttcttctcttttatgaacattcttattccatgattagacaacagctctttaaaaatcgagacagcaaaaacggtgacagatttgtccctgtcttgcaaatacgaccctttcaggggtctttgtaagttgtggaaaagtaagtctgccaatccaccagcagatgtctctgttttgcctaaatgaatagggctccctctgttctcagccactccatttcagatccaattaaacaaaaccctttctccgattgtccccagagatcccaacatgcttaaaagcaaagaattttcttcctccttaatttttaaaatggagaaatgtaatggaatagtttctcattctcctaaaaatcagcattcaagtctcatatacccatttcttgtaaatcttataaaaccaagcttatactggtagttgccaggggctggaggaagaaaggaatggagagttattatttaatggatacggagtttccgttttataagatgaaaagagtagagattgatggtggtgacagttgcacaatattataaatgtatttactaccactaaccgtacactagaaatggataagatggtaaattttacgtttgtgtattttatcacaataaaaaaaaattgagggagaaaaaagccaaccttataccaaagaatatattaccctcaactttagtccttactgtaaattccactcatgaattggcaaaattagcttaaggaaagtagatttcgataaaagtttaaattctgtgctctcaaagtaaaagtttattagtggaccaccttttgtgaataaataagtccatcttgagtggagatggaacatctccttttggaagattttgtgatagaagagatgctgaaaaagaatttaacctcgtgatggaagtcatttttcatttaaagtatctctaccgtgtatgatccagaggctctgttactttcttcctgttatgccttttcccctcaataactctaaatttaaaaattaagtagaaaatactaattaatatttgctgagtttttttctccctaagcaaattagagccccgttttcagtcaatccatgtgacccttgagaaatgcctcccctgtgtcaaagcatgcctggtcctgtaggaacccttttcagccagcaggaccctcaggagacagggaaaccttcttgtctagaacctccaaacaggaagtgccaaaaactaaaaccttgcccgaggcaaagtgttcttgtcaagattcaggtttctatggccacacctttttacatcctgaccactaagccaaactcatcgatttctatttcacactcaaaaacacacgtacacatgaaaaggagcactttaggaatagactgaccctaagagaaataaaacctcaagaacttccagtaaatttattcagaagatctcaatattgcacttaaaattctatttcagttcaacgaatcaacttacattgaaaaatgcattttcaaatggagggcacattagggatctcagcccaaacatagcttgggtgtttttccagctgaatgttggcctgactctcatactaacctctcctgtgtatgagagagagcatcagccttgatgcagcattgatccaattctcctgtgctaagcatgtctcgatttcacgtaatcactgtatatcactttcctttgtattcagggtagaagctgccatcggtgttatttccttgcataaccccctgttctagctcgaactgtactaatgagtgaccagaatttactgccacgttggacaacagggccagctatgctttaaatgtttcttttcaccgaaataaccagaacgtgtcaatcagctaatattatgccaccagtggcatctcattaaaacctcttttttatttttagctagattctgtcaggtgaacaccatccaactattcaaatgttgctccccttacagaagctttcagaggaatttggagctgaagttgccagcaacagagagggccacagctaacgcgatagagctgctcacagtgttagaccaggcctatgaaaactttgcaccgcagatcctccccaggtgtaatctaggtgggagaaaggccttctagctctgtagttgtcctatcaaaaaacaaaagtttctccatggaaagctccacttgtggccaaagagaagaggaattggagacctggcagggaggagctgtcagagcccagggggagagtgtgaagccatggtcctggtggccagacaggcctgcttagagcctggctctgtcacctgttactatgtggccttcaacaagtcacttaaactcttagatctcagtttcttcatttatcaaatggcaaaaacaaaatccatcatgctggtataatggggatacttttctacaaatagtaaatgcatgcattttttactaaatatcttgtatatatatgtgtatacaaattataaactaactatagattttcacagcaaacatacccagattaagaaacaatgtaaccagcacctcattccctcctaagagtaacacatcctgacacttaacaagatagactagttttgcctcattttgaacttgatctaaatggaatcttacagtatgtactccttgtgtctggctttttttatccagcatgatattttctctaagaaatatccgtgttgttgtgagaagcaatagattattcctactcattgttatacaatattccattgtatgtcttttaaaaaatatataccattgtatatgtatatatatatacattccattgtatgtttttttaaaaatatataccatggtatatgtatatatattccattgtatgtttttttaaaagtctatttaaacaatattcccttcagtctacttcctccaaggccaagtactgtgtttttttgttttgttgtgtgtatgtgtgggtgtgttgtttgtttgtttgtttttggagtcttgctctgtcgcccaggctggagtgcagtggcacgatctcgggtcactgccacctctgcttcccaggttcaagccactgcattccagcctgggagacagagtgacactccatctcaaaaaaaaaaaaggtagatattactatgagagttattaccttaccatcatcattgttacgactacaataactcagataacccaaagcagctctgttctcttgggcatattaggagagcacctcccaacatattcttaggaggatctgtagttgcttcccctaaaggagcaattaaagatggctgtgctgatcctacagttctccccagaccccctcttcaccattcccctgtccttctctgcctttcctcctccacctttctttacccattccccccaactcctcgcctcaaagcatcttggctgttttcttctgggaaatgtggtagtctacagcgagaccacctcaattaaagaagaaaccagagggcctccaagaaaggggagccaaatgaaacgctctttccaaaagcatgtatgtctgtatgatcacagcggcttccaaaacacccaaaactgaagaaaaagtgatgcttaaattatgtttgagcgttgatgatacctgaaactcagaaaatctttaatcttccacagcaaaaaatgagcttactatgtatacttgcttaaagtcctcgcatatgtagactgattatccaacctccctctcgtttccatcattgagtatcatgaatttgtatttgaattccttctctttgtctaaactttgaaggtcaccatgtttctattccccgtcccatatcaccaccaacttttgctggatgcagtattgttcacatcagtagatctaaaatattatctattattataaccctcttaaagacacctatactcctgtgcccagggttgctgagtattcaggattctccattacaatcttaatcttgactttctctttcatcgttcctataaattaacttataatttttcacactaggtgtcccaatttggggttctgaaaatatggtctatgtgtctttctattctcatttcaaaagaggccagagcaatttttcaatatcttacatacaaagagaaaaggaatgtttagggaaagatttccaggacctcataacagttccccactgttctctaagatggttgttaaaaagctcactttgtgaacccaggtggccagaaaatcaaatcaagaaactagagtattgtattcgccaagctgttacactagagcagactgagcaacttggctcagcaggccatgggcatcattcctccttggtggctcctctggaagtcgtggactcttgctccacctcgcttttcttctccatcaaatgggactaacgaggacattgtgaaacataattgctgtttatggagagcctcggcatctgagatgaaaggcatttgaaccaggtaaagcttgttcaagatgagttaatgctttgattagtggagttcaaggaagaaaagtataccccatgtcatctgagaatgatcctgctggctgggagaagcaaggtttcactttacagaggacttgtggggatttttttgttctcttttaaatggtgttcacaatgctggaatttctttccatgcttgacgttagaggaaatcctcgaacatgaaggaaaatctaactcattagaacctggcgacattcaaatcattttttccatatagccaagcacatagtaagtgctcagtaaagatttattccatggcccaataaattatttgctcaaatctggcccaatgtccagaaacaggtccaaagattgacatagctgggcgcgctggccacacctgtaatcccagcattttgggaagcccaggcgggcagatcatgaggtcaagagatcgagacaatcctggccaacatggtgaaaccccgtctctaccaaaaatacaaaaattagctgggcctgatggtgtgcgcctgtagtcccagctactcgggaggctgaggcaggagaattgcttgaacccaggaggcagaggttctagtgagccgaaatcacatcgctgcactccagcctgggtgacagagcaagactgcatctcaaaaaaaaaaaaaaaagaaagaaaaagattgacataacactttcatatcaaaaaaagatgaagaatccaatgaaacacatgacatgatgattttgagttatgaaaaatattcatgctccattaagaatcatatagaaagccactcacatatttccacaggctatgcatgcaaacaacagcaaactgacacacagttcaagttatttgcagtattgcgtccatagagagagaaactctaaagttctgtgacagatttttaaacaaaacatcagaacttacacatcctcattagtacaaacctcaggaggctacatctttattccaacaatgatatcattgttcaacgcattttaaaattcctctttagaaacactacacagagccagcggcctgttctttttaatatctgctgtagtggcaaatcttcatatttggagggtaaatttgattcttgtagataacaaaagggcattaggaattggttggtgattgagaatcctagattataaaccaaaagggaaatgtgattgccatgtaataagaatttattttcttacatggctttttacactggctctaaaagcaaatccagagaaatagttccagaaatgatttttgagggttgatttagtaaatctatccactccacagaagggacaaaacaagcaagaagaacgcatcataagcatcattacatctaacatctgtacattagggtctgcatttacaatgtatctagcataatagtgcctcatttacgttcgcatctgcccccaccttggcctgacccatggttcaaataacctcaaaggtatctacaaaatacaatactgagggccgggcatggtggctcacacctgtaatcccagcattttgggaaaccagcctggccaacatggtgaaactccctctctactaaaaatacaaaaattagccaggcatggtggtgcacacctgtaatcccagccattcaggaggctgaggcagagaaaatgcttgaacctacaaggcagagtttgcaatgagccaagattgtgccactgcactccaacatggacaacagagcaagactttgtctcaaaaaaaaaaaatacagtttttttgtagccctctataattgatatatttttaaatagtcaataataaaaatgtatcaatactcctctattgtatcaggaacagagaagtcatctttcaactaggtgacattgtagtgagtgaaacctcctcatcatatacaaaggctaaaccagcagagcaaaggaggaaaacaggaagtgaaaaggccacgagaaatgtgagatcttaaatccaaatcaaatatctttgttctttgttgttacccttagagtcatttcttttttttttttttttttttttgagacagagtcttgctctgtcacccaggctggagtgcaatggtgcgatctcagctcactgcaacctctgcctcccaggttcaggcaattctcctgcctcagcctcccgagtagctgggattacaggcacctgccaccacacccagctaattgttgtattttttagtggagatggggtttcatcatgttggccaggctggtctccaactcctgacctcgtgatccacccacctcagcctcctaaagtgctgggattacagacgtgagccaccgtgcctggctgagtcatcatttcttaacatttcttacaaccagtccttttcactagactcattcattgcatcagaatatctacaaccttgggcaagttactgaacctgggtaggggaagagggagaatatctacaaccttggggttgagaggaggagggagaatatctacaacctattaagacaaccagaagcaaccacaaggattcctaggccaatacttctaagccaattctggaaaatatcgtagagaagggtcgaagtggggttttctggtagcacagggaatagtggtacacacaggaaagagtctatgtcactgggtttgtattgtcttgcagagataattcattccccagtggttgtcaaaataacataccaaggatcaaaatcatagctgtttgtgcctgtggctgtttgcacatggaggtcaaatggtgttccctcatttaccatgggtagtagggcataaatgtcctctaactgtcccagtttgcatggaactgtcacggtttcagcactggcagccccacgtcccaggaaactgctcagttcaaggcaaaccagaacaaaccattggtcagaggaaaaggaagcccacatgaggccataagatatatttcagctgcccatcgagaatggaagccagcaatcctgacatcagccattaggtcattttgttctacctggctggtgttcacctccaagaactttcccaagcttgtgacccaacatggtaagagaagaaaatgacagtaagctctgggcccccactgtggtgtgaagcttgagctatgccacactgccttcctgggcctcagagatataatgcgtaggtgaggagctgcaccaaatcagtgttttcaaactccagacaacagtttgattttcatgggccaggaaatcaatgtagtggcttgcaaacagcattttaaaataatagaataaaatggaatatgtgagagggcattgcacgtggcaaggaaatattgtttgtaaaatatgtttcagctacatatctatgtccatgtgtactgggtctcagtgtaaaatctagtgcttagtgtgggttgcaaagtccatacatggaacaatctccaaactttctaccagctccagaattttgtatcctacagaagtcatcctaataatttcttctcttatacgtgtcatgagatttggtaactagagtgcgtgggacttccttcactgggcattgggttatattatttttataaattgtttttctcttttattattgtaaggaaaagttgtccttcacctatttatagcacccagcacggagtcttacagttaggtcactgtcaataaatggttcttatctctttttttttttttttttttgagacagtctcacttgtcactcaggctggagtgctgtggaacaattacagctctctgcagcctcgacctcccaggctaaatcaatgtgcctgcctcagcctcccaagtagctgggactacaggtgtgtgccaccatgcccagctaataatttttattttttgtagagacagggtctccctatgttgcccaggctggtctcaaactcctggcctcaagcgatcctcctgcctcagccttccaaagtgctaggattacaggcatgagccaaatgcccagccaagaaatgtgtcttatattccaacataccaacaagaacacactcaaacatcatcattggtgccatcttccagctccagcaaaagcagaagtcccagggctggatggttgtctcagacagcaagagcatgggctcttgaacaattttgcctttcaactggagagaactcggcccagtaaaggccacagtgatgcaacagcagccactgcagacgcaagtctgaccctgaggtaagatgctgtttcagccaggtgcgatggctcaggcctgtaatcccagcacttcgggaggctgaggtgggcggatcacaaggtcaggagttcgagaccagcctgactaatatggtgaaaccccatctctactaaaaaatacaaaaaaaattagctgggcatgatggtgcgtgcctgtagtcccagctactcaggaggctgaggtaggagaatcgcttgaacccgggaggcagaggttgcagtgagctgaggtcgcaccactgcactccagcctgggctacagagtgagactctgtctcaaaaaaaaaaagaaaaaagaaaaagaaaaaaaaagactcttttcaagaacaacctggttcaactgctgaagagatgaacacacaagggaaaagcaaaggagaaaaaagaaggaaaagatagatctagaatgaaaaacaggtacgcactaatcacacaccaatgatgacttcctgtttttgtttttgtttttgagactgagtctcactctgtcacccaggctggagtgcagtggcacaatctcagctcacttcaacctctgcctcccgggttcaagtgattctcctgcctcagcctcctgagtagctggaactacaggcacgtaccaccatgcctggctaatttttgtatttttagtagaaacagggtttcaccatattggccagactggtcttgaactcctgacctcgtgatccacctgccttggcctcccaaagtgctgggattacaggcatgagccactgcacccggctaatgacttctaggagggtgaaatatgacaggcactgcctgtgcattgacaggaagtatgattttatggattgtcactctataatggcagggtatagaaagaataaaggttagcaatttttacataacaaatctattagggaacccttttgttttctactctgccccgccaccaaaagttatgcaggaatttccatataatcaggacttcaactaaaaatttctgcatcctgaaaaggaaaaatgtcatttcctcttaaatcacacttatttccatgggtaattctgaagtttgttaaaaggacagaaatggagaaggttcatatttatggttcccagtcttttaaaaaattaggaagtgaaattgcttctccaaaatataagaacagatcagaaattaaaacttaagaggcccactgcagtggttcacgcctgtaatccccgcactttgggaggtggaggcgggaggatcacttgagtccaggagttcaacaccagcctgggcaatatagtgagacccccctccccccacccgcaatctcttcaaaatgacatttaaaatgtatttttaaaattaagacattaaaacttaactttttacaagcataaaattaggccacatcacgagcatggctggccatgggatgggctcatgcccaaatgagggtgcccaagcccctggggccacatcccacacaggggaggaaactccatcccagtaagagaaatgacgtgatatggactttgctggcaggggcgaggggtcgtccaggcgggtgcggagggacacagtgtgtggagacaggcagttgagctgttctagccaggacctgccgcctttgaaaaacaagacctaaggaaacgaccacaggctcagaatcccaggctaagctaaacagctcgatctcaggaaagaggaactgatgcagttgagaaccggccgttctcttttctgctgtctgtactttttattatgttcctttaaactacttgttacgggaacttaatttttaacaactatgtaataaatccaacaaaactatgaaactaacacctaagttcctcatgctttttcagtacccatcgctggactccaaatttccaaattcccaatgaaggaaccagctcctgtctcccagcaacacacgccgctagcctgaccagggcggaatgttttggggtcaaacttatccaatcagccgagggtagggagagaaatggtgccccagggacccagcgtggctgcttagacagcggggccgagggtaggcaggggccaccagtctgcgtgacccctgcagtttcaggaagtacgatagcaggaaacgggcagagctcagatgagacccaagtccagggtgcagcctggaagtctgattccagaggaacaaagagacaaataccaacgtggattctggcagaggggaacaatgcaggtgcccagtgagtaaaactggggcacaagaggaaggtttaattaccggaaaaagatagcaggtactgaatgtggggcagaaagtgagggaggatgggaaacaattgcctctcttgctaagacccagcacagagtcctgcacgtgggaggaaatcaataaagattggctgtttcgttaattaactcagcagcttatttagctcagccaggtctgttgagtctttaaagaaactggatcagtgttaaggcagggctgcagccctcctgcatcagaatcacccggtgggggtgggggattggggcttgttgaaaatacagataccagggctctgaaagagacttaatcctaacctcctgggcctggggcccaggaatctgtataccactgggctacatggctgtacctgtgggtcgccttgttctgttggagaaacttgttattgtattgggtactgtttgccttaaatttcaggttaaaattaatttttcccccaattgagcaaaatagaggcagtgacagtattcatatgaatgtatctggtgtgattcgtcccatttttcaggtggagtttatctcattccctgtctccacactggaccggtttgcccagatctgtttttacctacagggccagctgcagggctgggcagtcccagtttctggtgcaatcccaatggcaggaatctcggccctaccctctacccactgtgctgataattaggtcatcctttccagacttgacatcccaggcccaaccatccctgctcctaattgttccctgaaggtgccccagagctggagtaccacggtgagccctgggggtccacaatacctctagatcccagcatctcacctgcccccaccatactgacctaacacacaggagtgggtgactgccttcacttccctcattcgagtctttccctaattcagaaacaaacatgtactgagcacccactgtatatgtgccaggcactgggttaccaaagtgagagaggatttgaattcctgggggtctccatttctccacaagagtattggtttggtttggtttggtttttccattttgatggtaatctttttttttttttttgagatggagtctcgctctgttgcccaggctggagtgcagtggcgcgatcttggctcactgcaagctccgcctcccgggttcacaccgttctcctgcctcagcctcccgagtagctgggactgcatgcacccaccaccacacctggctaattttttgtatttttagtagagacggggtttcaccatgttagccaggatgatctcgatctcctgacctcgtgatccacctgcctcgccctccctgagtgctgggattacaggcatgagccaccgcgcccagcctgatggtaatcttttttaaaaaaaaaattgatattctgccatataatttttttttaatttttgagatggagtctcactctgttgcccaggctggagtgcagtggcacaatcttggctcactgcaacctctgcctcccaggttcaaataattctccctgcctcagcctcccgagtagctgggattacacgtgcccaccaccacacctggctaattttttatatttttagtagagatgggatttcaccatgttggccaagcctgtctcaaactcctgacctcaggtgatctgcctgcctcggcctcccaaagtgctaggattacaggcattaaccaccacacccagcctctgccatataatttacagtctgtatttatattcataaacattctcttcaagtgaaggccaaatgatatcatgtggtgatgaaccatgaataatccaaaatgatttaaataaagtgcccaacattttgttatccaagctcaaaggaaacttgtagcaatcaaagcaacattctcgtgttcatggaccccattttgtacctaccatcttctaaaagtttgttatgaatatggcagtgaatgaacaatgaaaaatctttctgttcctcattctagcaattatgcaattagacacttcttaaaggcagatttccagcatgtggcaatgctaactttacttttgagtgaacaagacagttcctcagagtgagcaagtggcctttcattaaaatcggcatttcaggaatgctcaggggcagagttttaattaactatgaggtcggattattctgagctagcatacaaggcaaagctaacaggtattctctgcattagcactgaacccaaaggccaaagacaataactataccattagtttcaggacaagagcatcatctgtcatattaaactaatgttgttttacttataaaatactggttttgcagtggtgtttgggcttcattcatacatcagctttgtttttataataatagctagtactaattagtgcttgccacatgccaggcactgtgctaaacctttttcatggattgactctttaatcctcaaaacaatcctatgagatagatactatttcctgcgtcttaccagtcagtaaactgaggcacagagaaattaacttacctgaggttacacaccatgtaagtgacaggtctaggatttaaacccaagtgggtcttgctccagaaattgtgttcttaatgcaacactatactgtttatcattatatcattttatatatatatgattatatatcactttatatattaaatgatttcatgatttcattttatattttttacatatttttttacatatttgaatagttataaaaactgcttaatccaatatttagcttgtaaaaatttcttttctgatttaagaaaaagaaaggtctatgtactattcaagtgaaagaaatgctgttttagtagaatttctgctcagagtaactgggacctgttctttgttttgatgttgttgttttgttttgttttgttttgttttgttttgtttttgtttgtttgtttttgagacagggtctcgctcttgttgcccaggctggaatgcagtggtgcaatcaccgctcactgcagctttgatctcaagcagtccttcccacctcagcctcccgagtagctgggactacaggtgcgcaccaccaagccctgctaatttttgtattttttgtagaaatggggtttcgccatggtggccaggctggtctcaaactcctggtctcaagcaatccacccaccttggcatcccaaattgctgggatttcaggcataaaccaccatgcccggctgggacccattctaaatcccagtggtgacatgaagtaggaagtggctccaatgcctggcttagctctgtaagcctttctgatcctctcctcacagcccagcatgccctcctcactagggaaggcctactgggtaagaactgagactcctgaactcatctccacttgtcaagcccctgagcattcccaatgcctagttttcctgtgaagtgttctgctgttaggtcagctctcctgctaggaatgcaagctggagttgcagctgacattgccatctttgaacccaaagtattcctcatcctaccccactccgacctccagccttctgcagggcaggtgagtttcccaactctctgtcacagctgacacctgactgtgaggtcccaatcagcaccagcttcctcatcctccttctttcccttctccctgccagactcatgttcagatgcttctcctttggctcagtgacagcctcaacagcatatgtgatcacagtgacaactgcctggtgccaactccagttcaccaggccagtatgacaaaagtgaatcacactgttataactgcatcaaaatgaggcagtaactccttgaaagagtgtcagtaagatgcaggtaataaatgcttctagtctgctggaaggcccatgaattgcaatcctccctctttataatcacaaaagatatgatgcataattacaagttaatggaactgacttttgcatgtgacttgggaattataaaattataaagctgagagggtcctcagagttagatcactccctgcaagttgcatcacttgtttacaaatgcttttttgtagcacaatggtaaaaagcacttttaccattgtttcagcactaacaaatgagcccccataatcttcatgcttttgggaagagtactgtccactgtccagtctccaacttctttttttttttttttttttgagacagagtttcgctcttgttgcccaggctggagcacaatggcgcaatctcagctcacctcaacttccaccccctgggttcaaccagttctcctgcctcaacctcgtaagtagctgggattacaggcatgtaccaccatgcctggctaattttgtatttttaatacagatgggatttctccatgtcggtcaggctagtcttaagctcccgacctcacgtgatcccgcctcggcctcccaaagtgctgggatcacaggggtgagccactgcgcccggcccagtctccaacttcttgagtgatgagaggtggttaagtagcagccaagtggcttcctggtccctggatcacagctgtggcattgcattcttgaagtcaatcgtcctgtgatggtctacatacaatcttccttcccgatgatggcaaaggaggcagctcccagcaggccagttgggaagcgtgctccagaacccattcctgcagcctgggacccacttctctagccttccattggtttttatgttcctagttccatgcatcaatttggttctgcttaaaatactctgaatggatcctatttaagagccctggctaatacacctgcactaatcatgtcacaagaaccctatgaaggaaggactagtattcccttttacagtctgaggaaagtggcacaggaggttaataaggttgccccagggcttacttagtaagtggcggtttctttagtaagtgggtctctggctcaatccatcccagtccagctccacaggccacactccaaaggcttcactgcctctgtcttagctggggctgctctaacaaagtaccataggcgaggtggcttagaaacaacagaaatttatttcttatagctccagacgctggaagtccaagatgagggtgccagcatgatcaggttctggcaaagaccctcttctgggttgagaatccaggttaattctcgagtcttcacatggcagaaaagagcaagagagatctctggggtccctttggaacagcactaatcccattcaagacggctccatctatcacctgagtataggagttcgagacccgcctggataacatggcgaaaccccgtctctactaaaaatataaaaattagccagatgtggtggtgcacgcctgtaatcccagctactggggaggctgaggcaggaaaatcacttaaacctgggaggtggaggttgcagtgagccgagatcacgccactgcactccagcctgcgtgacaggaacgagactccgtctcaaaaaaacaaacaaaaaaagaggtctccaccttaacaacttaataacctcccaaagcccccaccctaacaccatcacactgtgggttagtctttcaacatacaaatttgagaaggacgcattcagttcattgcagtctcatcactgtgctacttgacgtaacaggaattaatgatgctttgttggacctgaattatttttccaatctgatgtcattccactcatgatcaaattccctgaagagtctgactggcttgccatgggtctcagatctcacctacccaaggctccttgattgacagttccctcaagactgcaggcagtggagtcagggtagttccccgaaaggaaaagctggctgctgttttccaatggcagggaaagggatgttggtcagaccaaaacagatgtccaccacaattaccaaaactcgtctgagtctggccattgctcaaaagcatcatgggacaaatagacaaatgaaaaatgcccagatgttaagtggaaacttgcctctcttcagtcacgaaattgtcttatatggaccttgaagacggctcatgaaatgtgaagacttttgtaaaatgtgggcatagcctcaaagctgccatgggggaagccaggcactctggaagggaaggtaggaaagagaagacactgaggagcatgactgggtgctgcgctcagccagcctctcacccccacccactccgtgaggaccacttggagcactggttgaaaccccggcagagcttggtgacggcatttctgccacatactgacaccataactaactaaagaatgtccttgggctagaattgagaaggccttagagatgcccggaaacagcctgctgcttggacaaatgagaaacctgatggtcaaaaccccaaatcacaatttatccctgggcacctggtggattcttccatttcctggagaccggtaaattgatttcaggggtataattcatgtgcacttgagtggtttcaactccttatctaatgattttaagtttttgtttaaatatttttttccagaatgaaataaaaaatacctcttctctctctaacacacacacacacacacacacacacacacaaagggtcttcaaaaagttcatagaggccaggcacggtggtgcacgtccgtaatcccagcagtttgggaggtcaaggcaggaggatcgcttgagcccagaagtttgagactagtctgggcaacatagggagggcctgtctctacaaaaacataaaacttagcctggcatggtggtatgttcctgtagtctcagctacttgggaagctgaggccgggggatcccttgaaccaaggagcttgaggctacagtgaactatgatcatgccactgcactgtagcctggatgacagagcaagatcctgtctaccccccgcaaaaagttcatggaaaatacatattatgaaaaaactatgcatagatttcaaaagtaaactggactaacgttatgtgtctgagcaggatctagtttaaggcactaaaatgataagacataagtttgaaaagagcctctgtcagagcaacatgaattctgctaaaactgaagcaaggacaaatatcaaatttatggtgaagcttgggtggaaaaatggtgagatcaatgatgctttacaaaaagtttatggaaataatgcctccaaagaaatcagcagtttgcaaatagataacttagtttttttgtttgtctgtttgtttttcaatttgtagagaggggggtctcgctatgttggccaggctggtctccaacccctgggctcaagcaatcctcctgcctcagcctcccaaagtgctgagattacaaacacaagccaccacacccagccttgttttaagaagggatgagatgatgttgaagatgtagcccgcagcagcagaccatccatctcaatttggaaaaaaaaaaaaaattcatcttgcttgtgcctatttaaagaggactgacaattaactgcagaaacaataatcaacactatagacatctcaactggttctcaactagaaaattctaaacgaaaacttaaagttgagcaaactttccattcaatggatgccaaaaccattgcacccagatcagctgcagacaagagcagagctttcaacagaaatttaaacaagtgggaccaagatcctgaagaatttctttgaagaattgtaataggagatgaaacatggctttaccagtatgatcttgaagacaaagtacgatcaaagcaatgactaccaagagataaaagtccagtctaagcaaaagcagaccattcaagagcagaggtcatggcaacagttttttgggatgctcaaggcattttgcttgttgactttctggagggccaaagaatgataacatctgcttattatgagagtattttgagaaagttagccaaagcttccacagaaaaacacccagaaaagtgtcatcagagagtccttctccaccaaaacagtgctcctgcttattcctcccatcaaacaagggcaatttttctagagtttcaatgggaaatcattaggcatccatcttacagtcctgatttggctccttctgaccttcttaattttctaatcttaagaaaaaatttaggccaggtgtggtggctcatgctgtaatcccagcactttgggagaccaaggcaggtggattgcttgagtccaggagttcgagactagcttgggcaatgtggtgaaaccccaactctacaaaaaataccaaaaacattagctgggtgtggtgttgggagcctatagtcccagctattcaggagactgaagtgggaggatcacctgagcccggggggcagaggttgcagtgagcagagatcatgccacagcactccagcctgggtgacagagtgagaccctgtctcaaaaaataataaataaataaaaatttaaagggcatccatttttcttcagttgataatgtaaaaaaaaaaaacaaacaaaaaaaacagcattgaaatggttaaattcccaggaccctcagttctttagaaatggactaaatggctggtgtcatcacttacaaagatgtcttgaatttgatggagtttacgttgagaaataaagtttataaagtttatatttttcatcttttaataccacttttctacgaactttttttttttttttttggagacagagtcagctctgtctcccaggctggagtgcagtggtacaatcttgggtcactgcaacctccatctcctgggttcaagccattctcgtgcctcagcctcccaaatagctgggactatacaggcacataccaccatgcctggctaatttttgtatttttagtgtagacagggtttctctatgttggtcaggctggtctcgaactcctgacctcatgtgatctgcccacctcggcctcccaaagtgctgggattacaggcatgagccaccgagcccctgcctaactggtttaattttataatccctttctcccgagggaaaaaaaaaaagaaaattcagatttttcaaatttcagacaagtgctctttactgcttttactgagatttttccttgccaatcatttcctggaatttctccattgatgcctttcattgctagtctcagctttttgctgaaggttgattatgtgactaaaagttggttgcaaaaaatgtccctacatatcacattttcccaaagttctgctctttttccaattcaaccttcatggttttacttttccctgcaatataagtaatctctcagctgctaattcacaaaacctcagagttggtgacttctctccccatctagtcattctctgaactgaccaaagtaggaaggtttcaagtgtcatcttatgaagacccacttttcccaaaggacactgtacaggtgagacaagaggatgtattctagtcgaggcaaggcttctgcagcagtcagcaaagcagcagagtggtttagcactagccaaacggatgatagtgctatatctacctacgtagacaaagtcacacctggaaagaggcagaaatagaataacccctgggcattatttattttagaataggaagaaagaaattgaggaagactgggccttacctgatatgcctggcaattaatgagcagagagcagtgctggttaccatattagctgagagataaaatgtgtaagggaatgaaaggaggcaaatctactcccaacaatggtcaccaatcagatttcccagagtccaagctctctggacattcaaggagaattttctaaagctttccctaagttgctaaaccattgtcccccaataacaaataatttatatcaacctagagaataattgggccttgtatcaagacacggtgaggcagagcacttgtaaatgatgaatgagcagcagggccagtcacgctgatataaactcaaaccatggtggccaccgtccattaggaagttccaagtggaatccatccataatgggattttatactcatagttgtgcccaaccttgccacggcagaatccccatttgtgtgcccagaagtgcaatcaaagagtcatttctgcactatgattctgtcttgattttcttagctatgcgtgaccttgagcctgggcacttcccttcttcatatcaggacattaaagggaaacaagaaaacatattttcttttttcatattaggatctcacaatttttactgcttcctttttaactttttaatacaatacattcatgtaatgccaaaattaagataatgtttgggaaaaacccaaatacccaatttaccaaatcactctaaaagctggctgatcaatatgtcccccttttgtttctgcaaaattagattcatgatgtatatgtgatctgttcatctgctgctttcatttatgattatggcaggtattttctcctataagtttcataatcacaattttttacaaagggtatatcagcgtattgttggccctaatttagtaaatcatttccctattgttcatccaggctgaaagagtctttatcagcacaagaccaaagaagcttccatttgctattaagttttgagttgggaactctattcggagaacaattgctctgaaagctctacgtgactccttcggatgcaagagtgaggccagctcagctgggataagctcctactacagaaaagtagggggaaaatttcagaatctggtggttcatcatagagccagcactagcatgaaaggatgaggctgccacctcagggacaaaatgaaaaacaaaacaagaaagccacatcaaagaacgaaaattttacccataattagttgtgttgaatattgcttgtttttccccttttggttactggtgtacaaacttttaacatgaacaacaacaaaaaaaaactttaatcattacttttttttttttttttttgaggcagggtctcattcagtcaccaaatctgatcgcagctcactgcggcctcaacctcccagactcatgtgatcttcctacctcagcctcctgagtagctggtattacaggctcacaccaccatgcccagctaatctttgtattttgggtggagatcaggttttgccatgttgcccgggctagtctcgaactcctgggctcaagcaatcttcttgcctcggcctcccaaagtgctgggattatgggtgtgagccaccgcacccacataatgattatgttactttttttgctgttctttttttcattggcaaaaggaataaatgcacaagatttttttaaatccagacacagtatattgtctcagatcttgacctctatccttctggaatttttctttgtatatatatgtatatttacatgtgatgtccctttttgtttacacaaataagaacacacactgtattgcacttgccatttttatttgacctcaggtctcagattgattcatcttggcatagataatctacttcattattttttgtaagagctgcatagtttttcactacatgaaagtgctataaccatttccctagtgtgagatattttcatagtttctagggtttttcatattaaaaataatgttgtaaccataacattttttgacagattcaaggcaatcgaaagtcctagatttcctgaacagtcttaaattaatgtcataaatgatttttaatagaataatttatatagattccaaaaaggcatttgataacattttattcctgattttttaaaaagaaatttcagttaagaaaaaattctttttttaatttttatgcttaatggggaaataatggaagcttttccattagaggcaggaaaaagacaaagatacccattctcaccattattggttaaattgctctagaattactaatgcaaaagaaagaaacagaggtattaaaatggaaaataaggaggtaaaattatcttgatctgcagatgactattatatatcatgaaaaacacgcaaaatcaacagaaaagcttttagagggccaggtgtggtggctcatgcctgtaatcccagcacttcgggaagctaaaatgggaggatcatttgagcccaggagttccagacaggagttggagaccagcctgggcaacatagtgagacccctatctctaaaaataatttagaaattagctgggtgtggtggcatgcacatgtagtcccagctacctgggaggctgaggtaggaggattgcttgagcccagaagttcaaggctacagtgggccttgatcacacaattgcactccatcctgggtgtcagagcgagaccctgactcaaaaaaaaaagggggggtctggcgcagtggctcatgcctgtaatcccagcactttgggaggccaaggcgggaggatcacctgcggtcaggagtttgagaccagcctggccaacacggtgaaaccccttctccaccaaaaatacaaaaattagccaggcgtggtagcacacacctgtaatcccagctacttgggaggctgaggcaggagaaccacttgaacctgggagggggaggttgcagtgggccaagatcacagcactgcactccagctgggcaacagtgcaaaactccatctcaaaaaacaaaatgcttttagaaacaataagaacatacagcaaaatgactttcacaccattgatgagtggtaaagtggcacaagcccttgggggcaatttggactatctatcaaaactcattgagcctgtaatcttacttcccaaaatttctccttcagatatactgccccatggttcagagacacagatacaggtatgtatatgtatacatgttcattagagcattttttataacagcaaaaaggctggaaacaactggttttataaggggatgcctatatatgtatgagctagtatttgatatgagtacaaaacatttttcaaagaatagccaagaaagtggtatcagtgagtgtctctaaggaataaaacctagaaaggatgagaaggagcttgttttttaccatatgccttttgtgtggttggaactagccatgtgctcccaaaacgcatgccttaaaatgttttcgtagcgcaggtaagacttttctaacagacaaatttattttcataaaatcctagattaaaccagaagattaacttttagttcaagatagatggatctaggctgggagtggtgactcacgcctgtaaccccgggcactttgggaggcggaggcgggtggatcacctgaggtcaggagttcaagaccagcctggccaacatggcaaaaccctgtctctactaaaaatacaaaaattaaccaggcttagtggtgggcacctgtaatcccagctactcgggaggctgaggcacgagaatcgcttgaacccgggaggcagaggctgcagtgagccgagatcgtgtcactgcactccagcctgagcgacagagcaagactccatctcataaataaataaataaataaataaataaataaataaataaaatagatggatgtccttcgtgcaatacaggaaagcctctcattggcattaagaagacagaaacaacacctaaggattttttaagagtttttgttgtggttgttttagacttgatggctttgaaatggtgtaactatgtctactcatcaatcaactttactggtcagtgtttttcaagccctgtgcccagataacaattcacgtcactgagcaaggtgaattcaggttgggatgtaacccaggaccaacctcacttttttgagggcttacagtgacccagtcaaatagggcaacactgactcaaaaagtttgggacaggctaggccagcaggaaggagagtgagaaccttatctggggtctgttctgcttgctcctgctggctcctctggtcacagtgaccaccatcagtgacaacacggttccactccaaacctttctcatctcacttgttctcctcctcttatttctacttctaatatagagagagaagcttgggcaattctggtgagtggcaggaggaaaagcgacaagggcatgtggtgttagcaacagaaaattctacagctaatagcaataacattttaccctaaaatcacacgaaactaaactatattgatcagttcccaaaccctcgtccactaactaggctgctacacctaaatcgctagggagcatctttaaatgcaagaattctcgggttgtactctgcttcactggatctggggaaggacgtggaaatctatatttttaagacattccccaggtaactctgatgggcagccaggcttggcaaacatggacataaattattcagttacacccaaataattgtggcccatataacagtctaataaatttggatgtgaccccttgggggaaaaatatcccaggaaaaattgctatcataaaggaattaaattaatcctcaagggtgtgtaaattaatcccagtaaacacattatagtcactgcattaagtaaaaaattttgtctgcctactcaataatgaaataagcagagagaggacattttaaagcctgcaggagatattataattcaaacactaacctagagctgataaatattttatagacaattttatttcattctacttgagaatgaataagggcgtacgtttctatttggcaacatcagggtttttgaattgaattggaagcttatagtgttggtgaaactcgtgaatttctccctcaagatgagtattggcaacttcataactaaaagacaccaggtcattttttctcctcactgtaagccacttcacgtgacttggtcttttgactctgctctgaagtacagtgctgcgaactgtcttttgtagagtcctgtaaaatgtacttgttctctagaaacggacagatctatagatgtctggtcctggtcctccttaatttcctcctgctgagaaccttgcaaaacctcactacaaagtaagccaaagaaagttggaaaagtaagttcttttcattcgtcaacttacaggaccacaacaaaaagtctctgcaggcagtaggggagtttatggtaaacacccatgggcagtgaaagtttgtcatgggtttgttttctcatcctaaattgagtaagatgttttgtaaaggataaaatcatacaagccaagaaagccttcagggtttgacaaacatacggagagattcttttaatacaaatagggaatctggactgtgaaaattaggtgttctctgttctcaaaagtgggaggacaagtctgcccaacttcatgtgaaaatgtactagagaaacgggagttgaccagagaaactggttgtcagagtttaaactgagatttttcttctaagagaaatggtaactttttaaaaagattctttcacccatttgcagacccacttcatggcaggatgcttaccttggatgcttacatttggtgtcaagatgaagggggggcctttcctggatgtcactgggatgccacagcaggcctgtagaagtcacattgcaggaaagacgttgggcttcccaggaggaaaagggaaagggctggggatgaaagatcaagctcccagaccatgaggttgagacctctgaaagccgcccttttggaaacaatgtccccagaagacagaaaactaaggtagaggaaattcaaaagttgcatgctttatttcaagaccgaaagtgaagactgccacacagggatgtgtcacgcaaatgcccccagcccagcctcccaggaactgccaacctgcttctgagcagctgtgataatattcagtgcagactgtcaactgctggctgagggcattttgcttgaagagggtgtcctttttggggatgggaagagaacagtgtctaagcaaaacatttgaagagcagtgatgcagagcctctgcctcagagtacagccacagtggggcagtgatagggacagccaccagaagcctccagacccattcacaaccaaccaggaaggggttgggactgaggatgacaaccccccgcatcagcatgtgtgcacataagaggagaggacaccggcccccagtggaaactgcggagattagcatcctagtaccaacagcttttttatgataatcttggcttccaattgtccctcctttggagtgtgcgtgtgttgaggagaaaggggtagatatagtttgctaatgaatttcacatatttctgtatatgtgaaatgtgaaatcgaatataaagaatgcatgattctttgaaaattatttaagaattcatatatgagaattatgaaaattcagagccttcactcttcactaggcaagaaaaattacatcagctgggcatggtggctcgagactgtactctcagatactcaggaggctgaggcagaagaatcgcttgagcccaagaattcaagaccagcctgggcaacatagtgagaccctgtctctaaaaaaataataataacaaataaaaataaaattagccaggcatggtaggtagcgcacaactgtagtctcagctactcagaaggctgaggtgggaggtttgcgtgagtccaggagatcacagctgcagtgaagtataatcatgacgctgcactccaacctgggcaacagagcaagaccccatctcgaaagaaaaagagagtacctcaagctagtcaatgcaaactccttttgttgttgttgttgttgttgagacaggtctcactctgtcatccaggctggagtgcaatggctcgatcacagctcattgtagcctcaacttcctgggctcagcttcctgaagtagctggcactacgggcacctaccaccatgtctgatttactttttgtagtttttgtagagtttcaccacgctacccaggctggtctcaaactctagggctcaagaaatctgtccaccttggcctcccaaagtgctgggattacaggcgtgagccaccacacccagcttggcaatgcaaacttctacctccttttcatgtatacaggtttttcctgcagttactagaagcaaaatattgaccctgacctccaagagttttattttagatgagatgacaaaatgcccatgtaatgattaaaaatcagtataaagcagaatgtaaccagaacctaaatggggcaggtgtggattaaagccataacagtaatctagagaaagaaaacatctctggaagctaaagctactgctgcagtgaaagatttcatagaaatgggacttcagttgagctctgaaaataatttagttaaatgtatatgggaactatggctgggtacagtagtttatgcctgtaatcccaggaatgtgggaggcagaggctgaggtgggaggattgcttgagcctgggaggtcaaggctgcagtgagctgtgatcacaccactgcactccagcttgggtgacagagtgagaccctgtctcaaataaataaataaataaataaaatgaatatgagaatgagatggaagtttatccgagaagaagtaacagcaaaagttcagcagtcagaacaagagggactgtgtgcaggaccagatgtctgcctggtgctgtccaccttccatgcgatgggtaggagcgtgctgtccaccttccatgcgatgggtaggagcgtgccccatgttgcctgctcactatatgccagcgcctgtgccagacacactcacttattaccctgttacatcctcacagaagcctttccacaccagaagggaaggaagggctcagaagggttcagtaatttgtccaaggttgcatgttagtaagtggcagagctgggactctaactgaagtcacccaagtccagagcctatgctgttaactccaacacttttatatgaatccatggttgggtggccagttggcagcagtgagcagcataaagcttaaagataggtgtttttggccagaacaatgtgtagaaaagcagattgacttggctgggataggctggctgcccgatcagcttaattcctgtttcccaccctcccagtttcacatgctcatgctacctgtccaagaaatcctgcctaaggtgcccagctgacactgagggaggtgaggagaaatggaaaagaaagagcccattctttttttttgagacagagtctcattctgttgcccaggctggaatgcagtggcacgaccttggctcactgcaacctccgcctcccaggttcaagcaattatcctgcctcagtctcccaagtagctgcaattacaggtggccgccaccacacctggctaatttttataattttttagtagagatgggttttcactatgttggtcaggctggtctcaaactcctgacctcaggtaatccaccggcctcggcctcccaaagtgctgggattacaggcataagccaccataccctgccagagcccaatcttgagatccttctaaaaaaggaatttgaaagcaaagacaaagaaaggaaagagttaaagacttaagtctataaggtttttcacagtgaattctccagcatcagaaatcccttgggcaggttgggggtagggtggcacggagcactggttaaaaatgcagagccctgggcccagggcactcccaccgagtctaggggatggccaaggagcctaaatttgctagcaggctccactaaaatttgagagctattggattgtacttgttccagaacaaaatccctcatactcacctagttttcccttcttgcaaatataactcttaatcacatttactctaaatgagaaatagtgttcactgtcagcctgtcaaaatacttcacgtatgtcttaggaaaacctttaatcacaactttcttttctctgagtgctttttttctaatctttgagctttggagcaccgaattaaagtcagtcctaaatccttttctaatcaacacttacatcaaaaagacttcattgcaattcaatttgagccattttcgccattcatgttcagcctattattaccaaggagctggccaatggcactgagaatttttcacactgaccaaaaactggggttcactgagtgccaagacatgttttgggagccacaggcagtcactcggcttccttttcttgcctgtctcctgggaaaggtgggtaagaaaaatccccctgaagcctctgggcagtgaggagtactttgcccttgcccctgactttgggaagagctttccccattccaggccttttcctctgaagttcagaatgcctgaatgaccttcccctcctgccactcccccagaaactcctaatcatccttcaagttttggctcagaagtagtgaaaataataatcataaatcacatttccctattcaactctgtcttagcttactatataatttccctttgtagttctcatcaaagtctttcatgatctaattgtgtcattatttgatgagcacctatctatcccactgaaaactacatgagtgctgagaccatttgctttgctcagacttgtatttatgcctattaccatgtctggcacacagaaggtactcagtattattggatgaattcagaggtttatgtttactgagcacttaacaatacgtcaggtactgctatgtgctcctgacacatgatgtattttaattttcccaacaaccttctgaggtaggcactattattacccctgtgggataggtaaggatgtcaaggctcatcgaggtctcagggatttgtcagggtcacacagctaatgagtgtgggtgcttggattcaaatatgagtttgtctacctctagatctcagctctcacccatgatgttatacacctactgtttgacatagtcagcttccataactgttaccttcttggacaccctcttcctagaattaattgtttccttcactgtttttttctcataacatttcaaatattcttccattgccacactattacattgcatcaggatttaaatatgtgtctgggagctccatgagtgcatggaccatgttttattaagccagcgggccaattctaaccacacagtccatatgcaggtgcgattacagtacgggataagtgcttgattaacccagcatcagtccctcttgatccatcactatagagggagatgccattaacctaagtggacaaattgactaagggaacagatggacagctcagaggcagacccaccagatacagaaacctggcatgtaagaggtacactgggaaaaggatggagccagcacactcagtggtccgtgtaacaaaggaatgaaagtagaccccgtatcatacacgatacataaaaaataattctaaatgggctgggcgctgcggtttatgcctgtgaccccagcactctgggaggccgaggcgggcagatcacttgaggtcaggaattcgagacctacatggtgaaacccgtctctactaaaaatacaaaattagcagggtgtggtggctggcgcctgtaatcccagctactcggaaggctgaggcaggagaatcacttgaacccaggagaaggaggttgcagtgagtccagattgcaccattgcactccagcctaggctacaagagggaaactccatctcaaaaataataattctaaatggaccaaagacttccatgtgaaaaataaaactttcaaacgtataaaatgaggagtaatcacaatgataatcaaggaaattaaaatcaaggctatcataagatattcattttaaagccactgaattggcaaaaataaagaaatctgataatactcagtattggcaaaaatatggatcactaggaattcttaatccactgttgatggttatatatatattagcaaaccactttagaaaaaagtttggcaatatctaaagattatatttatactataaaatatatgtagcagaaaatgaattaacaggtacagctgctgtagaaaatagtatgattcttcaaaattttaaacatagaattaccatacaattccacgtctgggtatatacccaaaagaagtgaaagcagggataagaacgtatatttgtacacttatgtcacagcattattcacaatagccataaggtgggagcaaaccaagtgtccatcaatggatgaatggataaacgaaatgtgttgtgatgtttgtgtgtgtgtgtgtgtgtgtgtgtgtgtataatggaatattattcagccttaagttaaatggatggacctgaggacattatgctaagtaagataagtcagtcacaaaaggacaagtattttctatgaggtacctagaataggcaaattcatagagacagaaagtagaacagacgttgccaggggctgggggaagaggagaatggagaattttcttctgcagataactactctccttttgagtgacagctcttggcctgttactgggccttggtggaaactgaacattggctatgggtcatcaagtcaccatgtaaacctgaactgcctgtcatgaactgggtgctttctgacccatctagccataaagtgggtggtgcacagcagcattccatcaacaaatggaagtggtatatacgtaatcgggctcgagcaggtcctgaaggcacaagtaagttacataaggaagtggctcaaatgctcatggtctccactcctgccaccctgccttctctccctcagcgtgcaccaatggcctcatggggaattccctatgatcagttgacagaggaagagaagactagggcctggttcacagatggttctgcatgatatgcaagcaccacctgaaaggggacagctgcagcactacaacccctttctaggacatccctgaaggacagcggtgaagggaaatcttcccagtgggcagaattttgagcagtgcacctgactgtgcactttgcatggaaggagaaatgaccagatgtgtgatttatatactgattcatgggctgtagccaatggtttggctggatggtcatggacttggaagaaacatgattggaaagttggtgacaaagaaatttgcggaagaggtgtggatggacttatcaagtggtcaaaaactgtgaagatatttgtatcccatgtaagtgcccaccaacgggtgacctcagcagaggaggattttaataatcaagtgaattgatgactgttctgtgaacaccattcagccgctttccccagccacccctgtcatcgcccaatgggcccatgaacaaagtggccatggtggcagggatggaggttaagcatgggctcagcaacatggacttccacttaccaagactgatctggctacgcccactgctgactgcccaatttgccagcagcagagaccaacactgagccctcaatatggcaccattcctcggggtaatcagccagctacctggtggcaggttaattgtattggacctcttccatcatggaaagggcagaggtttgtcttcactggaatagacacttaccccagatgtgggtttgcctattctgcacgcaatgcttctgccaagactaccttccatggactcacagaatgccttatccaccatcatggtgttccacacagcattgcctctgaccaaggcactcactttatggctaaagaagtacagcaacgtgctcatgctcgtggaatttaccggtcttaccatgttccccgacatcctgaagcagctggaatgatagaacgatggaatggccttttgaagtcacaattacaatgccaactacatgacaatactttgcagggctggggcaaagttcttcagaaggtcgtgtatgccctgaatcaacgtccagtatactgtactgcttctcccatagccaggattcatggatccaggaatcaaggggtggaagtggaagtggcaccactcaccattacctcaagtgatccactagcaaaatttgtgcctcctgttcccacaacatgacattctgctggcctagaggtcttagttccagagggaggaacgctgccaccaggagatacaacaacgattccattaaactggaaagttacaagtgccacctggacactttgggatcctcctgtctttaagtcaacaggctaagggagttagtgttggctggggtgattgaccccgattatcaagatgaaatcagtctactactccacagcaaaggcaaggaagagtatgcatggaatacaggagatccattaggatgtctcttagtattaccacgccctgtgattaaggtcaatgggaaactacaacagcccaagccaggtagggctacaaatggcctagacccttcaggaatgaaggtttggttcactccaccaggaaaaaaaaaaaaaaacacgacctgccgagatgcttgctgaaggcaaagggaatacagaatgagtagtagaagaaggtagtcatcaataccagctatgaccacgtgatcagctgcaggaacaaggactgtaattgtcatgagtatttcctccttcttttgttaaaaacatgtttgtgcatgtatacacttatactaattttatttcactttatttcctattttctttaccatgtgacgtaagatttgttgacctcatatcagcatttaagtattgttaattttatgtaataatatttgggttgatgattggtgtgtttctggttgtatgaaggatagttgtattatgttaggcataactatgaccttattattgtctttatttgaagactatgtatgatctcaggagatgtgtgtgggttcaagttgacaaggggtggacttgtgatggttaatactgagtgtcaacttgattggattgaaaggatacaaagtattgatcctgggtgtgtctgtgagggtgttgccaaggagattaacattcgagtcagtgggctgggaaaggcagacccacccttaatctgggtgggcaccatctaatcagctgccagcacggctagaatataaagtaggcagaaaaatatgaaaagactagactagcctagcctcccggactacatctttctcccatgctggatgcttcctcccctcaaacattggacttcaagttcttcagttttcgtactcagactggctctccttgctcctcagcttgcagatggcctattgtgggaccttgtggtcatgtgagttaatacttaataactcatatatatatatgaaggggatttattacttcagacaggcaacaagagacaacagaaagaagcccaggattcatggtgagctggttccccagggctcaggaaagctgcccaggtggatggagtcttccacaagtgcttcacttgcacagcagctgaaggtcacccaaaaagtgacctacctgggttttataccccagggaacatgagttgctgggataaagcattgaaggacatcctgtttctaggggggagctggagagaattcaggctgttccagtcagtccctccctatcttgggatgttgcactcccagcacattctacagttattcttgagaactgcaagcaagaaagagggagagaactgggccagtccaaggccacccagagaactgtcccgcaggatggtgaaaggtctggaaactctgccagggaggaaggggtgctggtctggaaaagtgcatgtgggccttttggagagcctggttcagaagcatggctactggtattgcttggctgaagcactgctctatgggaagttcaccctctttgaataagtgagccacttcagaagcaccccaatctacagaactagcctggaaaaggaaaagggagagtatgggaaacataagacctaacttcaaatcttagaaagcctgttttatagaagtgagattcactgtgagaagttccagagatcaggcctcatggttagaagctacaggaagactttacaaactttgagcagggcaagcgcccaagagctaggctgcctgtgaggtcctggacatgttcaaccatctagattgtcaaagaatcaattgcaggactggaagcaggggaagctggaggagatgccagctaggtcctcgcctgctctgtgacaatgattcaaatgcatccaggtggtagacaccccacctgccaggaacagctgtcagtcttggaaccactcagtcaacacttattttgagttggattttctgattattctagaactcatttggatcttgccatgaaccaaatcagcccttttcacattagctgcagtccctggagtattaaaaatgctgccaagccttaggttttaccacttacggagtaagccttgagttctaataaaacgatgcttaaagcagatacatacatctttttttctatattctaaactgttcatagtttgccacctctcctataaatggatctaccatcttttcaagattttctcccataagcacttgagagcacttctgtaagcccccaggatactgaattgaaagatttatattaacacctgcaggcaaatctcttttgaacttgtccaaggcagaatcatgaggaagggaccacaaaataagtcagctaattacatgtcactttaaaaccactggatgtagactaaaggctgctgaaaggttttgatcaatactgactctgccttggacaccatgagtaatgtgatgcacgctgctcatgtcttttcctgggcacctcaatctggcaacttcttttctaagcagtaattaaatcagtgaaaattgtatatagtcatgtgagtggcaaaaatttttagcagcaatcatgaaaccaacccccgccccacgccccaccgctcaatacactttgaaaatctacaattggcaaatttgaaatgtcaggtccatgctaatttgttttgcaagctactccaaggaagccagatatcagcccgtccccggctgttagatgaaaggctccagaaagtcttgcatagctgacggcaggacgcagtgggctctctcctcccttccctggcaccatttgggtggcatcattgtgaaatgctctttctgccgctggtactggcatcctgttaaatctcaatttgacactcgggtgtgcgctgagtcacagcaggtgcaagacttaggtgactgctttgtgcccacatttgaataactcagctcatgagcaagttggctcaggtgtgcttcctcctctcattagccatggttttctcaacccaagagcagttgactacccagcgtgacctgaactggctgcttcatcaaatattgacagcatgtttgaagttctccttttattcttacaaggcagtttccttctgtgatactttccttcagaaagtactgtttcaagcagtgcccagacctggccctgaaaccatgtctgcagactgtcatggaagggaggcagaccttgtatttggccttagtagcacctcgccaccttgctcctcacccagactgccaagcacagagaagcacatacctcctctgtgaagagggaaaataaccagctgactcagattcacagagaacttagcaacaaataatgagagctttagcatctcatgcttgctaaatgggcaggaccaagtagatactataccactttttttgtttttacagacaggggtcttgctatgttgcccaggctggagtggagtggtgcagtcatagctcactgcagcctcgaattcctgggctcaagcaattcttctgcctcagcctctcaagtagctgggtccacagacatgtgccaccactttgtctgacttgtacctactttttaaggttaacaatgattatgaattgggaggtagctctcagactgacacagggactgaggctgctaattagagaatgccaaagcagtctgttagaaacaatcaaggcttactagacacccatgaggtttgcctttaacacaccaagctgctgtgtgacttcacaatggaatcaaggatgaatcaagggctcagcttcactctacacctggctggactggcccagaggtgctgctgagagaagacagagggacatagaagtgagaggtgggaagaactagaagcccaataaccatgatgattttgtgcagaagcatagagctggggaatgacccagaggatgtgagaccctgtctctaaaaataaaaataaaataaggagtgcagaggcacaatcatagctcactgcagccttgaactcctggcctcaagccattctcccgcctcagcctcataagtagctgggaccacaggtgcacaccaccgtgtccaactgattttttttttaattttttgagagatgaggtctcaaactcctgggctcaagtgatcctcccagcttggcctcccaaactgctgggattacaggcgtgagctacaacgctcagctaaaaaaaaatttttaaaacaaaaatcatcagtatatttctagagccacaagtgtaaggggccagatttttccaagacaaaaatgaaaatgaatggtgtcaggaggggggcaatagtagttgcttggcccggcatttagagccccagatcaccatgggaggggaggaaagtggggctggagacactgcgctaggcagctggcatggggctggcagagaaggccggattcctgccctgaaaagctgggggagtgactgcacagagcccctggtgcgacaggccaggcagctggctgccacagaagcttctgaacccctgcaactttgaggcacttggcactctccccaccccactttcatcgaactattatcaagaggaaggaaaaatgtatttcagaatcccaagaaaactccagaatgagccaaatcttctttgcttgtgtaaaaaagaaaaagcaaaagcaagctgagtgatcagaaaatgaaaaattataacctgacattaagtttgaaacttttgtgagtgacctgaagagaacaggttgggagatacgtgagggcctctagaaaggaggccaccaggggaaatcaagtaacctagggacacagatatgagcctggccatcacccccttcttacccgggagagagcagcaaaccatgacctgggcccatgagcctgggaagggggcctatgatcctccttatcctcgaaatagctgtgtctgtggggacaaggaccacagctttccctcactgtctcactgtctgctccctccctgcctcggctcctgtccacctgccctggagcaccccctccttaccacagcttatccagcttgcactcagctctgacaccttattgaagttacggtcctttcctcagagtgcaccaggctaaaatcactgatctgtcctctacggccacaatttaataataacaggtgacactctgcatttgaccttgtgccaggcactgttctaagtgcttttacatatctcagctcctttaatcctcataacaacactatgagggaagtatttgccttcactttatagatggggagcctgggatacagggaggtggagtgacttgcctgaggtcacacaactgggctaggatttgaaccctggaaggctggcatcagcgtctatagttttaatcactccactatcctgactctcaattccaacctgtcctatagtgttagatattaggatgtgacagttaatgtttaggccctgctattttttctttttttttttttttaagacagcgtctcactctgtcacccaggctggaatgcagtggcgtgatcttgggtcactgcaacttctgtctcccaggttcaaacgattttcctgcctcagcctcccaagtagctgggattataggcgcccgccatcacgttaatttttgtatttttagtaaagacggggtttcgccatcttggccacgctggtctcgaactcctgacctcatgtgatccacccatctgggcctcccaaagtgctgggattacaggtgtgagccaccacgccaggctgggtcctactattttagccagagaagcctcccacaagcatactcaaccctgcctaacttctgagcccatcagagctaaggcagttcatggttgggatcctggtaccctacccagctcttaccaggtcccttccccaggggcttggccataactctgtatctccagctcctggctgggatcctatcaaagcaaacctcttacctgggaccacagtgctgctcctgggctgactttgagccccatctctatgtggaatcctggttacttcacagcagtcacaggactggaccctcttaatggtaagttggcccaggatccccactttccctcacactggactgctctcaactcatcttctccccagcttcctcccactccccacgagcccctgcttccctacagaacccacctgaattatgacaagctcagatatcctatgaggtcagggctctcatccaagaggtcagcactctgcacagctagtggactggtcctggctctttaaaagcaagctggtaaataaaacacaatgagagtggacgcttcttactaaaggccacatgaaaggagcactatgaaatccctgccttcagaaagtcagtcaagggccagacgcggtgactcacgcctgtaatcccagcactttgggaggctgaggcaggcagatcacgaggtcaggaattcgagaccagcctggccaacatggtgaaaccccatctctactaaaaatacaattttgtaaaaatacaaaaattagttgggtgtggtggcgcgcatataatcccagctactcacgaggctgaggctggagaatcgtttgaacgtggaaggcggaggtttcaatgagcagagattgtgcaattgcatcccagcttggggcacagggcgagactccttctaaaaaataaataaataaataagtaaaagtcagtcaaggcctctgctatatcacctctccaatatctcatttgctatcagctaaccacactgtgcaagcggtgacagagttgacagcagtgttactgagggaaacagaaggggaatggtccactaggtgtggtttggagattgtgtggaggaaagcaatgaagacagagagtaactatatctagtactagcgtccctgggtgcaccccaatgtggcatttcttgaaagtttatcacaagggctaccggcaagcactgtaagattgagctgatacgtgaaattgatattttcttctttgcctcgggcattcattcccagggatacaatgtcaattcagagtttccaggtgaagctttgccagaaatattgccaatgctgccatcctgggcttttataagaacgcattcagcttatggccactagtgaacacagccttcagaagactgtcagattggttccagacagctaaggaacacatgcatatattaataagtggcattattttaagtaacctggacactaaaatagtattctccaaagcttactccaatgggtagtaaaaagtatgataaagaatgttgcaggtagcgactagctggggctggtggcacatgggtaaaggaatttaccaagacaattgtaagtgaaaaaaaaaggcagaattataggagaaagtatgaaaatacgttgcaagggtgcaatgggcagatcagcaacagaggagctgactgcaaggagacaaaagtttgctggggattttataagatggtgcttgtgctagagagggctatgtgctgtactgataacaccaagattgcagtgagctaacttgcatttttctatcagccgaggatctggtgataagtcagtgcaggaagattgtgagttattcgtgcaggagggctacgtgtcctggaccatgaagaaaggcagccttaaagcttatcttctttttctttttactttcccctgctcccaccagcctaactccccttcccttattaggactccacatagaataaaatgttcgtagtcaagtgaacttggaaaatacagaatcaaacaaagctaaatgggcttctttcctgcagaacttcccaggggaagtgtcattggagtctgtggcaagaggaggccatcagaagcagctttttcctcactttttggtcaccaatccctccttcacttccatccccatttttttcccctcagagagtcccatgaacttggttgcccaaaacagagcggctttaacgttaactaaaagcaaaatggtcagagcacctcacctctatgaaaagcacactataggaaccctactgcagtaggcagtgactgtcaatggcagctaaagctgttagatgaaaagtctcacagggaacttaatcataaatgaatcaggctgatgccaactgaacccacccatcagtcctaacatcacaaaaagagaggcagcgaggcaggatgcctcctgatgggatgcaatgggaagttcctagcacctcctatgaggttttcttgccaaaaaatcccacctgattatgcctctagagctcactactatctctaagaaatacagagggaagtgaaatatattcaccaatgtcatgggaatgcattcaacaaaatccaaaatcagggacatctaaggaacaaatggccaagtttcttcaacaaataaatgacaagaaagaaagaaaaaaaaaaaaaaggcagcctggccaacatggtgaaaccctttctctaccaaaaaatacaaaaattagctgggtgtggtggtgtgtgcctgtagtcccagctactcgggaggctgagacacaagaatcacttgaacccaggagacggaggttgcagtgagccaagatcgtgccattgcactccagcctaggtgacagtgagatcttgcctcaaaacaaacaaacaaaaaggacggtagggtaaataatcagatttagtctttttagatttataaggcctatcaaccaaatgcagtatttgaatcttgatttaaacaaatcaactatttttaaaaacacattaatgaaacaaccagggaaatgtcataactggctggatttttgattgtattaagaaattatagttaaacttttaggtgtgattatagtattgtggcaatgcaaaaagaaaagattttatttttagagatacatactgaagcattcatggatgaaaagatatgcctgggatttgcctcaaaataattcagtgtaaggaagggaaagaaaatggatggcagaatagaagaaacaagaatagccttgaattcataattgcttggagatggctgttctatctaattttgtattgaatttgaaattttccataagaagaagttttttaaaaaaaatacattgctaagcagcaaaatgtagagaaggacctaaagccttggacatggggtcttaattttctaataatccaaccttttgtagatgtaggatgtggaaatttcacctagagattataagaccaggatttttatatttgctttccatcttttctgtcaattttagaaaaggcaataccattagaaaacaacaataccattttcataaagcagaatagagagctcctttagagtcaaggaaaaataaaaattaaagataggcttttttcagtactcactatgtgtgacatattgtgttttgtatgtattaatttcctgttcaaaatcctctaataggctggggacagaggctcacgcctataatcccagcattttgggaggcccaggcaggaggatcatttgaggtcaggaatttgagaccagcctggccaacatggtgaaaccctgtctctactaaaaataaaaaattaaattagccagttgtggtggtacacatctgtagtcccagatactcaagagactgaggcaggagaatcgcttgaacccagaaggtgcagtttgcagtaagctgagatcacgccactgcactccagcctgggtggcagagcaagactgcatctcaataaaaataaataaataaaatcaaaaccctctaatagcttcctgcccttctcagagtgaaatacaaattcttcaccatagcctgtgatgttcaatatgacttggtacataatacagcttttccttcctcctacattggcctctttccattcctcaaacatggttagtactcttctgcctcaggatctttgtacttgctattcacactgcttgaaatactctttcccaaccaccaatgactgtgtggctttctccctctttcaggtcagactttccctgcccacctccttatgtaacacaggtagatgatcccatctacataccatcactctcctccccttcattcttttgctcctgttttatttttcttcttagcacttagtatccactgaaaaaaaaatctgttgtctgtctctcccaagtggattgcaagctccattagatctggggctttgttttattcatggaacaatgttctcagatcaatgccttaaatatagcagctgctcatgagatatttattgaattaattaattaacttagcacatacaaaaacctatttggtaaacatgcccatgtatctttggaggctggaattatgtgtttctatggtggccaagatcctctagattagctgtgtctagttaaactgcgctaagatgtctgcagagcagctgaatgccttgcagtggaagaagaccacactcctggcctataccaacctaagggagggacaactggcctagggccctggctgaggctgggatgactgttcttttcttgggaaaagtgagattcatgaaggtctaaataaagggtggcagtacctgtagaaaataaattgggaaggaatggcatagctggatggagtgtttgggggctgcaagaatgctgtggagtcagactctacagatggtttgaggtttccaaattaattcattttcagggagagttagaagagacacagatggatagaaattctgagtggcaaacatcccactgagcaatccactgtaggagaaatgggccctgaaaactgtctaatgcattttgaagaatttcactctgttgaactcaaatgaaatatacagacaaatctctgaaattaaaatgttttatctgggaaggaagaattgcaatttgggccatacacacagaccaggtggtcttcactgtgtctgaagaacaaagagaaggtcagaagttttctttaaacggagaaatattacatattgctctttgagaaagttcattggcactagtaaggttttaggaagctggcaagttttgcttggtaagtgatggcaatgggtaaaataattcttcaagtcacaggaggtagtttcggtagctagtagataaaactggctttaggctacagcaggcagtttcagcagcagggcttgcagagaattacattcttggagcaatgttatgtgccctgagagccttctcccagtggcctctcaactgttttagttgggtagaacaaagatgacccaatttattgatcaactttcacaactcctacctgagatgaccttttgaattactcttcaggttactatttgaaggaatcttgagttttctccaaaggaattcagatagctaagacactcctttggaactcaagtcagataactgaccatactcaaaagcatgttgaacacgcttgcctcgtaaaaagaaaggctattgatgatgggggtgaggtgccagcatagatctgggaactgcaatactctgaggtgctagactttgtgtgttatgcttcagcctgaaaactgcaacaaaactgtgtttccatctgtaataggagaaagtagtgagtttatttgcttcagagacagcatagttgaaacaataaaaccatgagaagggccttgtgttttacctatcaattgcttactttctaaaatgttgtacaacaaataacttgttagtgaattgaatgtttaaatcaattaggtatcctgctgtttaaaagcttcctatgggaaatactttggtaaacaatcactaatttatactttcaaaaatgaaacacattactatactttcagttttcacataacaaagcaactctttatttatttatttattttagatggagtctcgctccgtcacccaggctggagtgctgtgttgtaatcttggctcattgcaacctccacctcccaagttcaagcgattcttctgcctcagacttccgagtagctgggattacaggcatccgccaccacgcctggctaattatttgtatcttttgtagagacggggtttcaccatgttgcccacactggtctcgaactcctgacctcaggtgatccacccacctcagcctcccaaagtgctgggattacagacgtgagccactgcacccggcctatataagccagtttctgatctgtaaaccatcttgctgaatgtgtgtcagttatgccaaataatcgtctcttggctgggaaaagatttttcggcaggtcctcaaagacaaggacagatggcattctattgggggtactctttgttttaacaaatattgacacttttgtaggaaactgatccagatcctgtttcttcctaactcatcttggcaatcttgaaggtttgaagaggtgtagttcaatagaattgtgaaaatgcacttaccattgaattataaaaagacatacatcttgaagaataatgttcttggttaattgctgcttgtaaaagtcacaaagtaataaataatactgggacactgtgatcacaaagcactttcaagcggaaatgagacaggaaagaaagggagagaggagaggacagaagaaaaatgcttcctaaaaattcaaattgctatatgaaactttttaaaattttatttttattgtttttgcgacaagatcggctctgtcacccaggcgggagtgcagtggtgcaatctcagctcactgcaacctctgcctccagggcttaagtgatcctgccacctcagccttctgagtagctggaactacaggtgcgcaccaccacacccagctaatttttgtattttttgtagagatggggttttgccatatttgcccagactggtcttgaactcctggactcaaatgatctgcccacctcaacctcccaaagtgctgggattacaagcgtgcgccactacccccagcctgaaactttttttaaaaaaacccttttcaacctagatgttagtaatagcaaggttacggtagtgtgcctagaaaatcagggaatatttactgtaattcaaaattcgcatgtactgtttttcttgtttgtttgtttttgagatggagtcttgccttgtcgcctaggctggagtgcagtgatgcaatctcggctcactgcaatgtccgcttcctgggttcaagtgattctcctgactcagcctcctgagtagctgggattacaggcgtgtgccaccaccccagctaatgtttgtagttttagtagagatggggtttcaccatgttggtcaggctggtctcgaactcctgacctcaagtgatccgcctgcctcaacctcctagagtgctgagattacaggcacgacccaccatgcctgacccaataacttctgttataaaagccttaggtttgtgttttgctgcagccttgttgggggtgggaggagaaggataaaatgaagatggcacagatcaaccttgaaggtgagacagggacagaagaaaggattcaagtggttttctcagacaagaacccactgtcagtgccaaaccatctcctgtgttcatgctccatcatgctggacaagtgctggcccagagtggcagtatctcaatgccctgcttcagcagtactccctcctgtacctttgctccaaggctaccttgaactcagcggcacccagagtcccccagtttttactcagggaaagagttcatttttttcccagctttattgaggtgtaattgacaaattaaaattctatatattgaaggtatacaatatgatgtcttgatatatgatatacattgtgagatgattaccacatcaaatgaataaacacatccatcacctaactaacgcaattagttaccatttacgtgtgtgagtgtagtgaagacacttcaaatctattctcaatgcaaatttcaagtaaacaatacagtattattaactattatcatcatgctgtacattagattctcagaacttactcatcctataacaacgtttgtaccctttaaccaacctcctagcccctggaaaccaccaatccattctctgcttctatgagtttgacttttttttttttaacgattcaacacatttagctgggtgtggtggtttatgcctgtagtcctagctactcaggaagctgaggcaggaggatcgttttgggcccaggcatttgaggctgcagtaagctatgactgcaccactgtactccagcctgggcaacagagtaagaccctgtcactcaaaaaaatttttttaattaaaaaaattttaaagattctacacataagtgaaatcatacagtatctgtctttctgtgtttggcttatttcatttggcataatgtcctccagattcatccatgttgtgccaaataacgggagttccttcttctttatggctgaagaatattccaagactggacatggtggctcatgcctgtaatcctagcactttgggaagctgaggcaggaggatcgcttgagcccaggattggagaccagcctgggcaatatggcaaaactttgtctctaccaaaaatacaaaaattagccaggcatagtggtgtgcacctatagtcccagctacttgggaggctgaggtgggcccaggaggcagaggttactgtgaacaatggagattgctccattgcactccagcctgggcgacagagccagaacctgtctcgaaagaaaaaatatatgtatgtatagatacacacacacacacacacacacacacacacacacatacatatattccatagaaatagttcttatgtaggctgggcacagtggctcacgcctgtaatcccagcactttgggaggccgaggtgggcgaaccacgaggtcagaagtttgagaccagcctagctaacatggtgaaaccccatctctaccaaaaatacaaaaaaattagccgggcatggtggcacgcgcctataatcccagctactcgggaggctgaggctggagaatcgcttgaacctgggaggcagaggttgcagtgagctgagatagcaccactgcactccagcctgggtgacagaacaagactccgtctcaaaaaaaaaaaaaaaaaaaaaaaaaggaaatagttcttatgtaataacaagaacaaaataaaaagggaaggaaaataaaaaacatatctgtattagtttccctggaatgccataacaaatgaccacaaacttggttgcttaagataacagaaatgggccgtgtgtggtggcccacgcctgtaatccaagcactgtgggacgccaaggcgggtggatcacctgaggtcaggagttccaggccagcctggccaacatggtgaaatcctgtctctattaaaaatacaaaaattagctgggcatggtggcatgcacctgtaatcccagctacttggaaggctgagacaggagaattgcttgaaccagagaagtagaggttgcagtgggctgagatagtgccactgcactccagcctgggcaacagagcaagactctgtctcagaaaaaaaaaaaaaaaaagacaacataaatgtattctctcatagttccagggcccagaagtctgaaattaaggtgccagcagggctgaagtctctaaggaaggatccttgcttgcctcttacagtgtctggtggctcctggcattccttggcttgggacagcatcactccaatctctgcctctgtcttcatatcacctgcttctttgtgtctttgtgtgagtttttctgtctcttataaggcactctcattagatttgtgacccatactaatccagtatgattttatctccatccttaccttagggttatgtctgcaaagactctatttccaaataaggtcatattttgaggttgaggtgaatgtgaatttgaggatgggaggtatattcaacccactacaatagcatagacacatttgttcagcaaactaaaattataactagcatttatctttttagaaagcagatagaaggcaggcagaggttgagggggctcagaagtgggcctagatggctggggagtctcaccttctgttctgttcctgccttctgacaatcagaaggctgctgcctggttaagatcagatagagattccacagagctgatcataaaactaggaattagataaagccagcaaggacaaagaaacagttgaaaaggaattgtttaatgatgtgaattactaaagagagtattatagctgctaccaaaaatataaatgcgcttaagggagatgattaaacaattgagagaattcaggtgctaaattaatggtcaattcaaatataaaaacccatcaactttattaaatactgatcagggtcactggcctcaaaacttaggtttttttctagcaaaggagcaataattaggccctctgccaactgtgcttctgttaattttcagttatgggtgcttggttttctaccttgtaaataatcagcgactttgcccacagtccaacttacttacgtgcagctttcctactatcaagtagtgtgcaattagggaaagaagatcaatatgagtgtcacacgttcacaacgtcatccggcagatacatgtactgacaaaaagagtaagatgcatcccaaagccagagagaggcctttcaaattcttcctccatctggagatttaatcaagagtagagcaaaatatcttctgctttcttttccaaatctatgtggtggtgcttttagggctgaaagccacagagttaagcaagaacaccagagtttggtcattatctagcgtaattcctcacttgttgccagggctttcagagacactcaaggtgcaaagggaacttagaaatctgtccagttcaagtcctcactgtgaaggtgagcggctctgaggtccagagatgtagtaggtgttccttctaaaatgacttgcttgtgccaaactatgagacctaaaccccaagctctttccacaatataccccactttgaccattctcaccaggcagcatttcctaaacacctagactgtcagggcaaagtgctgctctaccatgaacaagtcattgaggtttgtgttagtgtattaattcactatgagtggctaaaagaatatgtttagtcaaaaaaaaaaaaagcaagatacccagtaggtgttgaataagtggttttcaaatgaatggaatacagaataaaacccaaggacagtaacttatcacatgtggcaaagatagccatctatgctctcttcttggtcttgggcagagttagggcttccttgcagcctccctttgttactagcagtgaatccatatgggtctgcagcaacctcaattcttgcctcctcagaagaaagaatgcaaacaagggggaataagacagagtgagagactgaggcaagttttagagaaggaatgaaagtttattaaaaagttttgggaaaggaatgcaaggacataaagtatacttggaagagggccaagcagacaacttgagagatcaagtgcatggtttgacctttgacttcaagttttctgtgttggcatacttctgaggtcttgctggtacttctcccctgattattcccttgaggtgggctgtcagcatgtgcagttctgccagcacttgggaggggctgcgggagcagtgtgtttactgaagttgtatgcatgctcacttgaggccttcctagaggaagatcatatagcagttaaatgctgccattttgcctcttagggcacatgcgtgagcccactcactcaactcctgagatcgtattgggaagctgctgatcaccggtttcaggttttcctatctgttgggagacggcctttccctggtgtcggctgtgaccaattattattttagagagacagttaaccatcacctgacattcctggtggggaaagggaagccctctcctgccctgttcatgtctgactagctacctactgtaacacctcgccacttaggtgtggccctgtggcctggttctggccaatgaagtatgaagtggaagtcatgaacaccacttcccagcctggcccatacaaacctcccgtgcttgattttcactcgctccatccactggctgaatggacaggactctgaggatccagaggagcccagagccacaataaaaaaagaggctctgtcctcaaacgactttaaaggacacggtctccctttatcttacaccctttttctgaagtataaaataagcaagaggccaggtgcagtggctcacgtgagcttgtaaacccagcacttttgggaggccaaggctggaggatcacttgagcccaggagttcaagaccagccagggcaacacagcaagaccttgtctctattgaaaaatacaaaaattagctgggtgcggtggtgtgtgcctatagtcccagctactcgggaggctaaggttggggggcatggcttgagcctgcaaggcagaggttagaatgagccaagatcgtgccactgctttccagcctgggtgacaaagccagaccctgttgggttaaagcactgagatttggggattgttatagtggctatcccatcctgattagtgcactacgcttgtgtgggttgttaaacagaaccagatccagcactttggatctgatggacaggacaaaagttgccaatggtagttcccctttgcttccaaatgatgtatgctgtaacccccactgatcagcctgactccgaggtcccctagaccccttttctttattccttttccatcctctgcacacacacacacacacacacaaacacacacacacacacacagagtgcaatcgcaaaccctggaaccttaacctgagtgtaagaattccagttcacaccaaagagactaggtgggagtcagcaagcctacttagcttgtgatttccctgggacaagcctggtcctaaatatgtttctcatatgaggagtcccagactcctcaatcagtggcatgcatttcaccctctacacatcctgcttccctaataagaccacaagctcttgccttgacagtctttgtatcccagggactgtcaccaatggatgcttaaaatatgtctttgaaagtaaacaaggctggcatgaatcaataggaatcaaaagcatgcaggaatcaccaaagagccaagcaacaagataaagtgctttaaatacagttagttgtttttgtgtaaaagatcaagaaaggcatcgtatgaaggggcaaaatccaatacttcatttcttctgacactttgcagagaagagattttggcagattttacactttccaaagctgtggaaagaatgcttggttgaagaagggcattccctcttgcaaaaggaggaggctgagtcatgaacaaacaagcaaaacagtgcagaggagtggcggacggcagcagaaagttgacagattgtgaatttcaattctgactctgccgtttattgagggcatttccttaggcagagggtggcgtgtccctgagcctcagtgtcctcatctagactatatgaaatggagataattttaggaactctggccagagctcctaaaacccttgtaacttcctaagtgataagagtgataaaagcggccaggcgcggtggttcatgcctgtaatcccagcactttgggaggctgaggtgggtggatcatgaggtcaggagtttgagaccagcctggtcaatatggtgaaaccctgtctctactaaaaatacaaaaattagccaggcatggtggcaggcgcctgtagtctcagctactcaggaggctgacgcagaagaatcgcttgaacccaggaggcagaggttgcagtgagctgagatcgtgccagtgcactccagcctgggcgacagagcaaaactctgtcttaaaataaataaataaataaataaataaataaataaataaataaataaaagcatcttttgttatgatatttggtttttatccctggctaccctacttcacaaaggtgctgtaaggaataaatgcacaaaaaggggccagcgcagagcagggttcagtacgtcgtagctactattgtgaatactatgtgcaagcacttagtgatcatcgtcatcataatgtccaaagcaactttaaagtcaaactttcggaagattataaactaaccagaaaaaagcataaactcatcctctgcattaagtatcagttgattcttcatcaccaagatcggtattacacagcaaatcagttcattcataaagctattctcttgcgaaagcctttggcaaaatgtcccaagaattttaattctagtgactacgcctgttttaaaattagctatacttaattctccctcctagatgatacaatgtatatcttaatttatgtcttggactttaacaggctattttgcttaatcatggaatttctaccacaaatttaaatttcctgtggctaatattaacagacactttctaaaagaaggatgtcaaggttttgacctgttttctttcttgctgatttggatagatgctgtgatcttgtgatataatgagaaatatatctttggctgggtgccatggctcaagcccataatccctgcactttgggaggctgaggtgggtggatcacttgagtctacgagttcaagaccaatcttggcaacacagagagaccccatctctacaaaaactacaaaaattagcctcatgtggtcccagctactcaggagactgaggtgggaggatctctttgggagggtctcttcagcctgggaagcagggggtgcagtgagtcaagactgcaccactgcactccagcctgagtgacagagagagactctgtctcagaaaaaaaaaaaaaaaaaaaaaaaaaaaagaaagaaaagaaaagaaaaaaaaaaaaaaaactccaaacccaccatatatacataggtctttggtctttgtctctggctcccggccagagcgcctaaaacccttaaaacttacaatgtgataagagtgggagaggaaaggggctagagattgagttcagtccccaaagactaatgaattaatcagtcatgcctgcaagactggtgtgtggtggctcatgcctctaatcccagcacttctggaggccaagacaagcaaatcacttgaggccaggagttcgagaccagccttgccaatgtggcggaaccctatctctactaaaaatacaaaaaaaaaaaaaaaaaaaaattagcctggcatggtggtacatgcctgtagttccagctactaggggaggctgaggcacgagagaatcacttgaacccaggaggtggaggttatagtgagccaagattgcgccactgcactccagcctgggcaatagagcaagactctgtttaaaaaaaaaaaaaaatcatgcctacacaatgaagacttcataaaaaataaataaacagataaataaaaggacagggtttggagaccatctgggttgacgcactcatagagatgctgggagggtggtgcacctggagaagttatggaagctccgtgccccttccccataccttgccctatgtgtctcttccatttattgtatcttttataacaaacctgtaaacatgagtaaatgtttccaagtgttgtgagccattctagcaaattattgaacctgagaagggggttgtgggaacccccagtgtatagcccatcagtcagaagttcagaaggcacagatgagattggcatctgaagtgaggtctcatgctaaccccaggcagatagtgtcagaattgaattgagttggaggacaccatgttgatgaccccagataactggaatcaaagaattgcttggtatcgaaaacccacacattggttgtcagaagtgttgtgtgagagtatagaaaggaggaaaaaagatttttctatttagaggtctacaagaaattgccatgttttgttcatctcataccaggtaggggtggccatgttttagtggttactatctttcatggcaagttataatttcacgtttaaagggttaagccctttaaatatatctagggactagaatgtactactgtaaagttacttcctagttataaattattcattgactatatcattaactgtatggcacaactgcagttacattttcagcttttccttctacttgactgatgtctacctctttttcttttttaaatagaaacaggatctcactatgttgcccaggctggtcttgaactcctggactcaagactggaggtccacctcttttttttttttgcagacagagtctcgctctgtcacccaggctggagtgcagtggtgcaatcttggcttactgcaacctctacctcccgggttcaagcaattctcctgcctcagcctccagagtagctgggactacaggcacatgccaccacacccagctaattttttgtattttagtagaaacagggtttcaccgtgttgcccaggctagtctcgaactcctgagctcaggcaatccacccgcctcagcctcccaaagtgctaggattacaggcgtgagccactgtgcccggcgaggtccacctcttacacaaggtatacaagttatctatgactatgtagcaaattactcaaaaatgtagtgacttcaaacaacatttattatcttaagtttatttctgggtcaggaatccatgtgcagtgtagtcctcttgctcagggcctttcacaaagctgcaatcaaagagttggcatgggctagaagccaacttagtcacttcaagcctcaactggagaaggatcagcttctaagcctactcaagtggctgctggcaggcctcagcttctctctcactggatattggccttgccacatgagcctctacataggactccttaaaacatggtaacttccctgctgggcatggtggctcatgcctgcaatcccaggactttgggaggccaaggtgggtggatcacctgaggtcaagagttcgagaccagcttggccagggagagcttggcctctgcctctgcctctgcctctccctctccctctccctctccccacagtctccctctccctctctttccacggtctccctctgatgctgagcagaagctggactgtactgctgccatctcggctcactgcaacctccctgcctgattctcccgcctcagcctgtcgagtgcctgcgattgcaggcgcgcactgccacacctgactggttttcgtatttttttggtggagacggggtttcactgtgttggccgggctggtctccagctcctaaacgcgagtgatccaccagcctcggcctcccgaggtgccaggattgcagacggagtctcgttcactcagtgctcaacggtgcccaggctggagtgcagtggcgtgacctcggctcgctacaacctccacctcccagccgtctgccttggcctcccaaagtgccaagattgcagcctctgcccagccgccaccccttctgggaagtgaggagcgtctctgcctggccacccatcatctgggatgtgaggagcccctctgcctggctgcccagtctggaaagtgaggagcgcctcttcccggccgccatcccgtctaggaagtgaggagtgtctgcccggccgcccattgtctgaggtgtggggagcgcctctgccccgccgccccgccccgtctgggaggtgaggagcgtctctgcccggccgccccgtctgggaagtgaggagcccctccgcccggcagccgccccgtctgagaagtgaggagcccctccacccggcagccgccccgtccgggagggaggtgggggggtcagcccccgcccggccagccgccccctccgggagggagctggggggtcagcccccgcccggccagccgccccctccgggagggagctggggggtcagcccccgcccggccagccgccccctccgggagggagctggggggtcagcccccgcccggccagccgccccgtccgggagggaggtgaggggcgcctccgccccgccagccgccccgtccgggacgaggggggggtgcctctgcccggccgccccttctgagaagtgagcagcccctctgcccggccaccaccccgtctgggaggtgtacccaacagctcattgagaacgggccatgatgacaatggcggttttgcggaatagaaaagggggaaaggtggggaaaagattgagaaatcggatggttgctgtgtctgtgttgaaagaagtagacgtgggagacttttcattttgttctgtactaagaaaaattcttctgccttgggatcctgttgatctgtgaccttacccccaaccctgtgctctctgaaacatgtgctgtgtcaactcagggttaaatggattaagggcggtgcaagatgtgctttgttaaacagatgcttgaaggcagcatgctcgttaagagtcatcaccactccctaatctcaagtacccagggacacaaacactgcggaaggccgcagcgtcctctgcctaggaaaaccagagacctttgttcacttgtttatctgctgaccttccctccactattgtcttatgaccctgccaaatccccctctgcgagaaacacccaagaatgatcaatttaaaaaaataataataaaattaaaaaaaatacaaaacagctgggctgggcgtgttggtgggcgcctgtaatcccatctactcaggaggctgaggcaggagaattgcttgaacctgggaggcagaggctgcagtgagccaagatcgcgccattgcactccagcctgggcaacaagagcaaaacctcatctcaaaaaaaaaaaagaaaaaacaaaaaaaaaacaacaaccatggtagcttccttcccccagagtgagggctccaagagggagaaagtgggagagagggtaagcaagataaaagccactccatctttttgtaatctaaactcagaaatgaaagcccaccatttttgccatattttgtttattagaagcacatcaccaggtctagcccacactagggaatatagggaagggaataatcactggacattatcttgggagttgcctaccctaccaggatgccatttaaggtggtgcttctcaaactaaccctttgaagaatcaactttaaaaaaattttttcaatttgttgcaagtcagcacttttgtcaaataaaatagaaattcatttctagaaaaatgaaattacaaaggcatttaaaaaacccaaaacctcagctcatctgttgatgttgtaatgatgtcaaattgctataaaaatttctttaggccaggcatggtggctcacacctgtaattgcagcagttagggaggctgaggcaggaggatcgcttgagcccaggagttcaagacaggcctgggcaacacagcaagactccatctctacaaaaaaaaatttttttttctttaaattctcaattctattacttatctcatttggatcagaagcaaatagtttacacatgagcatcagtttcaggtcaacctttgagtagcactgatttcaggattttatgaatgcagatgacttttcaaggcttttacaagacaatggtttggacttttcacttggctattcctagatggaggattctagaaataaacctaaagagaagtttttccttctaatttcattccattctccccatgctcctaaaagtgggactttttattgtgagtaaagtcaagggtatgtaggattgtctcctggttaacactttcctgcaaggtcttttaggtacccttgttcttcccaccagtcaagagccagagttaagccatgcttttgaagtgtatagtctgaaagatatttaacactatgattaccaattcacattgtaaaatggtgaggggttagcccacttcccaacaaatgttagaagtttgtatgtgcttcctgttcccagtctattcagatttctcaaaatacatctcaagtgtaacctcctcaattcaactaatattttttttgagcatcaactgtgtgtaagattctggagggcaccgccttgaagaaggcaccgcctctactctcaatagttttagagctccctatataaaccttgaagtaatttacatctaagtattttggcaattgagtacattatttctcttgtttcttagtgtctcacaaatttttatctcatctccctagtaaaaccataagcttacggaaggaaagaactccgtttcatatccttcatgcctccagcacagcctcaggcagttagtaggttctcagtaaaaagctgaaggcagcatttactaagctgagactctaaatccgctgttcaaagactaaatgctgtgaacggggtcttgataacctggcaatcacctttcttcatcctctttgccaccccaacccatcttccaaggcttaacacagaggaagcaactttcctctgctcccctgtttctgctcccctggtccccattcttttctcttcttactacactagcccaggagagagatgagaaagccaggtggagggaggggccttttaaaacaagtcttgctcaactttttacacaactgcccattctcagttgggcatcccctcctgtccccttttcttccaaggaagggagctaaggttagtaaaacctacccttgcaaggcccagtgctgggtactgtgcatggacaaaggtgaaccaaacaggttccttgtcctcaagaatttacaatgggcaaatcagaccgattctcatctacaacacagagttgaatgggccaactgttacaatgttggcaaacggagaaatcacggtgcaacagatgggggagagattaatgccaactggtgaaaattcagaggatgtagctttggagctaagccttgagggtgagtaacacaaacaatgggtagcagggagcacttcctacccatgcagtgctgtggtcggtggtttacatgcattatctcatttggggctcacaaaaggtctgctggggaggtgctattattagtctcattttacagtgagaaaactgaggcacagagaaaaggagagatttgtccaaggtcgcccctcaagtggaggggggacttgaactcactcagggtaactgtagagctggtgctgtcaaccctcaaggaaacaacggataaggagcaaaggataccgagaggaggtctagcactatgcagagcacgcccagagaagagagaggggtctgtgaggctgggactggggtgtgcggagtggtgggatgactgatcccaatggcaacggtggaatttatatgtgaaactccgaactttacacgaaatatttcatctgacctcaacacatccctgtttgacaggctctatgatccccattttacagatagcggaactgagacagagaggttactcttgcccactctgcccgccaagtgtcctcacgttggggtggaagcccgttgcaagctgccaggcccctcgtagctgcccagtcactctccgcccagtctacacatcctgtcccttcccacccagctacccaccacctagccctccaccccaactcccgcccttggctttcagcaaggatggcccagctcacggccacagggtggcaaggggccacttggtgcccagaacaacttctgctcccagaaagccttgcgttccccggacataaagaggctttgagctcggggagccccgccccgtgcggcccctcccacgggcgcgggccccgggcggcagggggcgtgttcctgtcggctgcgcccgcggccgggggcggagcttggccaccgcgccgggctgcgggcggctgggcgaacgggctcggcgctcaggtggctccttcttcgcttctcccgatccccggcggtgccaggcacggtgccggctgccgagggaacgcctttgtgcccggtgctgggaacccgcgacggccgccacgcgccccggtccattgtttcgcttatctgggttccaggcaggtgcgggcggcgcgcggggtccgcacgtgtcaccccggcggctggggcgccgggacccgcgggcgccggcaggggcgttcccgggcgcgcggcggcgatgaagcacctgaagcggtggtggtcggccggcggcggcctcctgcacctcaccctcctgctgagcttggcggggctccgcgtagacctagatctttacctgctgctgccgccgcccaccctgctgcaggacgagctgctgttcctgggcggcccggccagctccgcctacgcgctcagccccttctcggcctcgggagggtgggggcgcgcgggccacttgcaccccaagggccgggagctggaccctgccgcgccgcccgagggccagctgctccgggaggtgcgcgcgctcggggtccccttcgtccctcgcaccagcgtggatgcatggctggtgcacagcgtggctgccgggagcgcggacgaggcccacgggctgctcggcgccgccgccgcctcgtccaccggaggagccggcgccagcgtggacggcggcagccaggctgtgcaggggggcggcggggacccccgagcggctcggagtggccccttggacgccggggaagaggagaaggcacccgcggaaccgacggctcaggtgccggacgctggcggatgtgcgagcgaggtaggtgcagagcgggaagcgagcgaagtgcggcgtctacgccgccgggagcccccgaggcttgtgtcggatctgagcaggggccactctcgctgtgtcctggcacccttagcccctggtctttgcaggttcgcagatgctgctgctctgattccgaatgaagggctactagtgctgtcgctgtggtttttaggtgtttaaggaagaagtggacgaaatcatccgtttggttatagagaatacctttccttgtgtgtgatggctggcaagagtagttcggggatggggaggggagaagcaatgcccactgtcttcgctcagtacctcatgtacactggggtgtcgttctctgggacccgtgcccgacctggacgatgtgaaggaggccgtgacctctgggaggatgcatgtttttaagaacgactctcccggcctaacgcaaggaccttcgccctgttttcagcccaattgctgttcgtttttgctgcttccctggattaaggagccatggtcagggtctattcagaggccagccggcaggcggtccccctgtgacctaaccatcccctgcacctagcaatcctccttcctggaatttgtgtaacctcttattagcataacgaaaacaggtaccttggcagtcacttagtgactaacaagttccctttggtttatgggtccaaacccttctctggcttaacttctttctgaaaccaagtttaccaagatctgttgcttgaaacatctggtgctccccatggaacgtttgagttcagtctaatgacactttaacaccagtttccacaaaaccactttacccaaagttccttccaggggacttttaaaattctgtcttggctcaaactttagtgtttgcaactggtaacgatcaaccagtggtgatcaactaatgttcttcgggtgttgtttttgtggggcgcattcttatgcaaaatgggaattggggctaaactggtttgtttgttgctcttcagaattgccgtttgtgtaggctgttgccagacaagcttctccaccctcctggaggggtcattgtgtggaagtgctcggtgattcactgttatgctgatctgagcccttcctcttcctggggaccggaaccaatggggtgggggccagtgagagtcttggagggatccttctgtgttcaggatatactgtgggaggttcttccccactcactcatccaatctggaccccatggggtctgtctcacctaaatgctctgccctctaataagtgagtacttgtgcactaccaccattcctggttctgtaacacagagttgaaacctagtgctggatgctgtaccagatggcactctgccacccacacccgaatgccaacctgtgtgcaaagtgcacagggacctggagggagaagagaggaagctgttcagtcctcggaaacttccctcccggcatcacctgggagacaaagtggccttcccttggctgtttttttgtttgttttgttttaaagacagggtcttgctctgttgcccaggctggagtgcaaaggtgcaatgacgactcactgcagcctcaacctccccggctccagcaatccttccacttcagtctcccaggtagctaggagaactggcgtgcaccaccatactggctgattttttgtagagacaggtctcgctatgttgcctaggctggtctcgaactccttggctcaagtacccatcccatctcagcctcccaaagtgctgggtttacaggcatgagccaccatgggtggcctagactggcaggcctgccttggaggcattttttgagcctaggccagccaaaccactgtggaggctctgaatccagctttcctaggggagagagtgaagttccccgagaaccattctcctggcagtgccttcctggctgggctggcatgtgtgcaccatgttcactgctgggatgacctggttacattcaatctggcaaaaatcagctgtccagctccttacagttgtcacggccagttcacttttgttgccttttacatcaaccttgtgtggtgcactggccaggcacccttatatacaatttgtacttaagaaaaatagggctgagtgcggtggctcacacctgttatcccagcactttgggaggctgaggcaggcagatcacttgaggtcaggagttcgagaccagactgggcaacatggtgaaccccatctttactaaaaatacaaaaattacttgggcgtgattacacatgcccgtagtcccagctactcgggaggctgaggcacgagaatcacttgaatctgggcggcggaggttgcagtgagccgagattgtgccactgaactccagcctgggtgacagagtgagactctgtctcaaaaagaaaaaaaatgaagaagaagaagaaaactagaagcctaggttagggatttggctaaagccacatgtcagtgccaaaagagagaccagagcctgagtctcttgactctcagactggcacattaattaagtacctacacggtactcaagctcttgggacatctaggacgtctcagtgcatctgggatggggtgactcagccttccactgcccaggctaatcactctccagtgctagattgtgccattcataatgaagaggttgcaatttggaaccatgactttggggagaaaatgggctggaaaaacaacactggtctttgcggtcagctagacctgggtttgggagtatcacctgctagtatgccctcccataagctgcttgaatcactccaagcttcagtgtctcatgtcaagtgggagaggaatgtgtactccagggggaggtgtgctgattaagtgggaaaagcccatgggaagagcagcatggtgcctggattgtagctgcgctcttctgccctccgtccttaacccaccctccttcacctgtccccactcactggattccttttggcttgtctgcatatctagtttggttggttattgaagaagtggggtatgctagacccagactgcctggttttgaatcccagctctaccacgtctgtgaccttggacaagttgcttatcctttctgtgcttcattctgtgtgcattcccatgcacaatgggaatcagaaggggcttacctcagagggttgatgtgagaattaaaaagttcattccatgtaaagggcttagaacttgcctgtcacttaagtgcttagttagtaaatgttagctactgttaacttcaaagagacgaagtgctttgtcccataggaacataatttttaattttaaaaaatagataattccggtggcttacatttgagttgcaggagttttatagtataattttccataatttatgtacatatgcaaaaatattttggagtaggggattttccaagtatcaaaaggagtactgttttggtttcacttcttactggggcttatcatgatctgaaaactgactctggaattccccagggctgacacgcttcccttcataaccacagtcattcacaacggatgaagcatgcattcttccaagtaacacacaggttaaacaaagaaatgaacagtttttgtagaattgaatgtgtaaacgtatggaacagctgcctacagccagcttcagtatttcagagagctgttgccactttgaaactgagagggcttgtagtcattttgatgtggtttcctatcctggtacagagaccctctgctgggtgaggggtctggtaagacctcttgattaactgcctgaagaaactgttgggctgggccgggtgtggtggctcacacctgtaatcccaacactttgggaggccgaggcaggaggattacgagatcaagacatcgagaccatcctagccaacacggtgaaaccccgtctctactaaaaatactaaaaattagccgggcacggtggcacgtgcctgtagtcccagctactcgggagcctgaggcaagagactcgcttgaacctgggaggcggagggtgcagtgagccgagatcgctctactgcactccagcctgggtgacaaagcgagactccatctcaaaagaaaaaaaaagaaaagaaactgttgggctggtttcttcagggcacagagagaatctgatccagtcaatatttaattttttttgggacagggtcactttgcctcccaggctggagtatagtagtaccatcacagctcactgctacctcaacctcctggactcaaacaattctcccacctcagcctcccaagtagctgggactacagacgcgcaccactgcttctggctgattttttttttttttaatagaaataaggtctctctgtgttgcccaggctggtctcaaactcctgggctcaagtacaggcatgagctactgcacctggcctcaatatttaattctaagagtaaaggaaagagaaagaaggtccttgattgttaaagtaaaaattgtttttcatttcagaataaaaaatagtccctaactcctgggcaattggacaagagatgaaatttcagacatttgcctgtttttaactcacagctatgttacggaaatagtcttataattacatacattgcgtttatgacaagcgttcacagtgggattttcattttgtttactaaaggaagttgtaaaggtgcactattgtctttgtatgggaaaggatgtcataagttactgtatgaatttgctagggctgccataacaaataccacagactgggtggcttaaacagaaatttattctctaacagttctggaggcaagaagtccaagatcaaggtgtcagcagattggcccttctgcgggctgtgagggagaaagtgttctacagctctctcctgccttttggtggtttgctggcaatctttggcattccttggtttcttctccatcacctgagctctgccttcatcttcacatggcattctccctatgtgcatgtctgtatccaaatttcccttttttgttgttggggtttttttgttttgttttgttttttatttttgagatggaatcttgctctgtctcccaggctggaattcaatggcgcaatctcggctcactgcaacctctgcctcccaggatcgagcgattctcctgcctcagcctcccaagtagctgagattacaggcgcctgccaccacgcccagctaattttttaatttttgtagagacgagggttttgccatgttacccaggctggccagatttccctttttataaggacatcattggataagggtctaccttccttcctatcttaacttacctagttacatctgcaatggacccagtttccaaagtatgggggttaggagttcaacatgaattttggggacacagttcaatctataacaatcaccatcttccttccatcaattcttggggtgttcagcttgcttatgattaaaagctaactgagctgtttctgaaagcagctggtctatatggaggatcatttgcataggacttggtgtgtgctcctgagaaaatctggggttttgctggcttgatgtgcaaccctgaggaagcttggctcaaaccatctttttccagtcagtatttcccctccattagtaggttacagagaaatcatctttgccaagtctcttgtatcattctccttctttccatgacccctacttctcaacccacacagtgggaaatgagcatgcagggcccaagccctgacttgaggcaggctggtctaggggtcttgtgtgctggccctggagtcagaccagctggggaagatcccagtgccacactggctgtgtgatctggggcacacttcttaagtgctctgagccttggttcccttatccgtaaaatggaatagtaagagcaccttagggaagtggtggtgaggattgaatgagatagtgcaagttgagcagggttgatacactattaataattcaggtggggcttgtaccgcttcttccccaatttactcccgtccattgtgttgtcaggtgcaggtttccaaagcacaccttggttcgtctctctgcgttttgtgggatgcctcctctagctcgccattgcctacttattcagtattttgtcattcagggctgcccttgtggcttatgtgacccagcccccagctgctcttgctgggcctctccatgtagccttctttccaggagaaaactttcttcatccctttgcccaacaaccctatgatctcctgccctttagtctgttcttacctttgcccggaatgccttcctttcattcctctcaagtcttttatggttaaattctcaaactcagctcaaccatcacctcatccataaaacatttcctgttcttccctttgagccctattgcactctgtaacatttcttctataggacttggcatcctctcctttgaactgcagtggctggaatgtggagactgggtcttggctttcacctgaaatagcacccagggacagggttaggagcagaggtcagttcagccagtgtctgtctgttgagcacttatcattcatgacattgtgtttgcagaacttcaaagataccatgggtgtgaaggtgtcttgggtccttcaaggcccgagtctcaactagaaagtaggtcagatctgaaatcctgatgggccatctgactatttaatgccaactgtctgagtggatgagggcagtggaaagcagactttcaggctagcattataattaatcaagtggtgaaacttgggattgcctaaagttatatagcaagttagtgaccttgctaggaatagaacaggtcactgttcttaagcactgagtaaaccataccttctgctcactataaaacttcaaaggtaaaaacaaaagtctgtctcgttcatggcagccttgtgataggaagagtttattcttaaaatcttgttgcttttttttttttttttttttgagagatagggtcttgctgtgtcacccaggctggagtgcagtggtgcagtcatatcttactgcagcctcaaccttctgggcacaagccatcctcctgccttagtctcccaagtggctgggatcacaagcatgcaccactgcacctggctaattttttaaaaatttgtttgcagagacaaggtcttgccatgctgcttaggctgctctcaaactcctgggctcaagctatcctcctgcctctcctcctaaagtgctgggattacaggtgtgagccaccgcacccggctggatctatgttaatattcaaatacaattccaggcagctgaagcctgcctaggctgaggtacatccctgagttgtttttggtggagttgcaggtggtggttggcagaatgtgggcaagtcacagaggcaagacgtgatcttttgaaattggggagaactgggttcctgtctttatctgtcagagttctccagaaaaacagaatgagtagaatatgaataaataaatacacatatacacacagatttatttcaaggaattggatgatataattgggaaggctggcaaattcaaactctctagggcacccagaaactctggaagctccgcaggagctgcaatgctacaggcttcagggagaatttcttctttatcaaggaaacctcagttttgctcttaaagctctccaattaattggatgagacccacccagattattgaagataatctcctttacttaaagtcagctggttgattgtagatgctaaccacatgtacagaataccttcagagcaacacacaggttagcacttaatagaatgacttaagaacaatagcctagctccttgacatttaaaactgaccatcacgccatccagctccacctcttcctgggaaaccatgatttccaaattggtaaatggagaaaattaacatctttcttgaagagttcttgtgaggattaaatgacactgtatgtttaagggctggtacagttcctggcatagtaatagatcgtcaacagatgattcgcttttattgcttctgagctccaggtcaaacctccaggacaccccttgtcttctagaggaaattaccaaagactggaatccactttagcatgaaaggaacccttccctccccaagggggaggtcatactggaaatggttgaatgaattggggcagttccatgttgagaagatcagactgaggaaggatcatgatcaccaacttcaaatatttgaagagctgttatgtgaaagaggccttggacttgttgaggaggcagaactctaaatgccaactgaagttctgctaaagctcaaccgcaggaagaacttaatttcttagcttctctctctttttttttttttttttttttttttttttgggtcttacctttctttagagtttctccaagggtctaagggaaatccagtgacaaaatgagagcctcctggggcactagttaaaatgcagattgccaggcccacccatctaccaccaggctgaatgaatacctctggagttttccagacccccaggtggttcttgtgccatcccaagcttaaggtcctctgccttgacgctcctcccccagggctcctcagtgtccggcaatacctgaatggaaggagtgtctggctgaaagcccttctatgaatttaaggctcagagcagttaaaaaactgggccaaagtgacttaccaggtacttaaaagtcaaagcccaatttccctagctccttttattattttctaatatattctaaagaacatctctctggatgggggtggaggtaggttggggaatggggatctagcatgcaaaaacaatgaatgcagaattagcttgcacataagtgcagtttaaaattcatgcttaatgccaggcgcagtggctcttgcctgtaatcccagcactttgggaggccaagacaggaagatcacttgaggtcaggagtttgagaccagcctggccaacatggcaaaaccccgtctctactaaaaatacaaaaattagctgggcatgttggcacacacatgtaatcccagctacttgggaggctgaggcacgagaatcgcttgaacccgggaggtggaggttgcagtgagctgagatcacgccactgcactccagcctgggtgacagagctggactccatctcaaaaaaaaaaaaaaaaattcattcttcagttctagaacaggcaaagctgagctaaaaatattagcgaggagaactttctgaaaagttctatatcgtggttggggtgtcagtttacatgggtgcctccatttgtcaaagtgtgcacctaaggtttctgcatttctgcgtgtataaatcctgcctaaaaactattaaagaagaattgagtggggaggggtgaaggtattgatgataagagtgctgatcattgttgaaactgggtaatagttacatggaaagtgcactgtataatcatacagtgattctgtattctgtttacgtatgtttgaaattttccataataaggaaaaatacaaaaaacatcatgtattttgaggaccagttggcctattctgcctgctgggataatttaacactaaataaatgaatcataaatgatactctttactgccgcccccatggaacatgggcctcttatgtcctagcttcacctacctagtggatatctgccaagtttttcagctgtttctctgccttctccaggggactttagaagtaagtttagactatttctttttttttttttctgagacagggtctaactctgttgcccaggctggagtgcagtggcataatcagggctcactgcagccttgacctcccaggctcaggtgatcctcccacctcagcctactgagtacctgggattacaggtgcgcaccaccacgcctggctgatttctggtatttttgtagtgatgggtttcaccatgttgcccagggtggtctcaaactcctgggctcaaatgatccacctgccttggcctcccaaagtgctgggattataggtccatatcacattttattatggaaaatatcaagcatttattactagtggagaaaatggaggtggataatgcccccctccccatcatgtagcttcaacagttaccaattcatggccggtcatgtttcatctttaactcttgccctctctgtccgcccctctattcttttgaaacaaatcccagacatttcttagcaaggagaagagaaaaaccaagcattgttcctttcttactcttccactacttccattaactcaaaaccgtctgtaaatattttagtatatatccccaaatcataaggactcttctaaacataaccacaatgccgttagcacacctaaaagaaattcccaaggattcttttttgtttttttgaaacggagatttgctcttgttgcccaggctggggtgcaatggcgcgatctcagctcactgcaacctccacctcccgggttcaagcaattctcctgcctcagcctcccaagtagctaagattacaagcgtgcgctgccaagcccagctaatttttgtatttttagtagagacgggatttcaccacgttgaccaggctggtcttgaactcctgacctcaggtgatccgcccacctcagcctcccaaagtgctgggattacaggcgtgagctaccacacgtggccaggattctttatttatttattttattatactttaagttttagggtacatgtgcacaacttgcaggtttgttacatatgtatacatgtgccatgttggtgtgctgtacccattaactcgtcatttacattaggtatatctcctaatgctatccctccctcctcccccgaccccacaacaggccccagtgtgtgatgttccccttcctgtgtccatgtgttctcattgttcaactcccacttatgagtaagaacatgcagtgtgtggttttctgttcttgtgctagtttgctgagaatgatggtttgcagcttcatccatgtccctgcaaaggacacaaactcatccttttttatggctgcatagtattccatgttgtatatttgccacattttcttaatccagtctatcattgttggacatttgggttggttccaagtctttgctattgtgaatagtgccacaataaacatatgtgtgcatgtgtctttatagcagcatgatgtataatcctttgggtatatacccagtaatgggatggctaggtcaaatggcatttctagttctagatccctgaggaatcgccacactgacttccacaatggttgaactagtttacagtcccatcaacagtgtaaaagtgttcctatttctccacatcctctccagcacctgttgtttcctgactttttaatgatcgccattctaactggtgtgagatggtatctcattgtggttttgatctgtatttctctgatggccagtgatattgagcattttttcatgtgtcttttggctgcataaatgtcttcttttaagaagtgtctgttcatatcctttgcccgcttgttgatggggttgtttgtttttttcttgtaaatttgtttgagttctttgtagattctggatattagccctttgtcagatgagtagattgcaaaaattttcccccattctgtaggttgcctgttcactctgatggtagtttcttttgctgtgcagaagctctttagttcaattagatcccatttgtcaattctggcttttgagccattgcttttggtgttttagacatgaagtccttgcccatgctatatgtcctgaatggcattgcctaggttttcttctagggtttttatggttttaggtctaacatttaagtctttaatccatcttgaattaatttttgtataaggtgtaaggaaaggatacaatttcagctttctacatatggctagccagttttcccagcaccatttattaaatagggaatcctttccccatttcttgtttttgtcaaagatcagatagttgtagatatgtggcattatttctgagggctctgttctgttccattggtctatatctctgttttggtaccagtaccatgctgttttggttactgtagccttgtagtatagtttgaagtcaggtagcgtgatgcctccagctttgttcctttggcttaggattgacttggtaatgcgggctcttttttggttccatatgaactttaaagtagttttttccaattctgtgaagacagtcattggtagcttgatggggatggcattgaatctatacattaccttgggcagtatggccattttcacgatattgattcttcctacccatgagcatggaatgttcttccatttgtttgtgtcctcttttatttcgttgagcagtggtttgtagttctccttgaagaggtccttcacatcccttgtaagttggattcctatgtattttattctctttgaagcaattgtgaatgggagttcactcatgatttggctctgtttgtctgttattggtatataagaatgcttgtgatttttgcacattgattttgtatcccgaggctttgctcaagttgcttatcagcttaaggagatcttgggctgagacgatgggattttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagcttttattagtttgagatacgtcccatcaatacctaatttattgagagtttttagcatgaagggttgttgaattttgtcaaagctggccaggattctttaataatcatcacatatctagtcactgttcaaatttcctgttatctcatgaataatttttcatagttggtttgtttgaatcacaatccgacaagatccataccttgcattgtatccagctgtttttgcatgataaagtagtattcaagcagacaggtgctttactggatttgtatgcagtcagcttctgccagcactgctgttgtaatctgtgtgatgcagtgtgaagcgagcgggtggggcgggggggaaagaattcaccctggatggctcaatggaagagacttaaatgaatgacttcttacagccatgtggtcagg

SEQ ID NO: 2519 - DNA, 22016 bp, Homo sapiens
ccagtgtgtcctgttcctggaagaaacagaaagagtgaaaaagtttgacaagctttaatgttatagggaaaaaatacatccagagagcttttaacatgatagttgaaactatctgaatatgcagtacactctaaatggtaaccatatttgaatgtttagaagaattctctagccttttaattatttaggtctccttatttataaagtaaattaaggtagaaggacttatctgggtaaataagtatagatctgtggagatgttttacatttatcattttcctgattataaaaggaatatggcggggcgtggtggctcatgcctgtaatcccagcactttgggaggctgaggcggacggatcatgaggtcaggagattgagaccatcctggctaacatggtgaaaccccgtctctactaaaaaataccaaaaaaaaaaaaaaaaaaatagctgggcgtggtggcaggcacctgtagtcccagctacttgggaggctgaggcaggagaatggtgtgaacctgggaggcggagcctgccgtgagccgagatctcgccactgcgctccaccctgggcgacagagtgagactcaaaaaaataaataaataaagcaatatgtgtttgttgtaaaatattcacagttatagacacgtataaagtgaagtaaactctttcccaccctgttgccaaccttcagagagaaccagaattaatagtttataataatagtttccgccgggtgcggtggctcacgcctgtaatcccagcactttgggaggccgaggcgggcggatcacgaggtcaggagatcgagaccatcctggctaacatggtgaaaccctgtgtctactaaaaatacaacaaaaattagccgggtgtggtgccgggcacctgtagtcccagttactggggaggctgaggcaggagaatggcgtgaacccgggaggccgagcttgtagtgagccaagatcgtgccactgcactccagcctgggcgacagagcaagactctgtctcaaaaaaaaaaaaaaaatagtttccatatttgatcagtgtttgcttccaattagctgtttgatcaattttcttttctttttttttttttttttttagtatttattgatcattcttgggtgtttcttggagagggggatgtggcagggtcataggataatagtggagagaaggtcagcagataaacacgtgaacaaaggtctctggttttcctaggcagaggtccctgtggccttccgcagtgtttgtgtccctgggtacttgagattagggagtggtgatgactcttaatgagcatgctgccttcaagcatctgtttaacaaagcacatcttgcaccgcccttaatccatttaaccctgagttgacacagcacatgtttcagagagcagggggttgggagtaaggttatagattaacagcatcccaaggcagaagaatttttcttagtacagaacaaaatggagtctcctgtgtctacttctttctacacagacacagtaacaatctgatctctcgttcttttccccacatttcccccttttctttttgacaaaaccgccatcgtcatcatggcccattctcgatggtcactgtctcttcggagctgttgggtacacctgcagaaaggctgtcacttcacacttggaagattgcacagcagccaggcagaggcgctcctcacttcccagacggggcggccgggcagaggcgctcctcacatcccagacgatgggcagccgggcagaggcgctcctcacatcccagacggggtggccaggcagaggcgctcctcacttcccagacggggtggccaggcagaggcgctcctcacatcccagacgatgggcagccgggcagaggcgctcctcacatcccagacggggtggccaggcagaggcgctcctcacttcccagacggggtggccaggcagaggcgctcctcacatcccagacgatgggcagccgggcagaggcgctcctcacttcccagacggggtggccaggcagaggcgctcctcacttcccagacggggtggccaggcagaggcgctcctcacttcccagacgatgggtggccgggcagaggcactcctcacctcccagacggggcggccgggcagaggcgctcctcacatcccagacgatgggcggccaggcagagatgctcctcacttcctagacggggtggcagccgggcagaggcgctcctcacatcccagacggggtggccgggcagaggcgctcctcacatcccagacgatgggcggccaggcagagatgctcctcacttcctagacggggtggcagccgggcagaggcgctcctcacatcccagacggggtggccgggcagaggcgctccttacatcccagacgatgggtggccaggcagagacgctcctcacttcctagacagggtggcggctgggcagaagctgtaattttagcactttgggaggccaaggcaggcagctgggaggtggaggttgtagcgagccgagatcatgccactgcactccagcctgggcaacattgagcattgagtgagcgagactccctctgcaatcccagcacctcgggaggccgaggcgggcagatcactcgaggtcaggagctggagaccagcctggccaacacggcgaaaccccatctccaccaaaaatacaaaaaccagtcaggcatggcggcgcgtccctgcaatcccaggcactgggcgggccgaggcaggacaatcacgggagcccgaggcagggaggttgcagcgagccaagatcacggcagtagagtccaggctcagcaatggagggagaccgtcgaaaggagggaaggagggaggaagggaggaaggaaggaatcaattttcaacagaaaactaaaactgcctgctggcaacattaatttccaaatctaatctaactcatgagtattttaaattcaggggctttataagtgcatgttaatttaaattgcacagattagaacagcctgtctcaggacaggatgtaaaactgacctttgtttctgaattaaatgtttctttgatactgaaatattgaaatgccggtcttagcttttgacttgtgggttttcatggtccctgaacaataagcacaatgcagttttaaagactgtttgcttatttgatgaaatttcgtacttttataggagaatggggtactaagagaaaagcacgaagctgtggatcatagttcccagcatgaggaaaatgaagaaagggtgtcagcccagaaggagaactcacttcagcagaatgatgatgatgaaaacaaaatagcagagaaacctgactgggaggcagaaaagaccactgaatctagaaatgaggtaagcctgtcagaatattcaagccttgccgttttggttttaatgtagattttgtggcattgacagtttgtgtcaagaatgagcatgtaaaacagtatgctctactattaacaaatatgatatatgaaaatacctatgtctttaagttatgggagtagtaatttgatttataaatgaattagcccatacaattgttttctctggttaaactcaagattttgtgtgtatgtgcacacacccccttccaggaccttgctagcaggttttgctagttatgtttgccaaggcaagtgatgaagaaatggggaacctaggagtcctcaaccagccacatgcacaggtagccaggctggcctagtccaggagagcaagccgaggaccaaccctacagccaatcacccatgatgtcagctaaggcttgggctgaaatctttgttcagtctcctggcaggcctggctgaaccgttgggcatccatggtccagtgggaccacctccttaactcctcattgcctaaccttactctttggctgtgagaagaggtgtacaaagatgaactcccggagccaggctgaagggatggatgctttctgcgatctgtgcttcctcctcctttcatttgggctgtactctgatttctcttcagccctgctgaggtcctgcccacaagcatggcaaacaggcactcgagatatttaataaccacgtggcacttccacctggaaggcataccctcaggggtcttgccctgacggttttcttaggcatcacctgctttagcatgtccccttcccagaatgtggagtttagggctgtgttttgaataccttggaggatggagagtaccatgccctgacccttctcagacagctgtcatcatggtagccctggccatgtaatattacatggaacattacttattttgcatgaaatcagaaaacaggtttgttctctttgcctgcctaccactcccttgcccctccagcttccacctagagccccttggtgaaatctagggcaggtcccataaattctagatactaatgaaaatcgctctggccatcccagtgcagcaattgataagaataacccagtgtgtccatgtacagttgctcacacctataatcccagcactttgggaagccaaagcatgcagatcgcttgagcccaggagttggagatcagcctgggcaacatggcaaaaccccatctccacaaaaattacaaaaattagttggtgtggtgatgtgttcctgtactcctagctatccaggaggctgaggtgggaggatcacctgagcctgggaggtcgaggctgcagtgagctgtgatcacaccagtgcactccaacctgggcaacagagtgagaccctgtctcaaaaaaaaaaaaaaaaagtataacccaatgtaatttccaagaacgctgaaccaaaagttagctgggcgtagtggtgtgtgcctgtggtcccagctgtttggcaggctgaggtgggaggatcacttgagcctgggaagttgaggctgcagtgatccgtcatcatgccactgcacttcagacggggtgacagagcaggaccctgtctcaaaaaagaaaaatccaaaacaaaacacactgggctaaaattcagcatctttcctcagttttgtgtggcctgccctgctgatttctctggggttgagggtgtggggtgctaagaacataggaaattgtttctcttgaccacgcgatacatttaaatattatacaactctttgtcacgtgggcaccttttcgtgtataggttctttggagacccctggccccacagctgggagtcttcctcttgacaggggcaaatgcatctccactgcagctggtcctttaggactcttccctgaatgttccgtggtatacatgcatctcacctcttcaggtggccctctcaaccatttgctggccgcctagcacctggaaacatgcccttagacccttttccagttccctaactatggctcttgcatggtttctcatcgtttatatttcccaggcaaaaacaggacactaagcttctgtgtccccaaactgcggaaaacacacactgagttctaagtggtctccttgaggccctttttgacattcttcagatgaaggggagggggtagagagcacaccccaaggaaccctcccattttcactctgaccagtggagctttaacccttttgtaaccctcaattgcaacctggcatttggcaactgcctgttcttttttcccagctggtattctccccagctcctctgacttatctatttcctaattaatggatgcattgtatggttttaccactctccccacagcatacatactgtattgtcaaatcattacccatggacttttatattaaaatactgacagaaccatatatatgttgaagaggacaacatttctgcccacttccctgagtattcacagctctgtttgagggaaaagatgttttcactagtctttcacttatttaacactgaattgtatattgcctttctcccaggtatgtcttcgtctttactccctcactgggcttcccagaaaagcaagaactgtaacaaactaattcactgctaggcacagactaggcacttactaaatattaatgaggagacaaatgaagtagggagcttccttggagagaatttaaaatgtaatttgacataggacaaacatcaatttggacaaaacttttcagaaacatattaatcattcaaagccaggcatttgtgcctaattcttatcaggcttggttcctcattgtgttatctccatgttcctagcctgagcatttacgtcacatcttcgtgtacttaacactttttttttttttgaggaaggcggcgggggagacaggatctcactctgtcacccaggctaaagtgcagtggcgctgtcatggctcactgcagcctaaacctcctgggctcaggtgatctcccacttcagcctcccaagtaactggggctataggtgcacaccaccatgcccagctaattttttgtattttcagtagaagtggggtttcaccatgttgctcaggctggtctcaaattcctgggctcaagcaatctgcccactttggcctcccaaagtgctgggattacaggtgtgagccactgcacccagccacatttcttatagtagctctgacaagatatttctgttcttttattgggctattacttagtaggtgcttttaaagcttgttgaaataaaacagaaatgagttagaccagtgaatcactggcatttccattcttccagatgacaactctggaagaatatctaggaaatggggactggtacaattctagctaccctttagaaatcagaaccccagtgggggccccaaagctagatataagatctgaatgcacactaccatcaccatcaagaatcctcggccaagagaaagtacagtctggaaaatgatataaacactggttcttgaaaagaaaaatgcaaaactgctccccaaaatgctcaccttttaagaattaaaaatgacataaatagccatgagtcagcatatgcaaaagtcaggattcctagtcctctgaaaaagactctaaatcagtgtttaaattgttcataggaacagaatctataaggcaagaacagactatcatgaaaaaagaaaaagatctagaaaagagcccaaatgaaattctagatatgaaaaaagtcattttcattgaaaattcagtggaagtgatgtgaacagctaaggaaaagggtaagttggaagaaagatctaagaaaattatctagaatataccagagaagatgcaaaatatgaaagcaaaattgagacaatgatagaagagaaaaatctaagttacttctaataggagtcccagaagaaactataaaatatgaaagataagcaatatttaaaatgagtttatggcaaaatatttccagaaaagtcctcagattaaaggactacacagagctcctaacgaaaacaaattaagtcctagacataccagattgaaacagaacgtcaagaactaagaagaaacattttttaaattacctgagatagaaaagtttcattataaataacactgagagcaaacttaccagtagtaataaatgccataagacagagtactgagggaaaacattaaaccttatatttttaccagttaactcatcatttaagcatgaaggcaaaataattccatgtaggccgggcatggtgtctcatgcctgtaatcccaactctttgtgaggccaaggcaggtggatcacctgtggtcagtagttcaagacaagcctggccaacatggcaaaacgccagctctactaaaaatataaaaattggccaggcgcagtgacacatgcctgtagtcccagctattcgggaggctgacacacaagaatcaatcacttgaacccaggaggcggagattgcagtgagctgagatctcaccagtgctctccagcctgggcgacaggacaagactgtctcaaaataattccatgtaacaaaaactgggtttactgctcaggtcctctctaaaaagaactctgaagagttctttcaactagaaagaggctaaagcataaaggccaggagtgagatgaagcatcgataaattggttttaaaaaaacaaattggagtaaatgtaaataagtattgactgtaaaaatattttttgagacgagatctcattctgttaggctggagtgtggcagcgctgtcacgactcactgcagcctcaacctcctggactcaggcagtcctcctgcctcaccatcccggagtagctgggaccacaggtgcacaccaccacacccagctaatttaatttgtagaaacggtcttgttgtgttgcccaagctggtctccaactcctgggctcaggcgatctgcctgctttggcctcccaaagtgctgggattacaagcgtgagccaccacacctggccaaaattatataattgtgtaaccaactgggagggctggctatggaggggcaaaataagctgaaactaacaattagccaaaaattacatggaagttgtttatggtaggaatagaaatactgattagctttggacttttaagtatgcatgttgaaatactgagtaccataatcagagaaataggtcagctgcagtggctcacgtctgtaatcccagcactttgggaggcctaggtgggtggatcacttgcggtcaaaagttcgagaccaacttggccaacatggtgaaaccctgtctctactaaaaatacaaaaattagccagacgtggtggtgcacagctgtaatcccagctactccggaggctaaggcaggagaatcctttgaacctgggaggcagagggtgtagtgagccgagattgcaccactgcactccattctgggccagagtgagatccgtctcaaaatataataaaaagtagaacttccaaccaaggaacataatagcataaaaatccagtgtggaaataatacctggtgatcctttaaagataaagcctaaagccccaaccagttcagtcttttatgtgaaagatgcactttttgtgtttctctacagagacatctgaatgggacagatacttctttctctctggaagacttattccagttgctttcatcacagcctgaaaattcactggaggtaattggaactttggcttttatcctcgcaggaacatatctgcactgaccttttggtgaacaaatacaactcctttacttggatgacacagcagtttaaagtaatgcttatttttacagaagcacttcagcttagaattaaccaaatatgtatagcattcctctttccaaataatcccaaaggtataatcaaatttagactagtcatggaaaacagcgtggagatttctcaaaaaactaaaagaattatcaggtatttatccaaaggaaaggaaatcagtgtatcaaagggacacctgcacccccatgtttattgcagcaatattcacaatagccttgtagttttagcgcttagaggcatttaaacagcctctctcctccagactacttcactgtagtttattatccctgaccctccacaatgtgattaccaaccgctaggatgagttgcatcttattataaagtagcaaattacaagattgtaacattagactttttaagaaaatccagtcagcttttatactaatccatcttaatttctaggttactcagaattccaggtattctgatttggactcacatctcgtattgtattgcctgtatttaactaggaagttactgccaacagcatctatctctattaaatgtagaggaattgacaaaagaggggaaagaaagttgttaggtaatagaactgcttcagaaatagggctattcatgtttgaagtgtttctccttcgtttttcagggcatctcattgggagatattcctcttccaggcagtatcagtgatggcatgaattcttcagcacattatcatgtaaacttcagccaggctataagtcaggatgtgaatcttcatgaggccatcttgctttgtcccaacaatacatttagaagagatccaacagcaaggacttcacagtcacaagaaccatttctgcagttaaattctcataccaccaatcctgagcaaacccttcctggaactaatttgacaggatttctttcaccggttgacaatcatatgaggaatctaacaagccaagacctactgtatgaccttgacataaatatatttgatgagataaacttaatgtcattggccacagaagacaactttgatccaatcgatgtttctcagctttttgatgaaccagattctgattctggcctttctttagattcaagtcacaataatacctctgtcatcaagtctaattcctctcactctgtgtgtgatgaaggtgctataggttattgcactgaccatgaatctagttcccatcatgacttagaaggtgctgtaggtggctactacccagaacccagtaagctttgtcacttggatcaaagtgattctgatttccatggagatcttacatttcaacacgtatttcataaccacacttaccacttacagccaactgcaccagaatctacttctgaaccttttccgtggcctgggaagtcacagaagataaggagtagataccttgaagacacagatagaaacttgagccgtgatgaacagcgtgctaaagctttgcatatccctttttctgtagatgaaattgtcggcatgcctgttgattctttcaatagcatgttaagtagatattatctgacagacctacaagtctcacttatccgtgacatcagacgaagagggaaaaataaagttgctgcgcagaactgtcgtaaacgcaaattggacataattttgaatttagaagatgatgtatgtaacttgcaagcaaagaaggaaactcttaagagagagcaagcacaatgtaacaaagctattaacataatgaaacagaaactgcatgacctttatcatgatatttttagtagattaagagatgaccaaggtaggccagtcaatcccaaccactatgctctccagtgtacccatgatggaagtatcttgatagtacccaaagaactggtggcctcaggccacaaaaaggaaacccaaaagggaaagagaaagtgagaagaaactgaagatggactctattatgtgaagtagtaatgttcagaaactgattatttggatcagaaaccattgaaactgcttcaagaattgtatctttaagtactgctacttgaataactcagttaacgctgttttgaagcttacatggacaaatgtttaggacttcaagatcacacttgtgggcaatctgggggagccacaacttttcatgaagtgcattgtatacaaaattcatagttatgtccaaagaataggttaacatgaaaacccagtaagactttccatcttggcagccatcctttttaagagtaagttggttacttcaaaaagagcaaacactggggatcaaattattttaagaggtatttcagttttaaatgcaaaatagccttattttcatttagtttgttagcactatagtgagcttttcaaacactattttaatctttatatttaacttataaattttgctttctatggaaataaattttgtatttgtattaaaaattaacttttcccttttatacagaatctgaaccaaatttaccttactttccttccaaaatatccacattcaggaatataggtgaataacaaataaggcagcatagcaaactgctcagactcaagccaaattgaggtcaacatagtatgccaaatccatagtaaggcaaatccacccccctaccccaatacttaacacacagaatactatgtgatatagaatgcactgaagacctacggtcactggtagtttgagccacaggccttcctcatgtaaccagagacagaatgggctacttgcaaaaacgtaactccttgtgtgtatattaaatccataaaatctctggcagtaaagccagcctgaagggatggcctcaccatcttagaatactgagatctcaccagaacactgtaagccatataaacagtagggaaagagtcagcaacagtgaaaccatctgtttaaaatgggcaaaagcgattaagggaaaaaaaacaggtgaatttgaaaataaaccagggtaaggtaaattctagaaataatagcatttgaaatgaaaacctcacttaagttcactagaacagtaaacaggagattgctgaattttttgaagacagcaatgacctcacctagatgactcaagtttggggaacatcaagattttgacgggtactataatgcttaatatgtccaaattttcaaaatgaagtttctcagatattatttctgccataggagctacagtgtagagtatcacataagtatcttgggctagagaaatgcagtttatatataccgttggatttttataataaagtttcccaagacctgttattttgccagaaatgcttctagtatgcttctagataaaattgccccttcagtgactcatggtgttcaaatgatcattttagtctgttgctttttacaagggagtatttcaaatgtcttaagcttttgataattataatttaagaacacacataaaacatttcagtaggaaatcctactaagtacactcaaaagagtgcctgcttatcagatagcattcttttcaaacctctaaaataaaagacagtggagagcagaatcggtaatcatggtgactcttgttacccatgctgaagtgcagtggccccaataaaagatccagcctcaaactcctggactgcctcagcctcccgagctgctcagattatggaccgccatgcctggcctgaagtttaaactctaaaaacccttaaatatagcacacacagatctagtaactgcaaactgaatatatttaaagatggtagtgtctgtactgaactttattccccatacataatgcagcataccatttacctagcttctaccttggattaaatattgggtaacctagacaactcaagtgtatgagatgtgcttagaccacgtgcaaatacacgtttcatacaagggggctagagcatccacattttggtattgtggaggttcctgaaactgatgggcccctctcccatcaagggacttttaatcggcgcattaagcagccagcgtcacaagctctaattggctatgggctggcttcctgacataaccctgcctccatcttaacatgctggattcaaggtatataaactgcaactgcttttctgacagtccagttttagaggcagaagggaattccacattcggcttccagtgcaaaccaactagattacaaagccaatgcccgaaagctgaccattgcctaggaccctccacattacctacctagttgagcagtcttgattgcatcatctaacgtcttaatcagaatgaggaagacaagaacaaagacaacccaagtgggttggacatctccttttccaattaaaactatcacttgagcatcttcacaagtgtgatcagattttaggccaattgtacggcaactccaagcaaaaaaagacctagatttctagtggtcccctggtctcaaggtaggcttcggttcagcagagcttcagaaccagtatacagggttttgtgtggtaatattaacgtcttttaaacgcactcaagtagctaaatcattccccatctcagtctctgaacgatttgttctctgttaagtccatgcaactcaactgatttgttaccaattcccctccactaccccaaaacaagccagtgttagtgcattactaaatagtggaaatgtcaaaaattatgtagggcctgtcaacatctcagtatattagttccaaaccttaaagagagcgaatttatgtaacatgcagtccaggtgtcctgacagatgttttccacttttcaaccatcagtgacaaactgagacttgttgccttacattgttagctcccaatgcctaactagtatttattaggtcaagcaatttggcatctaccaaattgggctacatggaaaagcttacacatacagaaatctggtttcacactagtgaataaactgagtaagggcacccccttgagtgtgacagctggcatctgagagttcccaatgctccctgcctgcttggtaattgtaccagggaaaagaaccctcccaccacattctgtgaccataaaggatgcaagatagcacgactacttcgtagagcgtgttcattttacagcttttcttgctcaaatcactcaccgagggaagatgacaaccaggattaactttaaagctgttagtatgccactctggatattaaaaaaattctccaatcctagttttctgtgattggaaccttgagctttacccagaatcagttaagttgctcccaattgctgacccatagatgctggtttgtttctctgaactgctcttaagtattgaggtaagttgttacacagcaacaatataaagccttggccaaaaagcagcctttcttcatttagggcactgtctcaaagctacacaagaactaccttaaacttcaatttctacaagagaaacagctcaacacaacatatacacacaggaaataagcctatgttgaatatccaacattacccccatgcttcagtaaaccctccttcaatcagttcatttcagtctattgtgcaattacctaattctcccctatttgtgtgatattcccttgaccttggctggataggagttggtattttgaggttatgcatatcaacctgatgtatttcaaagttcaacgtctttgtacatccacacatttttaaaccttcaaaattttcttaaagttgggatatttgtacgtctttaattgacgaactcagctatttcaaacagaaagctgctttctatgtgttacctgctgttaaatttgacttacctgttagatacctcacattatcaaaaccaaaacaaattatcatagaaacaaattaacctggtctttttggttttcttaattcagataaatgtccaaataaacacatttaaaaagcaacactgatattcatttactcagtgtaaaccacaataaaactaattgacatttgacaatctagcacatattgtaaacctcagtgcttctgcaaagccacttaatctggaccactccagccggttaacctttaaaatccatgattttcaaaatgccaccagtattgctaaacgtaaaagtaaagccagaaactttaggagtactcaaacgctgaatatacagtgcataatgaacagcattttattggggacagccaataatgtccacaatgctcttctcatttacctgttaatattaaaatatgcatagctttgtgaaactgcttttaaaaatttaggggatggtgatcttttagacaaccaaatatttatagaacaagattcacacattttatgtgtaaacattacaccaagtatttggatacaaaaagtatttattttataaactttatatttaaaatagaattgtaatctgtctactcacaaaacctaatttaaaacatgatacatttatctctctagccaatttgatgttactgttttacaaacaacactcattttgtaattgttttatatcaagaacctcaactaaatgtttgttttatcagaaaacatttcccttttattttaaagagtgctttttaaatgaaggcaccaacaagaactactttcagatggtacagaatttcttatttcttgaagactctgtggttgaccacttcttcattagttacctgcagcaagacaccttcctgccaaaggaaaaaaaaagtatctgaagaagtttatcatgtttgtccaaaagaacctaaacaacttcagtggtggtcttaggatcaaagaagactcattggtgtatagagtaagccctgagtatcacattcctgtaaaggcaataaagccgggcaatcaaactgatcatatctaaggaatgaatttcaacagccaacctacaactttctcttcagggtaagacactgaactagaattaccacatttaacccacctatttagtactggatacataccaggcttcataatgcagacaagacacttcactcaagtatgaactactatctgaaaatagattcaaccatttttgccctaccttctttcagtctcatcctgataagcatgtacagttacaaccataaatacaacaaatgtctttaataaaaacccctagttcactcaaaatgtttgatccaagaaatgtgaatacacaagggtgtaacgatgggaaatctcatgatttattgaacttgcagcctaacttttacctaccattttactaccaacaccactgaaggaaccaagaaaagctttattaatgatcacttggcttgcctcagctgttgaaatgaagcactttacagtctttgtggcagcagaatatacttgtccatggttcatatcaatgctaaaattccggcagggaaaaaaatgatatgttaagcacccaaatcttcacatggagggggagggggtgggaaaagaaggaaaaaaagggaaaaacaaccaaaataatttaagtaaatgacagattggaaaacagggtttataaaaattattctcttgagtttataaattgttaaactcaatttatagctatgttaaactacgtaagaaccactatactgaaagaccatttaagagtattagtttatcttttagggaggaaaattaagaaaggaaaagtaaataagatcttacctaaagaagtttaactgaagcttagaactattttgctctacaccctcagctttcgttggcatccttataaactactgtagttaaagttttgtagaaacagcacagttttttaagactggctgaacttagtagccgtcaagagttctcttgtactagacctgtgtccctgaagagtacctcgctggggttatttcctttccttgcattgaagaagcagcatctaaaagatctaaaaaggtgtttctccttgcagagatatcccttaagttatctacataatttaatcctgatgaattgcagacaacacacttacatctgaccagcatttatcttatacaaatataacaacagctttgcaacggaccttaattatactacccactccttaacttatttaaaataaaaagtctataattacacaatttcctttagaattattttattaaatcataaatgtacaacagcttcttaactctacacacgcacttaaatttttttaaaggaaaaacgttatgtcttattacaccatgatcctggctaatagcttttcaaaactttgagaaaaatcttaaaaaaggtttcacatgtcacctgaaacttacaaatttaacattatcaaagaaggaatgcttctacactcttacaaagaccactagaaagaaacaacaattaaaaagctaagaaactgtctcaaaggcatttttttttacaatccttcctccacagtaaggtaatgttattaaataatccaatccattcacaaaatggctctctgcatctgctctggtgtcttctgccatatcactgcatatttatgcatgactgagataagagtttccttaacattgttatttcgataacctgaagctgttctgttacctctgggctctcatcctctcctatttatacagtgaagcctgtttcaacagaagtaaagagtaaaaaaaaaataggttatgaaattatccatctaaccagattttaaggaaagataacatgatcctaaaaagcttttactcctgcagctatgtctcccaagataataataattgtaaaactcaaaagctacttacccatggcaaataggaagaagctcagtatcggctcctcccaccataacccccacttcctccactgcctcctggaccatagtttcctataattgttggaacagcaagagaaaacaaacttactttgatttcccatgatcagcctaacactacagttgattctattttatatccatccagtcttttaaacaagcagatcctaatcctttgcagccagttagcagaattactcaggagataaattactcgggttcatagacatttttatttcgtggctgaccctattcttttaaataaagggtcctttcaccctctcatcctcatttggactgagtaagggatttttttaaaagtacatcaagcccaagacaaagctagtttactcctagctaaaaacctcaaaaataagctaagcaatggtttgaatcatggtttaaggatttaacttcaaagaccctcattccaatgtataccacttgcaatgtgggttgcaactgtatttagctgtttatgagtccccaccagaaattaaactactgaacacccccacctccaacatccctaatcccaatttgatgtcataactgcttgctgagtacttctgtggagatttatgcaaaatttctttattttcactaagaccgtacatggagcactgcccacagtacaaactacttagtatgttatcttccctttaagtcacaaaaggctaatcctttaatcacaaaaatctgaataacctcaatttttataaattacctccaccatatggtccccccatgttcctgctaccaccaaagtttccactcttcattggaccgtagttagaaggttgctggttataatttccaaaatcattgtaatttccacttccataatttcctattaaaaaattggaatactcagaacaatacaaacattaaaccaaggacttaggacaaagctcccataaaaacaaataaaagcaaacacttatccacaaattttatgggcatctagtgacaaacatggaaacaaaagatcaagtgttacaaagacattaattccaaattcccacataaaggttgcaggtgaatttattacctcctccatagttgtcataaccacctccgtagcccccaccctggttgccatatccaggtcctccaccaccatatcctcctcttcctcctccataaccggggctacctccaaaattgccacctattataaaataagcctttaagtaatcacttaatattttcaataccattttgaactgtctcctcacatccatttccagctttccaagtttccatgtgaaatatttaatgaaattcctctaaaatagcttcaaggactgaataactatccttggtaaacatttggtggctggggttactcagccaaatggataacaccatgtgcacacagttaaatacctgtaattccacagctttccctcaaaactaaaaatcttaagtatcttgaaatacttcatgtatattgtgggtaaggactgtgaggctagactagtagtgtgggctagagggaaagtaaaagagcacttcctcctactggcccaaaagataaagtttctattatgtctctctacgaattacatatcttaaaacaatgttctcggttgggcacagtggctcatgcctgtaatcccagcactttgggaaggccgaggcggacggatcacgaggtcaagagattgagaccaccctggctaacacggtgaaaccccatctctactaaaaatacaaaacattagccggacatggtggcagcaacctgtagtactagctactctggaggctgaggcaggagaatggcgtgaacccgggaggcagaggttgcagtgagctgagatcacaccactgcactccagcctgggcgacagagagagactccctctcaaaaaacgaaacaatgttcttggctgggcgcagcagctcacacctgtaatcccagcagtacgggaagttgaggcgggtggattgcttgagcccaggaattcaagaccagccagggcaacacagcaaaacccccacacctctacaaaaaaacacaaaattagccggtcatggtggcacaccccgtagttccagctacccaggaggctgaggtgggaggatggcttgagactaagattgcagtaagccaagatcacaccactgcactccagtctgagcaacaaagccagaccccatttcaaagaaaaaaaacagacccaacactccacacagtatgttctttactgtaaatagaagtgcggacataaacaaaaatttacactttcacatactgcaaaacaaaaataaaaaaaaaaaaaaggctgggcatggttgctcacgcctgtaaccccagcgtttttgggaggccaaggtgggcagttcacgaggtcaggagttcaagaccagcctgaccaacatggggaaaccccgtctctactaaaaatactaaaattagctgggcgtggtggtgcacgccggtaatcccagctactcaggaggctgaggcaggagaatcacttggaccgggaaggcagagattgcagtgagcagagacgcgccactacactccagcctgggtgacagagcaaggctccgtctcaaaaaaaaaaaaaaaaaagaaaccatattaaaaaaaaaaaaaaagcttgtgggctgagtctctaacttgtagttaaatacaagaactcagcttcctctaaaattttaattataaaaagtagaacagtgagatacactatttagtcatgcctattgagtggcaacaccagaaatcaagtctattaccagctcagttttaaatgtcccttgttacaaaatctgtcagtgtgtatcagccttttctgtacgccaatgatatatcacacttcatgtttaatggtagttcacaaccttatctgcagccaggagcacactaaacattttggaacatttccgtaggttacgctttttgaaagttatcctgggatgcttcccatctagttacgggtttagacatatttcatattttttcctacatataccacccccttaggttttactctgttaaatccagtattctgtacttttccagagaagcacgtacaaagatatatctagatccaatcattttgcttgagaaaagatgagatactctgatggttatctttacattttcatttaaaatggcactctattccttaggctataacagctaagatggcaaaactacttagaaataactggaccactatcacccaagccatttatagacactaatataaaatgtttaaaaactcaaaatataaatgaagtaaatatacgatatagttaagtattagtcacataaacaaaccaaaacgtagaggaaaactgacctccaggtcctcctccatacccattatagccatccccaaatccacgtccactgccatatccatctgttaggggccaaaaaaagattacgtttactataaactgttcagcattattgctaatattcattttcagttctcttactacctcagcacaataattaagaaccgcagaaaaggacacaccagtgctaccagtttacccacaaaacatgaaagcatataattaaatctaccgcctaaattttggactcttaacaagtctcaatcttagagattccatcctatttatacgtaagaatgacacttgatgggggtcaaagcttttcggatgacacttcatgttacattattaatccagataaatacaactgttattaatacaactctattaacttcttgtctggccaaatcacaagagcttgccaggatacaatctatttgaagtcttaggaaaattgacttaggttggatttcttgattctactaatgaaaacctaatcatatttaaaataaaagcacactcatcctttaaacacgtagaacttgaaactcaccagatcctcctctaaagttacttcctggtcctggtccgaaatttccaccgccaccacgtgaatccccaaagccaaagttgcctacaataaatgccccagttagaagcaagcccttatatatgaacaaaaataaagaagaaacagaattaaaattacctcctcttccactcctagaactctgaacttcctgcatttcttgtctagacaaagcctttcttacttctgcattatgaccattgatggtatggtatttctgcactggaatgaaaaattcagactccttttaaattaaatcaacaatattaagcagcttcaaaagtttacctttcaataaagttacagatgttaacatacacaaaattgaatacactggaaaaaaaca

SEQ ID NO: 2520 - DNA, 7370 bp, Homo sapiens
agaactcttataccttggcaccataataaataaatatttttgccttcttcaacagtagatgtcaaagcagctaattttgttgctccatcattgtgttagttcattcttatcctgaggaaatttcaaaagaaagcttgaaactgaagaccattttgcatgactcatgtaaagtttgttgaataaacaaaataaacccatggcagtgaaatcactccatgattagttggcagtagattttgttcaagaaaccctaagtcattttcttggtgcattcgtttgtccagcactgtattttttgcaagatggcagttaaaggatgcaactcactatcagagtgcaaatcaagtgaaaaaaaatcttatgttcatttattcattatgtaaatatctactgaacaccttgactctggtggtggccaattatacaagacaggcatggccatgccctcatggaacttttggcccagcttggaattgtcaaagaaacacaaagctgaacactagttaaggagacaagacggattctagtcagtactactgcagtaaggaagagacctcagtgaaacctcagctcagctcccctgagacaaaggtggtatgtgctaaaggaaagggactaaaggaaggtaagggggtggtctctgggtttaggccatctgagtttgttaattgacacttacctggaggagaaacaaaagtctcctatctttaggacaggacatagttttgccaactggattaaggccccgcaaagtttggatcttaccatcccacaggaactgggagacaagagagctatctcactgaatgtttgcatttcaaagagatggctcccacatacttgatgggacatttctgggtggtagaaggtttctatctcaaacgggcacagaaagaatatataattgcaagctttctaaagtaaatgccctaagaaagtgagctcagaggcctatcatcagatgttgtctgaaacaaacagtaattttttttttttggaaatggagtctcgcactattgcccgggctggagtgcagtggtgcgatcttggctcactgcaaccttcacctcttgggttcaagagattctcttgcctcagcctcccaagtagctggaattacaggcacccaccaccatgcccagctaactgtttgtatttttagtagaggtggtgtttcactatgttggccaggctggtctcaaactcctgacgtcatgatcggcccgccttggcctcccaaacaaacaataaattctttcggcagcattgagttttctcaggcaggcattttaagggggctggaattgtcatcctaggaacacagcctggaactgatgggaactatgctagtgtttattcaagacttttcctgtagtggggtggatgaaatcacttgtgctgcaagtcgtagttcttctaggccaaggtcaaggcctgcttgagaactctgaatagagtctggtcaaggagagtctttgtcccaacattggcagttaaaacaaggctcattgtgtctgcagtaagaatgtcgcgcaggttgtacactccacagcatgcctggccatgtgcagtggtctcgtgaccacagctgcttcagctgttcaaaaaatttctaataggttctcctcagtttcatcatggtcagtggacaaggtcccttctgtcctacccctacccaagatcttcaggtcccttactctcatttcagggcaagatgatgggagagttataagtgcccagggctgttggatgatttgtggtccacagtgcaggcggctgggggccccctacactgagcacagctgggccccatcttccttccagcctgtcctttagccctccaaggagaaggtctttgttacccctccccatccaggacaccctctctcccctgccacttcctcccctggacactgaaattctccataagtatacattgtctggcgctataggctgtggctctttctttctcctctttacattggactaggggagaaaacccatcttttggaaccggagagcaaattaatgtacagaggaaacacatgaactaatacttttagatgagctcctaccatgtgcactcacaagggagcattttaagggttctgatggtggagttctgggagccctgggaacagacaccaggaacgcggcagctgatctgccacggagtcaagaggatcttccgggaggctctgtcatttctgtaaatcaaggggttaggaagacaggggagaggagagggaaatggaatgcgaaggtaagggttggccaaaaaggtctaccgtgcttttttctggtcttttattttttgtctcttctgctctctattggatcaaacatattttgttttatagctttctttcctcccctcagtcccccactagcttggaagtaatgtgttctacttcaattctttagtggttaactttcattttttaagaggcgtaattaactttatgaacactgaagctcattaatctctgtattgtactctaacaccacaaaagccttacaatgcccagcttccctcccccacctcccatactgggtgctgggtgctgcttttatttccttctttttgtaaacttccaagtctggtcatttatcattatttttacactcggttcatatttaagtgaatcaaaatgtttgccagtttcatctcttcagatggtttcttaaatccagttcacttctagattcagtattctttgtgctgaaataatctttaagctatttagaatgaaaaactctctcggtctttgttatagctgagttaacctttattattgattgacagacttgctaaatatataattctaggatagccgttgtattttcacttggcattttgaatatattattgcattatcttccgaagtcctttgctgctttgtaagaaggtgcttttgcctaattgccattaccttttaaatttttatttttttatttttgaggcagagtcttgctctgtcgcccaggctggagtccagtggtgcgatctcagctcactgcaacctccgtctcctgggttcaagcaattatcctgcctcagcctacagactagctgggattacaggtgcatgccaccatgcctggctaatttttgtatttttagtaaagacggggtttcaccatgttggccaggctggtctcgaattcttgacctcaagtgctctgcccacctcagccaccaaagtgctgggattacagatgtgagccaccgcacgccgcctaaaattctatttttaaattgacaaataatattgtacattcgtggtgtacaaagtgatggatagtgatgcaatcaaggtaattagcatatttgccatctcaaacattcatcatttctttgtcttggaaatattcaataccctccttctatttaatagctatttgaaactatataatatattactgttaattgtagtcatcttaccatgctatagaacctagaactgatccctcttgtctagctgaaattttatgtctttcaacatacctctccctatccttccctccccgttcccttgtcagcttctagtatcctctgctctacttttaacctctatgagatcaacatttttagtttccaggtatgaatgagaacatatggtgcctaactttctattcctggcttattgtactttaaaaaacatggaatgcttcacagtttggcttgtcatctcgtgcaggagccatgcttatcttctcttactgttccaattctggcaggtgtgttgcagaaatgaacactgccattacttttgagataatctttcttctcttggtaattaaagtagttgtctttttatggtctgcagatttgttaagctgtacctttgtgtagatttatttaattcattctgattaggagttgtgatgttacctcaattagaaattccatttttctttatatctggaaacttcaccatcatcccttcaaacatcgctcctctcccattttctttttctgtttctggagctcctgttaacagataatggacattttcatttctcttccctattattgaaaccctcatattttccagatctttacctcttcatgtgacatctgagtgattttctcaaatcttttttccaatagactaattctctgaagtctgctctttcaaccttctattgatttctctatttcaatggctagacatttcattgtagaattcctttgcttcttttgcaaatcaacttggtcttttcccacagggtcctgttactgtcttatgactcccacatcttcctttacctcgaaacaatgaaaggtgacattcttattttaagtgttctcttcagctgttttattatcctgagttattggggttaaagtctcccggtctttcacctgctgcctctcctggtagttttctatcactgagagtccccagggtctgggcctggcagtatctccaggggagagctcacattcatctcttctgggccttgtaggattcagcagtttagggtaattttttgtgtcagctttcagctggggaagcaaatgtgtgtctttttactacccacacagtgtgagttctggcttcattctcattggtggtttaggtctaggacatgctcctcttaggcaattctgatccctcttaacctctttggagccaccgtttcccagggctggtggtcagtgctgtttctttccaccgaagcaacaagccagccctccaaggtgtctggcttccagcatggaaccggaggtctggattcatctccctgcaagagcatcagaagccacacactcttggaggctgaggcccggatctggctctgaaatacctgtgcctgcctctggcttccattttagccaagtcaccctggcttttagaagattttgcttcattcctggcacctcttttgatattgaacttggctatatgcacaaaacattacctcttatttagcatttttatgtatttgaggcaggtagggcagggttaggagtgggaggcgggcagcctttcatgccagctcagcttgccctgtggtgtgaggccccaaattgttttatgaagccagcgttaacagtggcatcagacccactagcccctcacaatcttgcccatgatcgccatcgtggtaaatggtttccaggcaagaccacatacggcacgctggccccctgaagacccatgctcccctgtcccctgttgctcctgctgatcagagccagagctgatgatgcctcgcaggcaagtgtcctcagccagggcctgcgggtgtgtgacactctgcaggcaccaggcatcactctgcttcctgagcctctcactctggatccggttctctgcctttttcaggccaatgactattattttatttctcaggggtatctcgcggctcctgtctcctctgtaaagcactgtcaaatttacaagagagcttctctctctctcctgtctcaaagagattagaatttgcaagaaagagcctccttgcccatttttttcctctgtgaaaaaagtttcagttggagagtgattttgcagccaggctacaactgggtaagatttgatggagacgtacagatgcgaagcctggagtatcaatgtctttccacaagtgctgggaaggagaaaagaaaattggttatttgagtgagaagaatgtggagaagagtggacatatctgaatgctggcaggaaggagctgaagcaaaatgagaggcgggcattccagaagagtgaagggagcattaatagagcaaatcacaagatgggccgggcattggcgttcaccccgaggtcatctgccgtgcccagtcccacagcatctctacttaaggtgaggtactcaatatgtcagagtggaactttaaccaaaggaacacagccaccactctgaactttgggctcttctccaaagcgaaggtgggacagagttgagagaaacttaaaatctactgctcttgatggttttaagtcaacagccggggactggcagtttcctggcctgagcggacccagccgtatgtggggtgtgagtgcagggccttccttcccacagaaggatccctgcagcttgtcccactgcctggatggggagaccttgctgaccaaggactctcttaactggaggggtttcatagaagttgatgtgtctgttgtcactgcccaaaacgaacttattgtggagataggtcattgaaaaggtgcattgtgatgaggtgagaataggaaaacttgcagagtatgaggccctgggtggctctggtagaacatcattaagaggggctcaggtcatcctgagacaggatttttgcatgcctgggccactgatagaagactcaagaaggatcaagtagaagtgagtgtgtgtgtgtgtgtgtgtgtgtgtggtattgttacagggcgtccttgctcccagagctcccaagatggtgttgggccacttccaagatggctgcaagcctcgtgttcgctaacctggggttcttggcctcatggattccaaggaatggaatctggggccatgcagtgagtgttatagctctattagaagccttgggtcacggaagagaaccatggaacccagtgactagtgttcagctcaattaggacaaacccgggcacttagccaagcaggaacaatggcaagcctttagcccaatccagagcagcaatgggcgcctcactggatcaggagcacagcagacaccctgccagatccagaggggtggaagtcagtagtgggtctgcaatggcggtaaatatcaatggtggacggcgagcgaaagctcaggtccagccgtgacaaacacggaccagaagagtgtgcacttgcaagatttaatagagtgaaaacagagctcccatacaaaaggaggggacccaaagagggtagccgatgccggctggaatgcctgggtttgtatcccggtcattgtattgtccctcctgcagtgctctcaggcgatagatgattggctatttctttacctcctatttttgcctaattagcattttagtgagctctctcattagtcgggtgtgagctaagttgcaagccctgtgtttagaggtggatgcggtcaccttcccagctaggtttagggattcttagtcggtttaggaaatccagctagtcctgtctctcagtatggaggcaggtaggctaaatatcaggatgaaaaatccaacctttaccattttatgtaaataaaactgcttttggcttattcaggcagttcccattgtttaagttccatctgacacatcacctttctcctccgtgaatgaatgaaacggttctgtaagtatccaagtgtgaatgctccatgcgggcaccctgtggacgctagggatgcagggagagttaggattgatcatctctgt

SEQ ID NO: 2521 - DNA, 16434 bp, Homo sapiens
gcagtgagtgaggtcacctagagcactcttggtcaattttgctgacatcactgccttttcctggggatagtctaggagagcatcagtcagtggggctgagttgggagtgctgtggccgtcagggctggactgtgggcctgtgcttgggtcctgggggaggggagggaacggtggcccctgcaaggccacatggccagacatttttatcctccccatcttatatagttctgtcattgcaaactcaagtcttcctgatttgcctgtgtgcctgtgtgtagcctaagggcacaggcattggccccgggccaggttgccaacttccaccctgccctgctggctcctgtccctcccatgcactctgtgttccagctcaggagagtggagctgcccgggtgccttggtctcctctgggtggccccgtgccaggtctggtaggatggggacacattgtggtcattctgatgccccagcctgtgcagaggtgaagccagagacagctggtgctctggctggggttagtggctgtggcaaggtgggcccgactgccgactcttgcctactgtgcccagccccctatctggctctgctctcttgcagctgcgcaccaagctgtcatcacaggagatccagcagtttgcagcactgctgcacgagtaccgcaatggggcctctatccacgagttctgcatcaacctgcggcagctctacggggacagccgcaagttcctgctgcttggtgagtgggccctggaaagagggtggcttgtccaaacctggcttggagaggctgatccctcctgggaatgtgcacacggacccctcagtgggtgcagcaggggctccatcagggatgggagatttgaaccagagatggcatgagagcagagtccagagatcggggaatctgctgtgattagtcagaagggcttttcccaggtactgttgggggcccaccgacaggccttcattctcctgggaactcaagctgagctgggtgggccctgccaggaagtagcagagatcccccaggagcagggctgggagtgaacacaaccctgagatttaggaaaacagtgctggaggagccagagaggcatgggttttggtgaatgtgtaggacttcaaggcggaaggaccagcgtttgccaagacccctaaaatgctcggcacattaggtcagtgcggctagagggctgtgtggtctgagcagcagagttggatgttggccccacacctctcaggggcggtgacttagctgtggtttccctctgccgacacttagaacacagcaagtttgcggtaatgtgttgctagtagccagttgaaggcttctgggtcctggcctgttttccctgcaaaccaaggaaggtgggtttgttaaccatcgtaccgacctggcagtggcaaacgtggattgcctgcccagggctccccgctcttaggagcgtgaagggctggaggctggggcagcctgtctgtacaataggttctgtctaagcagtgcctgccccttctgtgctgggccctgcgttgcctcctggcatgggactctgtctgcccctccacatcggggagtagagattctgagagacacactaggcttcccaaataagagggcagccctctgagttgggacagtcacctaggtcatggcagggaaactggactttggcatgaggcctgcctctgaggactgcacccttgttgccgggtgccagcaggtggctttgagcactgctctgggcctcagctttccccactgtaaaatgggtcctttgtgaggactaatagagaatgagaggaggccacaggttcttggcctgtgctggtgccttgaggccagggagtgtgcatgtggcagaggcagtaagctgtcagggccagcagcagtgtctgtcaagagttgaggttttagccaaactgtctggccccaggaagcatgatttcaaccaggatgctagatgcagtgagcatggcatcagggtccccaaggccatgcaccaggggcagctgtggccctgtcagggggctttgagccctgagagaagagctgagtgggctgagccgaactggaggtgccatgctgggtgttgtgtgtctgcaggtctgaggcccttcatccctgagaaggacagccagcacttcgagaacttcctggagaccattggcgtgaaggatggccgcggcatcatcactgacagctttggcaggcaccggcgggccctgagcaccacatccagttccaccaccaatgggaacagggccacgggcagctctgatgaccggtcggcaccctcagagggggatgagtgggaccgcatgatctcggacatcagcagcgacattgaggcgctgggctgcagcatggaccaggactcagcatgatggacagtggatgggggggcacccacaccttccgcgcagtcgtcataggccttcccagaaggagctgcccagacctgcgtgtcagcccttggtggtggccagggagaggcgcccggtgcagatggccccgggcggcccaggtcctctactgtgaaggagcagggagctgccgagggacacgagcctcagtgcggggtggaaggctctttgccttgtccaccagggctcagccaagccctgcagtgtgtccccgctcggggagggcccggccgagcgggcagggagagccagtcctgtcggctgggcccttggacggctgtcagttttgcacatgatgttcctattgtaactctcagagaccttaaaaagaagtttactgcaatgtgaataatttaatctctggttgccaagcatgtttctgatccagttgggtgaaagccatcggtgccaggaggggtgtccgctctagcctctgtccctgggtccccatctgccctgcagcacctgggactcggcagtggtccctgggggctggggtggaggaggcaacaggctcttgtgccacaggaaggacttgatttggacttgagcagtgtggatgtggggcaggagcgggtgttctgaggcctttcgtgggcagcgtgtgtgagggtagcgtgtgtggcatgtgttgggggcaccttgatctttacatcctgtgcactgaatccttcaaggtcactggctgtgccccgcaccccccctccccccaaccccatgctgcaggttttttcctcaagcagcctgcactaccccgtggaacagaaatgctctctgagatctcgtcaccttggagcctgggggctgggtcttcagaggccagtgtgcaactctgccgaccctccctgtgccgtcattgtgggcctgtctccatccttgtcccgtgagctcttctccccaaaccctgttggccttggtcttgcctataccctttgggcccttacaaagcttccttggatatgggaaggggagaagaggtgacctgggtcaggttgtccggagcctctccctccaccggagagcagccacaaccctgcggagacccccaaggggacagacatctaggaaggagactggctgtcacatctccctcctgcccaggctgggggcctagccttgctggatggaggggctgcatgtcaggccccagggattctctggcccaggcttggggaagcagggagagcctctggggctccatggacaccctgattgtgtccaggccaagccagaggatctggagtatctcaggcaccttcctgaataaggtagacgggtttgtatggtatcacagcttctgaacaggaaggggcctggtcggtgtttttttgtttgttttgttttgtttttctcaagacagagtctcactctgttgcccaggttggagtgcagtggtgcggttttggctcactgcaacctacacctcctgggttcaagcgattctcctgtctcagcctcccgagtagctgggactacaggcgcctgccaccacgcccagctaatttttgtatttttagcagagacggggtttcaccatattggccaggctggtctcaaactcctgactttgtgatccgcctgcctcccaaagtgttgggattacaggcgtgagccaccgcggccggcccggtcagtgttttatgggcgagtttttccactgtactgggctgttgtagagctgcttactcatgggaccccaggccagggcaggcagcaggctctttactgttgacactgtctcttaagtttacatgaaaatggacatgccctggaagcatcaggagaggctgaggacaaaccacacagtctcctgggctcttgccccctaccagagcccaccctgtgccagaaggttcagtgtcccccttccatccctctggttgaacatggccttgcatgggccttctgtgtggagtgtcaaaggaaccacatgcttgcccctccagggtccatcccaggtgtggcccccgtgctgcagtcgctggtctttgctagcagaaagagtagaggacatggagcagatgaagggacaccagagggtaatgaggggacaccagagagtaatgaagggacatcagagggtggtgacaggacaccagagggcagtgaggggacaccagggagtaatgggacatcagggagtgatgggacatcagaaggtgatgaggggacaccagagggtggtgaggggacaccagagagtagtgaggggacaccagagagtaatgaggggacactagaaggtgaggggacaccagagggcggtgaagggacaccagagagtaatgaggggcacgagagggtggtgaggggacatcagagggtgatgggacaccagagggcgatgaggggacaccggagagtattgaggggacaccagagggcagtgaagggacgccagagagtactgaggggacaccagagggtggtgaggggacaccagagagtaatggggacaccagaaggtgaggggacgccagagggcagtgaagggacaccggagagtattgggacaccagagggcagtgaggggacaccagagggcgatgaggggacaccagagagtaatgaggggacatcagagagtaatgaggggacatcaaggcggtgaggggacaccagagagtaatgggacatcagaaggcggtgaggggacatcagtaatgaggggacgtcagaaggcggtgaggggacaccagagagtaatgggacatcagaaagcggtgaggggacaccagagagtaatgggacatcagaaggtggtgaggggacatcagaaggcggtgaggggacatcagaaggcggtgaggggacaccagagagtaatgggatatcagaaggcggtgaggggacatcagaaggcggtgaggggacatcagagagtaatgaggggacatcagaaggcggtgaggggacaccagagagtaatgaggggacatcagaaggcagtgaggggacatcagagagtaatgagggcacatcagaaggtggtgagatatcagaaggcggtgaggggacaccagagagtaatgaggggacatcagaaggcggtgaggggacaccagagagtgaggggacatcagaaggcagtgaggggacatcagaaggcggtgaggggacatcagagagtaatgggacatcagaaggcggtgaggggacatcagagagtaatgggacatcagaaggtggtgaggggacatcagaaggtggtgaggggacatcagaaggcggtgaggggacaccagagagtaatgaggggacatcagaaggtggtgaggggacatcagaaggcggtgaggggacatcagaaggcggtgaggggacaccagagagtaatgaggggacatcagagagtaatgaggggacatcagaaggcggtgaggagacatcagaaggcagtgaggggacaccagagagtaatgaggggacatcagaaggtggtgaggggacaccagagagtaatggggacatcagaaggcggtgaggggacaccagagagtaatgaggagacatcagaaggcggtgaggggacatcggagagtaatgaggggacatcagaaggcggtgaggggacaccagagagtaatgaggggacatcagaaggcggtgaggggacatcagaaggtggtgaggggacaccagagagtaatgaggggacatcagaaggcggtgaggggacatcagtaatgaggtgacatcagaaggtgaggggacatcagaaggcggtgaggggacaccagagagtattgagacaccagagggtggtgaggggacaccagagagtattgcggggacaccagagggcagtgaggggacaccagagagtaatgaggggacaccagagagtattgggacatcagagagtattgggacaccagagagcaggggacaccagagggtggtgaaggtacaccggggagtattgaggggacaccagagggcggtgaggggacaccagagagtaatgaggggacaccaaagggcagtgaggggacactggtgagtattgaggtgacaccagagagtaatgaggggacatcagagggtggtgaggggacaccagagggaagtgaggggacacagggtgatgaagggacacaagagggtgatgaggggacaccagagggaagtgaggggacacaagagggtgatgaagggacaccagagggtgatgagggggcaccagagggcagtgaggggacaccacagagtaatgagtggacaccacagggcagtaaggggacaccagatggtggtgaagggacaccagagggaagtgaagggatgccagatggtgatgatgggactccagagggcgaggaggagacaccagagggcaatgaagggacaccgatttattgagtagcagagctgagggaaggcgtaggatggctccagcttccggtcagtggctacatggtcagttcctgcagaaagagatggtcatgttgggggaagcaccccgcagtggagccaacatcaggacctctcgaggcccttggggacagctcaggggtagggaaaggggccagtgctcactcaccatgatggcgttgacgatgtcactgtggttgtctctcagagcccgcacggccttggccctggacacattggcctgcgccatcaccagctcaatgtcacgcagttccagccccgcctcgtccacctggagttgggggagcagggaagtggctggagctgcttgaggtccctggggcagagcccccatgtagcgcctcccaccaccccctgcgaggccctggagcccctgcacttcacctcttcctcctcctcctcttcctcttccttgcactccagcctcacccggggcctgggtgctgactcagggaccaaggctgagggctctgagggcaccttaaacttctcagctgcggctttgtgcacttgctgggacaggtcctcaatctgcaaaatggaagacagctgtgtcagtagagcctgtcccccccttgtcccctatccctcggatcccccattccaccacagccgccacccagaccttggcctcgccaaagaccacataagtgtctgaggctgggctcttgaagacatcaggcttggcgatgacaaagaggatgttcttggacttctggatggtgatcctggtgactccctgaatctgccgcaagcccagctttgacattgcctgggagtagagggcagaggggggctcagacctggtgttgacccacgtcgggggaggagagcagcacagtgcccaggaaggcaaagtctccaccgccaacttccccaagaccttgggctggtggttggtccttccccatgagcctcagtctataagggccttctcatgacattccagcctcagctgtttaggggaaggtgtgtgggttactggcatggacccaaaggtcccctgatggatgggatttcattagccatggagtgtgagggtcttggtaaggacgttccccacacagatggtcccaggcctgaggtcccagagggagccaccagcccacctttcgggccttcttctcactgcgactctgcttggctttggcgatggtctcctcactgccgcctgctggggcctgagaaaaggtgagggctgagcatccatgggtggggtgtggggccctcccagaggcccaccctcttccctggactgggcacctgggctggacactgcacggtctgaggagccaagatgtcctgctcgtccagctcggctgatgactccccgtggctatccgaatgctggcccgagcccagggcccgaggcgagtctggggaaggggagaggtgtgaggatggccttttgcttctaggtggcggggaagggggttcaggaccctggccctgctgccacatcagggccagaggaagcagtgccagctctccatggtggctgtggggtctgggccccccacctcgccacctcagaggccctccagctcaggacagctctaaggaggagtccagttgacccaagccccagggcacttcactcccaccctctgccttaccttcctccaggctgtcctcatcctcttgctgctcgggggctgagagcccttgagggccagctgggctctggggcccagagggaggaggcacttggcaaggcggcaagatctgcaaggccaggtctttggcatccatggaggccaccttggggctgaggagtggggagtgaggcgagaggctgactcgcggcccagtccccagaggctgtgtggttcctgagacagcagcagcggcaggctggactcctgcctggggcggtgggaggcccagagagcctgggggctcctcgtcttccacagagtcttcctgggggtcctggcacaggcagggggctgggggctccagtgggggtagggctgccccagcaagggtaccaggagcagaagggtcagggcccaggggcctgtccacgggcgtgctgggctgacccttggcaaggttttctgggggctgcagcaagggggtgccaaggacactgggtacttcgtggggttgctcaacactgcccagacccagtacaggctccggctgctgggaggttggtgcagacgtgggggcaggcgcgtcagggcagcctctgtccagactggacacagcccctactgaagactctgggcaggagtccagactggcctctgtggccacagctgagggaagcgtgggctccggggtggacttgccactcaggcctctttcctccctggctgggctcaggagccgggcctggctgacctcagggcaggcagcaggaggcgcatcggggacctcccttgcacctccaagtgctgacctgggtccatgttcctgtgccagtggcttcaggcctccttcctgctggttctcaacctccagggtctccttttggggtgagtcaggcttagccccatcacctgtgtgcgctcgcgcttccagacatgcttcccgtccaggcctagaaagggcttctgctatttcctccccagcaccagaggccggctcagggagactgagggcctccatgcccaaagtggaatccgcatcttcctgtgcggcccaaggtgtcccagcttctgcagctggctgtgggtcatcctgttggacctggtccaaggctgcaggctccgggactgtagggagggctgcattcttctcctcaggtgctggcctggggcctaaggcctcacctacttcctgctgagccatggtggccacaggctctgtccctggggcacagcctgcttctgcctgcaaggtttgaggggtggccacagccagaggctctggacctgaggtggggcctgtgtcttgcagaggcagaggtgctgtcatagcggagtcctggggtaaggtgaggccctcttcagcctgctgggacacaggcgtggctgcagccacaggctttggggctgacgagagatctgtgtcttgtaggggcagaggcggtgtcatagcggagtcctggggtaaggtgaggccctcttcagcctgctgggacacaggcgtggctgcagccacaggctttggggctgacgagagatctgtgtcttgtaggggcagaggcggtgtcatagcggagtcctggggtaaggtgaggccctcttcagcctgctgggacacaatcgtggctgcagccacaggctttggggctgacgagagatctgtgtcttgtaggggcagaggcggtgtcatagcggagtcctggggtaaggtgaggccctcttcagcctgctgggacacaatcgtggctgcagccacaggctttggggctgacgagagatctgtgtcttgtaggggcagaggcggtgtcatagcggagtcctggggtaaggtgaggccctcttcagcctgctgggacacaagcgtggctgcagccacaggctttggggctgacgagagatctgtgtcttgtaggggcagaggcggtgtcatagcggagtcctggggtaaggtgaggccctcttcagcctgctgggacacaagcgtggctgcagccacaggctttggggctgacgagagatctgtgtcttgtaggggcagaggcggtgtcatagcggagtcctggggtaaggtgaggccctcttcagcctgctgggacacaagcgtggctgcagccacaggctttggggctgacgagagttctgtgtcttgtaggggcagaggcggtgtcataacggagtcctggggtaaggtgaggccctcttcagcctgctgggacacaatcgtggctgcagccacaggctttggggctgatgagagatctgtgtcttgtaggggcagaggcggtgtcatagcggagtcctggggtaaggtgaggtcctctttagcctgcctggggacaatcgtggctgcagctacaggctttctgccagaggggaggtccagccctccttcttccttcaagttctgaggagagtctggacacaatgtgaggcttgtttcttcctgtggagttggaagtttttctgcagtgacagactcttggcctaagatctcgctgatgccctcctgggagggctgaggcattgccatggcagcagattcttgtccagcggtggagtctgtttcttcctccccagcctgtggggtcactctggtagccacctccacctggaggcctggggctacctgcagagtgtgaggggtcacagtggcagtggactcctggcctaaagcaaggccctcttctgttacttctgagatcaattcctgtctctgggacagataggcccctctgtctgaggtctgaggagcagcctccacggcccaggacacagtcccatcctgagcctgcagccccttggccccacctccgctctcctcctctgtcttctggacactgtcctggagcaaagtggcctgggcatggggctccccgctgtacagcctctcatcatctgcctctgcgtaggaggctgagtctgaatcagaggaggctgcagaggtgtcgtcccggaaggcaaaagcctcgtccatgccctccgtgatggacaggtcagacagtgactgcaggaaggaggcagacgtgctgtcctcctcaccctccccagccaggtccccacctgggtcgggatccgccacagcctcctcttcttcttcctctggggatagcggtgtcacctccactgcctccacctgaaagatgaggctgccctggaagggtaggagggctgcggggatcattgggtcattggccaggaagtccaggtcgaagaagtggccctcctggccccaggaggagctgctgtctgcagagaggctggactcagaggacgggggctctggggtccctgctgggtgcagctctcgttcatccaccatggacccctgcggggacaggccccagcctgaggggaagtccagcccttcagccggagccagcaggctgagggaacaggagggtgaagaggcccagctgtccccatcggccgtaatgtaggagcccgagggtgaggcggggggcgagtccagcagctcatcccgcagctcagcctctgagtccctggcgtccccgtggggcccacaggcaggaagcagggcataggtggtcttggtgggggtggagggaggcgtgaagaaggaatcagggtctgggggaggggaaggcacagaaagatcaccctgagaacacagctcggggggtgggtctgggcttgcgtgcccaccctcctggtccctgagcgctgtccgggcagctctgggtgacaggagggcctggcacgtctcctctcccatcacaatccggggctccagggtggccgggagaggagcctccgtggacagagcctgggaagacaggccctcagggaggagcatggggcttgggccgccctcccctgggtccgcccaggccgagggtgccccaccaggccctgcatcccagctggctccctcgggctggggccgggcacccggcttgctgggcaggaacgtgagggccaggtggctgggccctggggtcagagcacagggctcccgccggtcccctcccaggatggtggtggcagcggccgcatcgcaggacagatctgtggagatagagaagatcatgaggtgcccctggatgcatctcccaggcaagggccaggcccggggagatgaattccggctgcatagggcccagaggaaggtggatccaggaaggcaggagagaaaagagaagaccctctgcacgctgcgtttgagggagaacttccaggagttttgacagcagagagcagatgctagtggtttcctagagaggggttttgagggaagtgttgctgggagtcatgaacagacctgtctggcggcttttctcaaggacacctcagcaaagaactagcatttcagcctctctggggagactggattgcagtttccattccacagaatcagtgtggttcagctgggctcggtgggaggggctggtggtgggaatctgccaggcagtgccagtcccatcccatgacctcccaatagatgcgccacatgaggcaggtggcaccagcacgacgcgcgcagctcgaacactctgggcttcatgcctcgctctgcctcctctctctgctgtccttgctacctacacttgaggccaacatgtcagggtttcaccaggcccctctgaccctgctcccctcctgcacccagggagatggggaagccaggggccaccacacgcagccaagtttctggagaacagagatgaagtgtcccgtggaggctttgctggagcatctggccacaagggcagtggtgggcaggaacggagaccatggagcccagcaagagcacaggacagcttcagagggccaacagcagcctctggctgagtcctctccttggtggcagccaccccatgggtgaccaccagttccttcccgggtgctgggagttcccaccctgccctgtgggccttctctgggtcccatgatgcactcccccaacccgctgggcaggcttcagtatgaggaggctctggtactcagtaaacgtctgtgagctaacacacctccagctgagaaaggagtccataggaagtagccctcatgggtcagaaaggacttaggggactcaggaagatggaagaaaacccctccgaggttgcggcacaccagaccgctatggttttctgcctcctggactcttactggcctgtattttatcacaggcgagatcacattgcacattcagttttgaatctagctattttcacccaacctaatctcataagcattttcctgtgtgctctaaatgctcataagcttcattttaaatgtctccattatgtccactccctcacttggacctaggccaaaggcacctctgtttgaagcatccaatgaaggcccttcagagcccaggccaggtcttgcccaaggtgggggagcggcggcacacaggggccagctctccaggctgcagatgcctgcctggtggctcctgctctcccgcactcactggtgaccaggacaacatctcttgcacctcagctttctcatctacaaagcagagccaggattagagttgaagctgaaagaagggggaccctgttgccaggctgctccagctcccctcagcagcatcagagccctgagccctgaaccaccagccaaaacttgtcacccaagggctttgctgctggggtgatgggacatccagggggtcctgagacaagggggtcctttgggttcttgcatgcctgacacccaacatcaggagtgggcgtggctggtggggcatcactgggtgccctgaagctgggctcttggttctggcccctggtgtggcccccagggcaggggaacggctgagctgttgggatggagcagaaaccaaaggccaaaggtttttataactcattcaaggtcaccaagcaagccagaacagagccagcacaagaccctggggctgggaagtctgggcctgcactccctgcctcccacctagagcagaggcagcagcctgtgtcaccccaaaccaggccccaggccccagcagtggtcccatctctgggtgacttcttgcccacagcaaggtgcccttggccctacccacacatggctgacctccacgccaggactgtccaggctcggctctttctaggccccgtagaccccatcagcctccaccagcatttgttgacccagcctaaggacaggtggtctgcacacccagggccattgctaatcaggccacctcccccaaggccttccaccttccagacccaacttaggctttattccaccacctggccctccatccgggcttcctaggctctggccagtcctgctcctccctccagagccatgaccagtcgccggcccaggacagaccgggtgcaactgaggaccctcccggtggtcacctgatcgtactgggggtatcagccggacaccccgcctccagaacccgctgcctctgtccagagcggcccagccccagcaggctggcagctcggtgcaaacaacgggatgcagcgggcgggatgcgagccccacgatccctgggtcggaagccaagggcttaagcccccacgttctttctggctcgcggcgggcacttcgtgcgccccaccttccccgcagttctgagagaggcggtagcagggttcagatggagggaaggacagggcgcggaaaggggaggggactcgaggggggccagggggatgggggagaggggtgaaaggtgagcgatggaaagagaacccgggctggagaggggagaggctgaaggcagggaaagagtggccacggcctcacctgtgcggggcccgggtcggtccgcctcgggcagcagcagctcggcgcgggcagcctccccaggcatggcctggccgtgcgcccgcccgtccctcagtccttccgaccctccgtcagtccgtgccgccgccccgccgagcctgcgcggccaccgcccctcggccgggcggtgggggcagtgggtgacgtcaggccgccccgcccgcctgtcccagcgagtgagcgtgcgcgggctcgccaggcactgcggagggcgtagggggggctccctccccgcccccaccccacccggctgtggcctccctctcgctgtgggcggtttcgtgggggagcgggggtgggcgcctgcgcccggtcccaccctttccacagcatttacgagggagggtttcagggccaattggaagctgggttgcctcagggtggcattcgcccgtggccaggaagaggcggggacgcccctagaaccctggttgtgggaggctggggaggtggttgggattctgggatgctcggagcgctttgggtggagttggcggcgcagcctccttccccgctgaccaagcagagggtgcagggcctggggagggagggggccccgcccagcccgatgcctccatgcaaaaggtgagctggagctgcagctctggagtgattggctggtcctggcagtcgtcggtctccgtggcaaccgcctcctgtctccatggcaaccagggatggagccgacgagagcgcaccagggaaggcgacccggatgggtcggtctccaggtctctaggcaactcggtgatctgtcctatcatctcccctccacccccacactaggcagtagaaggaaaaggaagaaagtgtttccctctattcctggcagcaccctctgccacacctcccaggaggaagcccgccccgtgaatttcctgaaatgcctcttgctttcacacaggctactgcgccacccagattcactgagcacccctcctcccccgtgccaggcaccagggagacagatgaatgagacattgtcatcacccctgactggggtggggggaatcagagtagccattgtcacaggcagggagggaggtttcaacatcctcagtcttctgtgggttctaactttgagctcatgaagccaggggctgccctctgactcccccagacctgcctcaaggctcagtgctacacacctggctgcctgctgggcatctctccccgctgtaccccaggagtcagacacaccacaccattagaattaacatcaacttcaaacaatctc

SEQ ID NO: 2522 - DNA, 11094 bp, Homo sapiens
ggtcaaatgaaaatgtactttattaaaatattagtgttcttacagattaaatctgaagcacagcaatattcagttctcaggacagttctcaggatagaatgtaaaagaatgccaactcctatcagtccaatagaagtggaaaatcagagctgatattcaaaatttttcctgcatagaaccttagatgttttcagaaagaaaaaaatcaataaggaagtgcttcagtgatcactctaactgcaaattttacccatctccagcctaattcattaattttaatatcaagcagagccaccaccagtgcttatagtacctttgtgcatactagaaaaaaaaaggcagatgttggcctgcaggcttttggcttagcccaattctacctaatagccttgactaaaaaggcagttttcaagtgtgtgtgtggaaggtagggtgttaaaagaggaaaggagaggaaggccatcttcacaacgaataaagtaggagaaggaaaaaatccgttttacctaaagaggggtagttgattaatttaaagtgaaatcaagtagaacaaagtgcctgatggcataatcacaaagaatatccagtctagaatgtctgtgcggttttgtaagtttcattaataagtatttattaaatataaaggaattccctattctatcttgtcattcgaaaaataaaaccaagaaaaaaaaacttctattttttaaacttaaaatattcaattaaaataatttagtcagaccaagtagtttatctgcagatttacagaaatactttcaatcccatcactttagctcattaaatctgcaatgtaattagagaataaaagctgcatacttacataaacagttgatttgaggtcttcaaatgctttcaaaaatatgcaaggtttaccatctctgcttgtagatgaagaagctaaaaaaacaataaatctagccactgcaatggtgtcctacatagaaaaaaaaaagtttttgaatcaatcaccaaaatacgtataatttggaatgtcatataaatccttatttatattattatgtttagaataaaaattacctctataaagtagaaaactggttaacctaaacttgtttaacacttgctgaatacattatttagactaccacttcctctaaaacatcttcaacatctacagctacaatatagccacagatgacaataacgtcccacttcatggaccaggaaaatgctaaatcactaagaaagttttatgtagtgaaactcagatgttccaatagtaataaggatggaatttaaatgaaactaaatctcaaagttgagaaactacattgagaaaggcatgacagtgcaaaaactccacatattacaaaactaatatatgtgcatacaaatacagggcatggacataataagaaatttccatttatatactaataagaacaaagatattttctttctacttaggtttgtaacagtagtaagaagccattctccatttatcccttcctctctcattctttaaatttccttttcttattttccaaatactaaaacagaaatactaaaagagttttgcattgctgcatatatatttttcattgtcttactcccttaattttaacaacgaaaccttaagatacaccaaaatgtctgggcttttggtcatcttccttcaataatttaaaactctatcaagtggaagtcttctgcattaccacagtgtgctctgcacatacaagggcctggtgtcaattctcacaatcctctattcagatttaataattggactgagagcatactgaagatagtggtcatttctaattctgctctgtatttacaggacttggcacaaagcaggccctcccaaaacaaactgtctatgaatcaaacgaaagaccttattttgccttttctaaaaatctcttgccctaaccaggtattgtagctctgcaattcctgcgtttttttcttcacatgagattgcaaacataactgagtgtatgctgataatgccaaattaccacaactcttcatagttcaatgggagaaaatttttcttcttactgaagattttatatttctccgaaaccttttatgcagtttaaaaaaataaaatgaacatgtttctggaataaaaataacaactgagttaccttttttcagttttacaaactgaagtatacactctgttttcaagtgacctcaaaccaatacattctgattaaatgaaaacttgagattttagtcaaagatttaaagttgtttatcaaactaacaccggaagataaacagaagtagggaagccaacagtttatcagttctaaattatccaagtagaaaaaaaaacctacctcttgttatcctctgttccacttaaaaatgttttcaaaagtaaatattatacaccaaatgcaaatgttagagtacagatgaccattttttttctattttcctgtagattctaaacttttttaaaagactgagtatgtatgcatttcttttatcatgaagaaaaattttgaaaagaataaatgactaaaagctggacatcagcattcataagaaaaatttttctgaatttaacagtagctacacacaattcagtaaaaagttacaacccttcctctggcatatattcaacagcatggaaataacaatcacagttttttttaattgaaatgcatttattatattcataaacatggatttatatttgaatatacatataaaaactgcattgaaggcccttcagtgatctcatcccaagcaactctgcctgttttatttccacatacttcccattcaatattagacaaattggatcctctcataagtatagtgcttttccacatatattctttatttattttgagccactgctacaaataaataacatgtttcccatctgtacatatctgacctaatctatatttcaaagtctagccttcttcttcctggtagaatctatcacagattctctctcagaaacaagtaattctaccttcctctaaactctcctatacagcgttttagcatttttcactttgtatgttatttacaaacttttcttaatgcctttaaagcccttaaagtcctgtaagttccttggactgaaagtaatggagatcattccaagatggccgaataggaacagctccactctacagctcccagtgtgagccacgcagaagacgggtgatttctgcatttccaactgaggtactggggtcatctcattaggacttgttggacagtgggtgcagcccatggagtgtgagctgaagcagggcagggcatcgcctcactggggaagtgcaaggggtcggggaattccctttcctagccaagggaagccatgacggtcagtacctggaacatcgggacactcctgccataatactgtgcttttccaacggtcttagcaaactgcacaccaggagattatatcccatgcctggctcatcaggtcccatgcccacagagttttgctcattgctggcacagcagtcccagattgaactgtgaggctgcagcgagtctgggggaggggcttccaccattgctgaggcttgactaggtaaacaaagcggctgggaagcttgaactgggtggagcccactgcagctcaaggaggcctgcctgcctctgtagattccacctctgggggcagggcatagctgaagaagaggcagcagaaacttctgcagacttaaacgtccccatctgacagctttgaagagagcagtggttctcccagcatggagtatgagatctgaaaatggacagattgcctcctcaagtgggtccctgacccctgagtagactaactgggagacaccttccagtaggggccaactgacacctcacacagctgggtgcccctctgagacgaaggttccagaggaaggatcaggcagcaacatttgctgttctgcaatatttgctgttctgcagcctctgctggtgatacccaggcaaacagggtctggagttgacctgcagcaaattccaacagacctgcagccgagggtcctgactgtaagaaggaaaactaacaaacagaaaggaatagcatcaacatcaacaaaaaggacatccacaccaaaaacccatctgtaggtcaccatcatcaaagaccaaaggtagataaaaccacaaaggtcaggagaaaccagagcagaaaagctgaaaattctaaaaatcagagcacctcttctcctccaaaggatcacagctcctcgccagcaatggaacaaagctggacagagaataactttgatgagttggcagaagtaggcttcagaagatcagtaataataaacttttccaagttaaaggaggatgtttgaacccatcgcacataagctaaaaaccttgaaaacagattagacgaatggctaactagaataaatagagaagaccttaaatgacctgatgaagtggaaaaccatggcacaagaactacatgatgcatgcacaagcttcagtagttgattggatcaagtggaagaaagggtatcagtgactgaagatcaaatgaatgaaataaactgagaagagaagtttacagaaaaaagagtaaaaagaaatgaacaaagcctccaagaaatatgggactataagaaaagaccaaatctacatttgattggtgtacctaaaagtgatggggagaatagatccaaattggaaaacactctccaggatattatccaggagaacttctccaatccagcaaggcaggccaacattcaaattcaggaaatacagagaacgccacaaagatgctcctcgagaagagcaacctcaagacacataactgtcagattcaccaaggctgaaatgaaggaaaaaatgttaagagcagccagagaaaaaggtcaggttacccacaaagggaagcccatcagactaatagtggatctctcaggagaaactctacaagccagaagagagttggggccaatattcaacattcttaaaaaaagaattttcaacccagaatttcatatccagccaaactaagcttcttaagtgaaggagaaataaaatcctttacagacaagcaaatgctgaaagattttgtcaccaccagacctgccttacaagagctcccgaaggaagcactaaacatggaaaggaacaattggtaccagccaatgcaaaaacatgccaaattgtaaagaccattgaggctaggaagaaactgcatcaactaatgagcaaaataaccagctaacatcataatggcaggatcaaattcacatataacaatattaaccttaaatgtaaatgggctaaatgctccaattaaaagacacagaatggcaaattggataaatcgtcaagacccctcagtgtgttgtgttcaggagacccatctcacatgcagagacaaacataggctcaaattaaagggatggaggaagatctaccaagcaaatggaaacaaaaaaaagcaggagttgcaatcctagtctctgataaaacagactttaaaccaacaaagatcagaagagacacagaaggccattaagtaatggtaaagggatcaagtccacaagaaaagctaactatcctaaatatatatgcacccaatacaggaacgccgagattcataaagcaagtccttagagacctacaaagagacttagactcccacacaataataatgggagactttaacaccccactgtcaacattagacagatcaaagagatagaaagttaacaaggatatccaggacttgaactcggctctgcaccaagcggacctaatagacatctacagaactctccactccaaatcaacagaatatacattcttctcagcaccacatcgcacttactccaaaactgaccatagttggaagtaaagcactcctcagcaaatataaaagaacagaaattataacaaactgtctttcagaccacagtgtaatcaaattagaactcaggattaagaaacttgctcaaaactgcacaactacatggaaactgaacaacctgctcctgaatggactactgggtacataacaaaatgaaggcagaaataaagatgttctttgaaaccaatgagaacaaagacacaacataccagcatctctgggacacatttaaagcagtgtgtagagggaaatttatagcactaaatacccacaagagaaagcaagaaagatctaaaatggacaccctaacatcacaattaaaagaactggagaagcaagagcaaacaaattcaaaagctagcagaaggcaagaaaaaactaagatcagagcagaactgaaggagatagagacacaaaaaacccttcaaaaaatcaatgaatccaggagctagttttttgaaaagatcaacaaaattgatagactgctagcaagactaataaagaagaaaagaatcaaacaaatgcaataaaaaatgataaaggggatatcaccactgattccacagaaatacaaactgccatcagagaatactatgaacacttctacgcaaataaactagaaactctagaagaaatggataaattactagacacacaccctcccaagactaaaccaggaagaagttgaatccctgaatagaccaataacaggtactgaaattaaggcaataattaatagcctaacaaccaaaaaaagtccaggaccagacagatccacagctgaattctaccagaggtacaaagaggagctggtaccattccttctgaaactattccaatcaacagaaacagagggaatcctccctaacttattttatgaggtcagcattatccttgtaacaaagcctggcagagacataacaaaaaaagagaattttagaccaatatccctgatgaacatcagtgtgaaaatcctcaataaaatactggcaaaccaaatccagcagcagaatcaagttggcttcatccctgggatccaaggctggttcaacatacacaaatcaataaacgtaatccatcatataaacagaaacaaagacaaaaaccacatgattatctcaatagacgcagaaaaggccttcaacaaaattcgacagcccttcatgctaaaaactctcaataaactaggtattgatgggatgtatctcaaaataataagagctatttatgacaaacccacagccaatatcatactgaatgggcaaaaactggaagcattccctttgaaaactggcacaagacagggatgccctctctcaccactcccagtcaacatagtgttggaagttctggccagggcaatcaggcaggagaaagaaataaagggtattcaagtagaaaaacaggaagtcaaattgtccctgtttgcagatgacatgattatatgtttagaaaaccccatcggtctcagctcaaaatctccttaagctaataagcaacttcagcaaagtctccggatacaaaatcaatgtgcaaaaatcacaagcattcctatataccaataacagacaaacagccaaatcatgagtgaactcccattcacaattgcttcaaagagaataaaatacttaggaatccaacttacaagggatgtgaaggacctcttcaaggagaactacaaatcactgctcaatgaaataaaagaggacacaaacaaatagaagaacattccacgctcatggatagaaaagaatcagtatcatgaaaatggccatactgcccaaggtaatttatagattcaatgccatccccatcaagctaccaatgactttcttcacagaattggaagttcatatggaaccaaaaaagagccctcattcccaagacaatcttaagcaaaaagaacaaagctggacgcatcacactacctgactccaaactatactacagggctacagtaaccaaaacagcatggtactggtaccaaaacagagatatagaccaatggaacagaacagagccctcagaaataataccacacatctacaaccatctgatctttgacaaacctgacaataacaagaaatggagaaaggattccctattcaataaatggtgctgggaaaactggctagccatgtgtagaaagcagaaactggatcccttccttacaccttatacaaaaattaattaaagatggattaaagacttaaacgttagacctaaaaccataaaaaaaaaaccctagaagaaaacctaggcaatatgattcagaacacaggcatgggcaagaacttcatgactaaaacaccaaaagcaatggcaacaaaagccaaaattgacaaacgggatctaattaaactaaagagcttctgcacagcaaaagaaactaccatcagagtcaacaggccacctacagaatgggagaatatttttgcaatctactcatctgacaaagggctaatatccagaatctacacggaacttaaacaaatttacaagaaaaaaatcaaacaaccccatcaaaaagtgggcgaaggatatgaactgacatttgtcaaaagaagacatttatgcagccaacagacacatgaagaaatgctcattatcactggccatcagagaaatgcaaatcaaaaccacaatgagataccatctcacaccagttagaatggcaatcattaaaaagccaggaaacaacaggtgctggagaggatgtggagaaataggaacacttttacactgttggtgggactgtaaactagttcaaccattggggaagacactgtcgcgattcctcaaagatctagaactagaaaacaccatttgacccagccatcccattactgggtatatagccaaaggattataaatcatgctactataaagacacatgcacacatatgtttagtgcgccactattcaccatagcaaagacttggaagtaacccaaatgtccaacaatgatagactggattaagaaaatgtggcacatatacaccatggaatactatgcaaccgtaaaaaatgataagttcatgtcctttctaaggacatggatgaagctggaaaccatcattctgaggaaactattgcaaggacagaaaaccaatcaccacatgttctcacccataggtgggaactgaacaatgagaacacttggacacagggtggggaacatcacacaccggggcttgtcgtagggtggggggaggggagagggatagcattaggagaaatacctaatgtaaatgacaagttaatgggtgcagcacaccaacgtggcacatgtatacatatgtaacaaaactgcacggtgtgcacatgtaccctagaacttaaaagtataataaaaaataaaaaataaaataaaataatgtcttattcatgtgtatatttcatataaatggctgccagaggcttctgttcatagtgttcaacaaatatctggtaaattaatgaattaacactggcaaaaactgaagtacagaactaaacaaagagaaaaaataaatggctcttaggatccagtttccatgaatttatgaatcataatggcttttaaaacattcaagtacacagaggataagaaaaatatataacagataatagtagtttgtataaacactcattagatcgaattgaaaatgagattttatatggggtgttctaagcttctgagaagagcatactgaagccattcaaacaagaattggaattacctagatctgtgccaagagtatattctgacataccacagatgtttaactcaattgggtgaaaaaagttaggagaccagcctggagaaaaaaatactatgctacaaaaagtgagaaggctttatcaatgcatatacgagttataaaactaaaaacacatttggaatcactgaaatctttaaactaatttaagatacttcaatattagcaaatgggtcatttcccttttgtgtctgtactacctgtcatccctgtcacattgccttacaaagagtgagctcccttgtcattaaacaattccctgtttagtatagccaaatagaatatttactgcaaaccagtctcagagaagaaaaatgaagtcagtaaaggtcttcttaacaacaagaagtgttcttcaaaaaatcaacaattaacttaactgcttcaccccccacaaaattaaggccacatactgtatgattctacctaaaagactggaggttgccagaagttagggaaagggaaggatgaataggcagagcacagacgatttttagggcagtggaaaatactctataaggtactataatgatagatatatgtcaaaatacatttttcaaaactcatagaatgtacaacactgagagtaaaccctaatgtaaaccatggactctgagtgataatgatgtcattgcaggttcaccaactgtaataccactctggtgagggaacactgatagcagaagaggctatgcataactgcaggtagagaatgtgagggaaatctctctaactttctctcaattttgctgtgaacctaaaacttcttttaaaaagtattttttaaaaaaccaaagctttaaacatgtattttaaaaagtatatcagattatttatttgcatattaacaaatatggtttttatatgttagtacctcctaataaaggaaacagtcagtggtgaaataagcaaatcaacaggcaaataatagcataaactacaagactcatgtattagtttgctaatttttaacaaataatacctcagaaattctcaagtcattacacttagtgggcaagaaaagggcattgaaaatataaaataactgataatccaaaatgaaaaacacttatttgactttaacaagcattaaataattttcctatattgaccttacaaatcttgttaggttaccatattttaaaacatttttcaagagtaagggtacaggcagaaaccaaggacctgacggcgttgatagtgcagtgattgacagaaaatgtttctctataaaaatgtatttcatgagcatttgcatgtactgggttgagtaataccaaggtcataattggaagtaatgtatgtgaataatattagcattaaaaaccaaaattcttaaattgcctacaaatcactgtatgatttgacccctacccacctcatcagccacatcagccacatattgtgtgactcactctggtattctgtcttctcaaaattcattaaatattccaagatgct

SEQ ID NO: 2523 - DNA, 34670 bp, Homo sapiens
taaattgctattttaagattttttaagataggtcattagaaatttgtatgaccattataaatattcaacgtattaaacgtttctcttatatttgaggcaaatatttctcccaactatgtttttcttatttatttataagaaaacaaactaaactatatatagttatatttattaactaaatataaatagttaggtctatttatatttccctatgtgattctgactcaattcctctacatttagaaaaattcctccccctctacagattagacatgcaccatctaaaacatagtacttgctttttaattattattgttagaattaaatgaaactgaaacttgttaatgaaattagctaacaaaattttccactgctgaccagatattataaaaaacattgaacctatcatgtttaatagtgcatagattttcccaagctggataactgtgaaatagagtgtaaccaatgatttgagtgtaactgtgattaaactttccaatgttggaagacacttttaatggaagctattatctatatttatagcagtttcattttttacttcagctgttacttactcaatttttttcttctcttttttgcaattgatttgcaaaatattccattaattgccttataactgttatacatatggaaaattgttagcatgccttaaagtgatcaagaaagctcttgagtgttgaaatatactaagtcttattttagatctacatttctcctctgggttctgcttaggcaaaactagttacatttaatgacgctttcatgcatttgctattaaattatattagtctaggtcagtcagaaccttgagatacgtttgtctcttgaggctccttgtctggactagatgtccatgcaattcttgttcagctccaagtccagccagaggcatttaatgtggccaacaacaatggtctcatgccttgattctaacatgtatctgggggtctgagcttaagaatggagaaacagaatgtaagtggtcctgtcagttgttaaactactctttccctgcatccccagtcttgcctcatagatatcctcggaataaaatatcatgatttttaagcatctcagtttgtactaggattgcattgatgggtggcttttccaacagaggaggaatagagatgggagggactgagatgcctatattcgagaaaaactatttctaggcagatagccaaatcttgatccatcaaaatactaaattagtaatatattaaaacatttttaaagggaattctgttattattatgaagaaaatgagaaaagaataatattccatactgatatcttctatcatttggaaatacctactttcttccaagaactgtataatgtactagagacataagattaaaatatatggtccctgtttccaaatagctcatagcatggagaccaggctgaccaggaaacagtatcagctatgaaacggaagtactgaattacaaggagtagatggaatgactgcctagctgaaactgtaaacatcaagaagaattcctggataatgtgccctatgaattgagttttacaggaagagaatctcaggcagaagaaagcatattagaaggcccaatgctgtgagaaataacctatttacctccctgcaagtatttcagcaaaggtcttaattggtcagtgacaattaagtaaaatgaagggcttaggaggtccagatgattaaggtttttattcggcttgctaaggattttggactttatgctaagccaataaaaaggtattgaaagactttaagtagtcaaggatgtatgatcagatttgcattttagaaaaatttctctggccacaattacgtaaaaaacagagaaggatggggcgggggacacattagcacaaaagaatagttagaggacaattcttggccattcaggaaagaaatgaggagggtcttaagtagagagagtgtttctgaagaaagatattaaagagccataagaggcaacatatgatcactgattataaggttggagagacagggataaagaaaagggtgaaggcaacccagctttctggcttttacaaccaggtaaaatgtgatgacgttcacagaagcagggagtaacagtgtgaaagaaggcttgattgaaggtagaatacaaatagcttgagttacctgtgaaatgcacaagtggatacacagggctgggactagggtgaagtgagtgatgcatggaattggatgcaaaatttaagaaacaaaaactctttgaaaaaatgcattttattttaagtctgggatacataagtaggatgtgcaggtttgttacacaggtaaacgtctgtcatggtggtttgctgcacctatcaacccatcacctaggtattaagccccgcatgtattagctatttgatattgatgctctctctttccctgccccctactcctgacaggccccagtgtgtgttgttcccctccctgtatccatctgttctcatcgttcagctcccacttacaagtgagaacatgcggtctttgattttctgttcctgtgttagtttgctgaggataatgacgcagtggtaacacatggaagcctcctttctttaaggaactattactgagagagaggcagaaggtttaaaggttgtgtttttatttatttatttttacttttctctcatgaaataagaaactggaacatgtttatttgctgaggctaaaaggaactggcaatggagaagggacgtgggaaggaacaaatcagagaagatagatgccaaaacaaagacagacagaggctgaagaaaaggaggctcagatgggattattgtagacagtttactgaatacaggccttcaaaactggggggcttccacccaggaagtgaaaccatatgacccagcaatccctcttctggttatacacccaaaaggaagtgaaatcagcaccttgtagaaatatccgcacgccaatgttcgttgcagcactattcacaatagccaagatatgaaagcaacctaagtgtccctcaagggatgaatggataaagaaaatgcataatatatacaaaagagaatactgttcagcctttaaaaaaaaaaagaaaattctgcaatttgtgacaaaatggacaaacctggaagacattatgctaagtgaaataagccaggcacagaaagacaaatactgtatgttctcacttatgtgtggaattaaaaaaaaaaaaaaaaagtcaagcccatagaaaaagatagtacaacagtggttatcagggacaaggaggggatggggaatggagaaatgcacgtcaatgggtacaaagttgcagttacataaacaactgaaataagtaagtctcaagagctaatgtacagcatgaggactacagctaataattttgtattatatactagaaactggctaagacagcagattttaggtgctgttaccaccaaaaaataaaaaagaaggtaattacgtgacatgatggatatgttaatgtgcttgaccttagtatatttcactaaatatatatgtaatatacatttatcaaagcatcatgttgtatgccttaaatatacacaataaaagaaggaaagtaatgcacttttattgcctggacaacacattaacacatctccccattgtgggtcatttttttttcttttgaaatgtttataacatttactcacatctttccatatttctgcccatccccaaatttaaggaaattagtatgcaatacttatctgcctgtaatcccttctctttggggcattaatcagcagttactaatctgaagatttaacaagggaagaacaaagaagcattaaaaacactatttgctgaaaatatagaaggggtgcctaagtgttgctcacatctcttcaaccttcaggtggaaattatactcaaggctgcaatggctggaaccccaagttcactgaaatctgcatcttgaaggaatttttgcacaaaacagttctttcatttcagaaataaaatatttactaaaaagttgagaaacaatgcaagcaaatgcagtaaatatttgttcttcatggaagcaagttattcctttacatactcctattgtctcagtgaagttctggaggtttatacaaatggaatagattgtggaactacccctgagaactactcttaaacatgctacgtattcaggatgtcaaattaaaggagtctctgaggctgccgcttctctggtcatctttaattagacaatactctggtgaaaccctcacaattaatattaagagttgttcttcttctacagtaagtggaaggggaattatgtagtggcttgttctttgttataattttattgagagggttgtggaggaaggattggaatataatagaattgttctattttctaccatttacagaaaactagatgaatcacaaaattgaagaaaaaatgatgcttatcttttaaatatgtattttataaatatttaacttatattaaaattactttccacatattacaaaatgctctaggcatatcagtgcatgtgtgctactcattaaatgttactatgtctttctaccacagagatttatttaggagggagattgtcatgttatttcctatacctggaatgactcacacttctgtgcctgttaacattttatccatctgatacaatctagaccgtgaaacctttcctaatcaagctattttttcataaatttaacaactgtcataaatgaattgtctgtcatgaatgaatgaagcaacaaaacaatgaatgactcagtgtgggttggttctaagagttgcataccttcgtaaccccaatagagcttgttggggtgcctggaatattaacaagccaaaaaaatacttactttattattaattatgtaggcaatgcataaattgaaatacatttatatttctctcaagaaattctctctaaattatattagcttctgaggagaaagtgtctttctagcaacctggcttttaaaaccatcataggcactttctctgtaaaggtaaataaactttctttggaatgtggtgaaagaagctgttagataatttctgaatgtctggttttataataaggagggtcactgtcctcaaagtttagcaatcactagaccctgagggacttttatctaatcttaaccctgcacctgactgccaggcagagctaatcacttaacctcccagtgaattaatgggttcatctgtaaaacacgattgccatcaaaggcatgaaaggaaaagactaatgatagacggaatgaggttagatttaaagattcaacaaagccatcaaaattcacagcaaagccattttccattatttccctcaattgtaactatactgcttttataagaagtgaattcgacaaaaataagtttataagagttctgttgtgctagtttttatctgctggactgatgcagtatgtaagaaaattctcttgctttcaaaaatgtaaaatttaaagcacattgaaaattcatgatatttcatgagatgcctaaggatttgagactctgacagacaaaaaaatcccctgtgattttgataagactgctaaataaaaaagcagttcatacattatttttatcaccttcctcttctatttcctctttcatttttctattacattttgattttgacttttatgtttctgcatctttacttttctccacccctggagcaatgggaagtatttttttgcaggctacaaggtaccattttcagtgtctgatgaagttctccctttggtgtgtgtcaaacaatcatttccagcctccagataaagagacagagtggcccagaaatgccctaagcccactagaggcatgcttgcctaagctggctgcatctctccagttgcaatgcacattttttgggacaataataaatactggctcaaaagagaatgatggaaagtacatttttaggagatatgagatctaggtctattgatggataaactgatttttttccagtcactataacatctgttcagagtaagtaagcatcactgcacagggagatggaggatgttaactgatattgggactacaattagatagaagaaaaccagaaccaaggcacacacactgttcagatagttcatagggttattttaatcactgattcaactttacagaatgaagtttctccattcaatttcacatcagtaactgcaggttgtattatgtctaagattggtatagaacaacagcaatttcacaatatctagacaatgaatgaatattaaaaatctatttcattaaaaagctctttcagatactggtatctgaaagaaaccatgttggacgcaaaatatatcaagaaatcaagaactcaatataatgaaaataaggctgaagactgcaacagatttgaatacagcatgcctctatattctagttattaatgattgatttttaagaaaacctgtttcagtgaaaagggcaagtaatcttttttaatctcactttaaaatatttcctagaactttctcattcattagctcacttgattctcaaaacaatgattctcattcattagctcacttgattctcatattctcataatcctaaaataaatgttattataatctgtattttaaagtttaatattttgaaagaaataaattacataatttgatgagggtgataaattgggactccagtcccaatttagttcaccctgagcaggtccattctcacatcaacctgttacaccatttaaagaaataaaaaatgtccattacatatatttttaagttacattcagtcaaacaagcagttaccttagcactcagatgtgtaaaaaccagtgcaacaaaatttcagtttttaacaagtcatctgaaacaacagaggacataattttgtcctgttcccaagatactttgtgtttatgttcctaaatcctaaattcctaaaattgcatcctgataaagaacagtaaatttgtttctctactatatttaccatattgcctcattacttgatccctccttccttccctccctctccccttctcttccattccttcttttcttccttccttcttttaataaatgtatatatatatgtgtgtatatatatataaccaataattaccaagcacttacagtacactgggcagagtgctaggctcttcactgaaaacacttcaaagtataataagagaaacaggaagcaatgaaatgagtcagctagttttggaatcaggttagtcacagttgatctcagctgcaggcccggaaggttgggggtgggctgccttgtattgcaaacacatgcatcacatcacacagacatcctgcacgctggagcacagtagcctgtcagttcccactgctgagtcatttacagcttttatcgtagttaatgccaatgattatatatgttaaaagtacttattaatccttgtaccaaatatagaagagggctcagacgcttcttatctcatggttcttaaatctaaccatgcgccatactcactggtagttttacaaggaatggattcttgagctcctctaaagaaatcagtagctccaagagagatgtttttaaaaatctgtttctagtaaactctcccagtgattgctgagtaacctacttaaaatgacattggaaaaccatacactagaaccctgcttttgatttttgttacaagatctagaatcaagttcaaatagtctagatagtaaaatattgtgagaatttttttttagttttagaaatcctacaagaagtataaaactattgttatagtccatgcaaccaaaattcttacccaactactggaaaatgaaggagtaaaaagagttggccagggtagagacatctggatccctcttcggcaacctaagaagataagtctgtcagagaatagtgattataatgagttaatgactatatgcctggtttgctttagacagccccatgtcatgccttctgtcttagtataattattaatcatgctacccatttctttctccgaagtgtccctatttgaacaacaagttatttggtcaccccaactaaaagggaatcttgtcagagaccaatgagtgtcgtttagtgaatatagaaataataagcaggctctatttattcatttattcaactcaattcagcaacacatttgtgctagcattcgcacatgccaagtcctgcataagtgaggaaagccccttgccttgtggagcttacagtccagcagtggaagactcacacagtatacaaatgaaaaacaaattaaaaaggatagagattacaataactgctattatgggaataaagaggatgatataataggatttcatgggatggacaggtgtaatgaggggaggccttctggcagaccatcatctgtttcaacctcattttgcataccttcttgtactccagaaactggaaagctaaaagctatgtttcatatcctcctccgcagctagggatctggatttagacacagacaaccagatatactcatgcgaagcactgattcagaactaaactgtagaaggacgacgcagtggcagagaaggtgtctacttcactggcacagaagtccagtctccttattgtcagacagcacataagatgtgttcctgaaggtaatggttctgaccccacttcctgatcccctactcatggttatagtagtacaaccctgaagccagcagttgggacagcagtcttctaactccccagcttcctgatgaggcagatgtagagggccagttctgtggtggtgttcttggagtctggaatagttccacatcaagagctattcccaagaccttctaaaaaattgtaagcactaacttaccatgttaagttcccttctgattaaaatggagtggtttctgttatctgtcacagaatgctaagtgataaagacctaaagaatgaaaaggagtcatgtggcaaataaggggaagagaattccagaccgagaaaatagcaagcgtacagggtcaaggctgggaaaagacttggcacgttcaagccacaagaataaagtcactgttgctggaggaatgaagaggtgggaatgcggaaaatgagacactgtgggagtctgattagggccatgtcagtgagagacaagttcagatttttcctagtatattgggaattcattgaggagtttcaatcaggcatgatctagttttaagaatattagactagatgccttgcagaaaaggaattaaagcaggaagattagtataggactatgtcagtagtactagcaggggtgaggaaaaggaggaattaaattcttggctttcagctagatcagaaggtagatgtgctgtaattcattaaaacagagacgaataggatagaataaacatatgtttgaagcatcaagagtttgttttcgttttgtttttgggtatctttggttgcacaagtcaaagttgagatgcaaaccagacaaaagactttgacaaggagagttttataaataagaatctgcaaaggaacagtcagttttccatggaaatcctcatctaaaccaggtcctagggtcaagacgttttaacataagagtcagaaacaaaacctcagagcacagtgcatccaagcacctttttcgttttttatacgaggtctcgtctttatcactcaggctgaagtgcagtggtatgatcacagctcactgcagcctcaaactcctggccttgagcgaccctcttgcctcaatctttcaagtgtctaggactacaggtgtgctctgccatacctggctaatttttaaaatttttttcttgagacagagtcttgctatgttgcccagtctggtctcaaactcttgggctcaagcaatcctccagccttggccccccagcgtgctgagattataggcttaagccaccacacctggccaccaaagcacctctttcttatgttggctgttaccaaagcctatcagacattccctctattaaccctacaaccacagaccctgtccttacctgcaaattcacgaacacttcctcaggcccaggaagaactggacgacttctgtctacctatactaccagcaaatgattaagtcagactgtcaggacgtctacaaccctcttattatatgtttcctatattctttcaactctgatcagttgttgggggaagtcagggaccccgaatggagggactggttgaagccatggcagaagaatgtgaattgtgaagatttcatggacatttattagttccccaaattaatacttttataatttcttatgcctgtctttactgcaatctctaaacataaattgtgaagatttcatggacacttatcacttccccaatcaatatccttgtgatttcctatgcctgtctttactttaatctcttaatcccatcattttcataaattgaggaggatgtatgtcacctcagtaccctgtgatgattgtgttaactgcacaaattgtagagcatgtgtgtttgaacaatatgaaatctgggcacctcgataaaagaacaggataacagcaatgttcagggaataaaagagataaccttaaactctgaccaccagtgagccgggcggaacagagccctatttctcttctttcaaaagcaaatgggagaaatatcactgaattctttttctcagcaaggaacatccctgagaaagagaatgcgcccctgaggataggtctctgaaatggacccttgggtctggctgtcttctatggtcgagctgtagggatgaaataagccccagtctcccatagcactcccaggcttattaggaagaggaaattcccgcccaataaatttttaacagactggttgctctcaaaccctgtctcctgataagatgttatcaatgacaatggtgcccgaaacttcattagcaattttaatttcaccccgtcctgtcctgtggtcctgtgatctcgccctgcctccatttgccttgtgatagtctattaccttgtgaagtacgtgatctctgtgacccacaccctatttgtacgctccctccccttttgaaaatccctaataaaaacttgctggttttgcagcttgaggggcatcacggaacctactgacatgtgatgtctcccctggacgcccagctttaaaatttctctcttttgtactctgtccctttatttctcaatccggccgatgcttagggaaaatagaaaagaacctacatgactatcgggggcaggttccccaataatcagtagccctgagactataagttgaagtctgcttactttgctataattactatctggaaagctgacttgctattcttataaatataatcctagcattgcaggataccatgggccatcttgccaatctccttgctgcacaaacttgctaagcccattacatatgcaagttttatcattataatcataatcatcaataccattgtggctgaggttgatgttatgattgccatacattgaaaagtagctatgtaagtcactaaacaaacattttatctccacttaaatatatttgtttgtctgaaataattacagagagaatatacatagatctatgtgtggacaagcctatctgtgtacgtgtgtgtacatatatttgtgcacaggcctaaacaaatatatatgtatggacgtatatgaaactaatatgtaatcagttaaaaagttaggttaatatacataggttaacatgtatgtatattaaactaacaggttatcatgaatgtgttatttgaactcatagtcattaagagatgtaaaactgttaagatttttcactgttggaaaacattggagagcctcaaaatatttaaacatctaatctttaagttgaaatgattcacactaaaagaaaataaaaatatctgagcatatttattcaggagcagcagtaaattaagaaaccaagagtttttttaatgagttttcactatattaatttcaagctatttattatgttatgggctgtctggtttgttaaagcctaattaatgtaagtaaagaagacccaagtaatcattaaatatatcactatgaaatgaattttagataaaagtaccattactttaagagaggaaagaacacataattgccatggttgatattaattttaatgtcatggaaaatttatttagtaggaagatgcttgcaagtaacatctgaatttttctctttgtttcaatatccatgtaaacctgagagaaattgcctagtagattttaaaaatctatagtataggtgttttaatcaggggtctccagagaaacagaaccaataagccaattccttataataaatacaatttgatataaagaatggctcacattattatggtgactgacaaatcccaaggtctacagggtgagttggccagctggagacccaggagtgctaatggtctagttcctgtccaaaggtcagtaagtttgagtctcaggaagagcttatttttcagttcaaatcagaaggcagagaaaagccaatgtcccagtttgaagtcagtaaggtggggggaaatctttccttggagaaggtcagccattttgtcttattcaggctgtcaaccgtatgaatgaggcccataacattaggaagagtagtctgccttactcagtctaccaatttaaaggtaaatctcaacctaaaacaccctcatagaaatgctgagaatgatgtttaacctgggcactttgtggtccagtcaagttaacacataaaatgatcaccacattaggtcaactctcagaatgcagaatgttttgcctttactaataattcatgctaaaggaaaaagtgaacatgagtagttacagccacagataatataagatactgtaagtctggtttcaaaaagcattatgtgaattcttcacatgttattttcaatggtcctccttattcaatagttttaatatatacctggtatctgccatgtctaccacaaaggtagacaaaatgctcactggggtcctagtcctttttacctcatgcctacctggccaccttatagctgctctctcttcaagacaatctactttctacatatttactacataaatattcctggctgggtatcgcagctcatgcctgtaatcctagcaatttgagagggaaaggtgggcagatcgcttgagtccaggaattcaagactagcctgggcaacatggcaaaaccctatctctatttttttttaaatgtctaatgaaaaaagaaatcctaaaacactgttattattacaatgctcccctggctcaggaacctaccatggctcaccagagaaacaaaggtagattaactttcacctccacaaaaagactatagctattattgtgtacaagtatttttttttaaataaggctaaagtttctacactgactttcagaatttcagagaggagtccaagttgtaagccagctggaaacaagatgactactataatggcatgagagtgttcattaagcaaattgtatcttgccttaaggtatgtatgtggggaagggggtgtatagtattagacaatgcttcatttaactagactttcttttcttcatcagatttgtttacttctcctatactctaggtctacgctaggctctagagtttcaacgcattaaaggtacagccccctgatggaactaaatagagaacccagaaataaacccattcatatatggtcaactgatactcaacaataaggaaagaaagtctcttttataaattacatttgaaacactatctacatgagaaagacatttgccctttatcttacaccatacacaaaaatcaactcaaaatggattgaagatctaaatgtaagacttgaaaccattaaaagcctaggaaaaaaacatggagaaaatctccttgacattggtcttgacaatggttttttggctagaacaccaagagcacaggcaagaagagcaaacaataccaagtgggactgtatcaaactaaaaagcttctacacagcaaaggaaagagtcaacaaaatgaaaaggcaacatgtaatgagagaaaacatctgcaaaccacatatctaatattcaaattatatgagaaattcatacaactaaatagtaagaaaatgaagaatccaattaaaaaatggacaaaagacctgaataggcatttccaaaagaagatatacagatgttcaataggtatatgaaaaaatgttcaacatcactaatcctcagagaaatacaaattaaaatcataatgaggtatcactacacaccttttagaatatctattatcaaaaatgaaagataaatgctgtcagaaatgtggaaaaatgaaacttttgtacatagttcgtgggaatgtaaattagtgtaaccattacagaaaacagtagggaggtttctcaaaaaattaaaaatagaactaccatatgatccaacaaatcactactaggtgtatttccaaaggaatgaaatcagtttattaaatagatatctgcactgtcatgttcattgcagcattattcacaatagtgaagatatggaatcagcctaagtgtctgtcaatggatgaaatggatgaagaaaatgtgatatgtatatatctatatatatgattctatatatataaaatatcatatatagattatatatcacatagagagagctccatatatatatatggaggctgaatagtacatacagtagagtactattctaaggaaattctgtcatttgcaataacatggatgaacatggaggacattaagtgaaataaggcaggcacaaaaaaaatacctcataaactcagttatatgtggaatctacaagagttgaactcatggaggtagagagtacaatggtggttacaccaggggctggaatacttgggaaacgaaggatgtggggagcagttggggagatgttggtgaggggattcaaaattttagacaggaagattaaattttaagatgtttattgtaaaacatggtgatatagttaataaaatgtattctacccttgaaaactccataaaaagtagaatttgtgttctcactgcaaaatatgtgaagtaatgcatatgttaattagctcaatttaaccattccatgatgtatgtgtattacaaacaatatgttatacaaaataaatatataaaattttttgtcaaataaaaagttttgaaaaaacaaggaaaggctctgaatagacgtatttccaaagaaaatagacaaatgtctaacaggtacatgaaaagatgctcaacattaataatcattagagaaatgcaaattaaaactgcaatgaaatatcacctcacacctattaagatagctgctatgaaaaagacaagaagctaggtgagtagctcatgcctgtaatcccagctatgcagaaggctgaagtgggaggattgtgtcagcccaggagtttcagaccagcctaggcaatatagcaagatctcatctctgtttaagaaaaaagaaaaagaagaaaaagaagaggaggaggaggaggaggaagaagaggaagaagaggacgaaaaagaggaagaggaagaagaagaaggaggagggaggaggaggagaaataatagaagacataagtgttgcaaagggtgtggagaaaatgaatccttgtacactgttggtgggaatgtactagaacagctattactgaaaacagtacagaggttcctttaaaaatttaaaacagagctaccatatgaaccagcaatcccactttgggtatatatctaaaaaataaaataaatattttggggagatatctattcctccttttccattgtagcattatttacaatagggaagctatgaaaacaacctaagtgtccatggacagaagaataagtaaagaaattgaggtacatatatacaatggaatattattcaaacattaaaaaaagaaaactcgtcacttgcaacaacgcggatgaactcaggggacataatgctatgtaaaataagtcaggcacagaaagacaaataccattatgttctcacttacacaggcataccttgtaaacattgcaggtccagttccaaatcaccacaatacactgaatatcacaatacagtgagtcacacaaatattctggtttcccacataaaagttagttttatactctataatagtctactaagtgtatagcagcattatgtctaagaaagtgcataatttattttaaaaatattttattgcttaaaatgctaattatcatctgaggcttcagcaaatcataatcttttggctagtggagggtcttgcctcaatgttgatggctgctgactgatcagagtggcggttgctgaaggttggaattgtgtggcaatttcataaacgagacaacaataaagtacggcattgattgacatatccttttatgaaagatttctctgtaacatgttatgctgtttaatagcattttgcccagaatagaacttctttcaaaattggagtcaatcctttcaagccctgctgctgccttattaactaagtttatataatattctaaatcctttgttgtcatttcaataatgttcacagcaccttcaacagaagtagattctatctcaagaaaccactttctttgatcatccataagaaggtactcttcctccattcaaatttgattatggaattacagcaattcagtcacatcctcaggctctactttctaattctagatctcttgctatttttaccacatttacagttacttcctccactgaagtcttgaaccctttaaattcatccatgagggttggaatcaatttctgccaaacttctgttaatgtttatattttgggctccttccattaatcgtgaatgttcttaatggcatctagaatggtgaatttttttcagaaggtgttcaatttcctttgcctggatccataagaagaatcacaatctatggcagctatagccttataaaatacatttcttggctgggtacatggctcatgcctgtaatcccagtattttgggaggccaaggcaggtggatcacttgaggccaggagtttgagacaggcctggccaacacagtgaaaccctgtctctactaaaaatagaaaaaaattacctgggcatggtggtgcatacctgcaatcccagctactcaggaggctgaggcatgagaatcgcttgaacccaggaggtggaggttgtggtgagcccagattgtgccactgcactccagcctggatatcacagtgagactgtctcaaaaacataaagtaaaataaaatatatttcttaaatagtaagacttgaaagtcaaaatactgcttgatccatgggctgaagaacagatgttatgttagcagtcaagaaaacaacattaaagtccttgtatatcttcatcagatcttttgggtgaccaggtatattttcaatgagcattaatgttttgaaaactatcttcttttctgagcagtaggtctcaacactgggctgaaaatattcagtaaatcatgctataaacaaatatgatatcaactaggcattgtttgcactgacagactagatttagcataattcttaagagccctagggttttcagaatagtcaatgagcattggcttcaatttaaagtcactagctgcattagcccctaacaagagagtcagactgtcttttgaagctttgaggccaggcattgacttctttctggctatgaatttctagatgacatcctcttccaagagaaggctgattgacctacactgaaaatctgttatttagcatggccaccttcatcaatgatcttagttagatctttgggataacttgctgaagcttctatatcagcatttgctgctcaccttgcacttttatgttatggagatggccttttttcttaaacctcatgaaccaacctctgcagcttcctctccactatcagccttcatagaattgaagagagcagggcttcgctctggattaggctttggtataaaggaatgttgtgactggtttgatcttctatacagatgaatcaaaactttataagcaataagactgtttcactttctcatcatttgtgtgttcactggagtagcacttttaattttctttaagaacttttcctttgctttcacaagttggctagctggcacaagaggcttagctttcgccctgtctcagctttcaacatggcttccttactaagcttttgacttaaagtgattcttcctttcaattgaacacttagaagtcattgtagggttattaattaaccttatttcaatattgtgatggcttacagaatacggaggcccaaagagagaaagagagatgggagaatagcaggttggtggagaagtcagaacacacacaaaatttattaagtttcccatcttatatagatgaggtttataatgctccaaaacaattataataataatatcaaagatcactgatcacaggtcaccataagagatgtaataataaaaacttttgaaatattgtgagaattaccaaaatgttaaacagagatacaaagtaaacacatgatgttggaaaaacagcacccaccgacttgaaatagagttctcacaaaaatgcaatttgtaagaaacacagtacctgtgaggcgcaataaaacatggtacaccaaaagcaactgcaacaaaagccaaaactgacaaatgggatctaattaaactaaagagcttctgctcagcaaaggaaactatcatcagagtgaacaggcaacctacagaatgggagaaaaattttgcaatctatccatctgacaaaggtctaatatccagaatctacaaggaatttaaacaaatttacaagaaaaaaaccccatcaaaaagtgggcaaaggatatgaatagacacttctcaaaagaagacatttatgcggctaagaaacatgtgggaaaaaaaagctcatcatcacttgttgatagagaaatgcaaatcaaaaccacaacgagacaccatctcacgccagttagaatggtgatcattaaaaagtcaggaaaacagacgctggtgaggatgtggaaaaataggaacacttttacactgttttggtgggagtgtaaattaattcaactattgtggaaggcagtgtggtggttcctcaaggatctagaaccagaaataccatttgacccagtaatcccattactgagtatatacccaaaggattataaatcattctgctataaagacacatgcacgtgaatgtttattacagtactattcacaataacaaagacttggaaccaaatcaaatgcccatcaatgatagactacataaagaaaatgtggcacgtacacaccatggaatactatgcagtcataaaaaagaatgagttcatatcctctgcagggacagggatgaagctgggtaccatcattctcagcaaactaacacaagaacagaaaaccaaataccacatgttctcactcataagtgggagttgagcagtgagaacacatggacacagggaggggaacattacacaccaggcctgttggcaggtagggaacaaggggagggagagcattaggacaaacacctaatgcatgcagggtttaaaacctagctgattgggttgatgggtgcagcaaaccaccatggcacatgtatacttatgtaacaaacatgcacattctgcacatgtatccaagaacttaaagtaaaaaaaaaaaaaaaaaaggtatgcctgtatgtgaaatctaaaaatgctgagctcatagaagcagataatacagtggcattcttcaaaggctagtgggtggggaaaatgagtaggtgttagtcaaaggatataaactttcagttataatgaatatgtttgatgatctagggtacagcatgggtggggatggatgtgttagtttaattgtggtaaccactacacactgtatatgtatatctaatcatcacattgtacacattgtacaccttgaatatattcaatctttcttaattaaacatttttaaattaaataaataaatgcatagcctctttcatgaagctcagaaacaagcagaaggtaattcaataatgatagtattggctgggcacggtggctcacacctgtaatcccagcactttgggaggtcgaggcgggcggatcacttgaggtaaggagtccaagtacagcctggccaacattgtgaaacctcatctttactaaaaaaaaaaatacaaaaattagctgggtgtggtgatgtatgcctgtagttccagctacttgggaggctgaggcagggggattgcttgaagccaggaggcagaggttgtggtgagcctagatcgtgccactctactcccgtctgggtgacagagcaagactccatctcaaataataataataataataataataataataataataataataataaatagtatctacctacaaagtgcttactttgtgccagatgttgtgcttggcactttacacatttaagtcatttaatttccacaatagtcctatcaaggaggttctcttattatctccattttacacatggaaaaaacctaagttacagaaaagctgaataatttgcttaatgtcattcactaagtggtgtaaccagaatttgaaccagacagtctggcttcaaatcctgtgcttttaaccatgagattctactgtaaaatttatcaaagaaaggtttcctagaagtgtaatgggagcccagatgaaatgcaatataggcagtggcttcacggaaaagatcatcccctttttcatatatacagttgacactcaaacaatgcagaaatctgcatataacttttggctccccaaaaagttaactacttatagcctgctgttgaccagaagccttactggtaacatatacaatcgattaacacatattttatatgatatatatgtgtatatatatatataaacacactctattcttacaataaagtaagctagagaaaaaatggtattaagaaaatcataaggaagagaaaattcattcatagaactgtattgtatttatcgatatcataagtgtatgtcatctgttgtcaaggtgaaacttctatctgaaatggtaggcaaccacggctgcagatctcaatctatggtacatatcaagcaagccaactttttcctgtaatgtcgtgacttttctctgtttcttgggagcacttcaagcattactactggcactttgtatgggtcccatggtgctttcaaggtttacagtattgcactaaatgcaatgaaaaatgcaagaacgttgacacatcactttttattgctatacacaatttactggagagatgaaattgctcatgtggagatgattagcatcacaaggcattttaagcagatactcacaacacttgagctcaccacaatagcagcagcaggtggttacaaaattattacagtagtacatatgtattactgttcatttcatgcagttatgatttaatgctgcacccttaagtttgtttacatttctctcaactgtaaacggcaccatgtatggtctgaaagtgtgtaagttttgatgaactttaacttttataatagattcatgtatattttatggcagtaaataataaaataggctagaatctacattttttacatttgtggtatacctacctttctgattttttgctacttctaagctacataatttatctgtgaattatctcaaattgtcacaaatctccaaaaaaatttccaatacatttattgaaaaaaattcgtggataaatggatccatgcagctcaaatccatgttgtttaaggatctactgtatttgtttgcacccatctctatctctccaacaccaatattcaaatatagctaggccatgtttctatagctaaaattttgcttttgtaggctgaggtaaccttactcctatcttttcaaataccctttctatcactgccaatggcttttctgtcccatttcctttatggataattccaaccaaaactgattttattttttctgaccaccatgataggttattaactgagcatgtattttcacagttgcttataattgaactctgttctctaattttttttcacatgcataagtcctttcacctaaaatagattttatatcacctaggcataaatatatttgcatcctctagagcagacagacatatagtaagtgcttaataatactcagtttgacacaatttaattgaattaagaagcatttaaatttaggcaggaaaactgaataaacattgaataaacacttttttttctctctctaaaatgctcatctggcttctttttcaaaacagtttttttttttccttacatatagtcagggtcttagactcctgaattgtagtctaattggcctaatttgagactcatgttggcagcaacaatttctgtaactatctggagttgtgaagcagttagccagagaagtatatttgacagctaagttatttctctacagaaaaaaaaaaaagtgttgaaattcagaaagggatcagttaggcttgtaatagttactgtttttctataacaccctttgctccccgtggcatctgcctatgtcattctccttgggtgctgagggtgggtgctgctagaacgtatgacttcatgatgcatcactcaggattccttccctaaattcccctatgaaatgttggttttcacctccatcatcctgatgcatgctctcttttgtccaaaacttctactctgttgtgtattctatgtgtgcctgtgcccagaaacttcaagagccaaggactttcattctccctgaggatgtttctaaggatctctctactctcatgtatgattttttacaatgtttgtaggtagaaaataaattatcggtgaggagagagaaaatgaagaaatgggagtgattgagaggaaagcatgagggagaagaggaagaatcatgaacatgagtggaggggttattctctaagaggccagcatgctcttcttccaccagtagggaggaataataaacatgtcaagaggagcagaaaaaagataagagttccttaaaatcttttgaggtggagaaaaggaactacatgaaagatgatggtaaagagcctaaaacttttccctgaagaaatagggagtaagatcatttgcctgagagatgcagcagattatgaaaatgacttgggaccatctttgtgagatttgggcatctattagagggtcatgattgtggtgagcacctgaatgaaagtggctggcacaaatgtattatggtatagtcactgaaatctatggccctcaggcaactctggatagggaagagagagaaagtatggacaatggagctgatccctgaggcaaataattctagaagggtggagatggaaagcactggtgtgactgacaggaaggtcgaggcttgtggggtggagggtgaaataagagttgtggagatttcatgtagcatgcatgtgagccatccagggacacgagtgctgggagtaagcgggctcaccagacacagccatccttcaccctccttcacaccaggagggcagctcaaacatgtttgggacatacaactatggactttgggacatacaactatggacaaagcttccccaaaaagagacaattaggaaaagtaatacaggccaataaccatgctttctctacatactatttcaaataagtagactttgtagtgtaacctgcatttctacttcaaataattgtggaatctaacattttaaaatacattccctttatattacatattaccaatttacatacttgtaaaaacataaaaatttaggaggcaataatttatttactcaaaattataacaggacttaaattaccaattattttggttaatatcggaataattttatggacaaaaaatcatttacttagaaaccgtgctaagaacataaatttaacatcatctaaactctttgcttatttctaggagtaactctttcataagtacatagttagataggttccttagtttgaatggtgatgtctttaataacttcggtgttggccgggcgtggtggctcacacctgtaatctcagcactttgggaggccaaggccggcggatcacaaggtcaggagatcgagaccaccctggccaacacggtgaaaccccgtctctactaaaaaaaaaatacaaaaaattagcagggcgtggtggcaggcgcctgtagccccagctactcgggaggctgaggcaggagaatggcgtgaatccaggagtgggagcttgcagtgagccgagatcacgccactgcactcagtgtgacagagtgagactctgtctcaaaaataataataataataataacttcagtgtttttttctctatttactcagttttccagagggaaggctaagcttgttccatattaggaggttaaaaaaatgcgtacttcagtgaccaagagtgtttatacctgactattttaggctcaagctctagggtgggggtatagttgattcacagattttttggattttgattctgaaatttcatatcctggggtgagttatttgcaagaatttgtagtgatgagcttttgtctccctgtgctagtgagttgttttgctgctgtgtggtggaggccaggacttttcagggtgatgcctccactagctactttgcagggcatcatagccaactgagagtcaaaggtagatgtaaccacatgtgaacttcagactttccatttgacttgcatctccagccctctagaattattcactgcagggatcagctccattgttcatgctttctatctcttccatgtccagaacggcctgagtgccacgaggttccagttactgcactattatatgttcgtgtcagccactttcacttgggctctcaccatgattatgaactccttagagatactcaaatacatttctcatgagggtagctccaaatcattttcataatctgccatactttccagctaaataaccttactatctacttctttaaggaaaaatattagggtctgtaccattatctttcatatagttacttttatatactttggaaataatttaatgtaaaatcaatactgcatattgtgggacaatggaattacctgggttttggagtcaaacacatgtgagttcaattcttagattagctactgaaaaggtgggagggtttagaaaaattattaaagctctgtgaactccagatctttttttacctaagtgtgtattataataatagacactttgcaaagttatcataaaatataaattaataaatgagataatattgatgggataaaagtattttgcataatttttggcacacaataaattatcacagtatgcattaatcgttttaacttactgagtgatataaaaggatattttgaaagtagttgttattaacacaaacatagatttcactttctaaactacattaagtggtcaaaataaaatgtttactcaataaagtattcatcagcatgtttttaaacctataggaattctgctgcaatcatattccagtaactgggtaggtctggttcaggtattgtactaaaaggagtcatgaactaggttgtaaatgattttgtcaaggtgtcagtcatgtcatacatgaaagtatgctgttgtaagtctgtgagagtcaacatgtgtgaaaaataacaatgaagggccaaggaaccaccacgacaccttacagaggtgtattattggacagccctgtgatagctgtgatagctgaagtttgcccaggctgtgatccactagtttttagcagggtaatctttctgtgcaaaaatgccacacaattcaccaggcctccagggagctgggaaatcacaaatagacagagacttgaagagtgggtggatttttttttttttctttaaagcagcagctgttagtttaaaagatagtctttagtcttgaaaaaaaaaaaaaagaaatacaaggtatttactgatttctatagcaagttctatattttttcttttcccttacttcttctaattccaatgttatgttttttaaagtaatagtgataattttatcagtgtctctaatttataatgtctctagtaagagtagctgttatatcaatatactataaacataccctttcttacttgtcactccctcctctccttctgcttcttaccttcctttcttgtctctctcttcctgttcttcctttattatgtatatttaactcatgttattctcacaattttttttttttttttgagatgggatctggctctgtcacccagaccggagtacagtggcataatcattgcagcctcaacttcctgggctcaagtaatcctccttcttcggccttctgagtagctgggactacaggcatgtgccaccaaacctggataattttttaaatttttttttgtagagacagggtctatgtggcccaggctgttctcaaagtcccaggctcaagcgatcctcctgcctcagctgggattacaggtgtgagcaactgtgcctgaccacaagttgcctcttaaatgaataagtggttattagagcagtcatcattcttctgacagaaaaccttcctgacaagggtttcatatgtgaatataatgaaagcaaaatttaacttttaaccaaaaatgttgcagtatattcatttgaaaaggatgacacagaaaggataagtagattatttctgagaccccatacacactgtctttacaattccaagattcataattctaatatactaataaaatataaaacttttagtgtttataaatagacaaaaatacatgtggatctcttataccaactgaattttatatattaatacttcctcgaccaaaggtatttctttgtaatttttgtcttacttttacaaaacaggaaaatgagaaaaaagtaaactttcactagacagaggtagaattttcattggcatctctaagaagagtatggggagactcagagctttcagatggcttttgaggaaactgctttgtgtttattttgctgccttccttcactttttccctctagcaaacacagagattaaagatcagtgtgttggccattctactgtcatcacaacataaaatgttttctgctctcttgagctgacatctcatcagcactaacagcttgaccctacaccccaatggtatataggatatacctgtctttaaaatgtgtgaacagaatgttatctgcagtgatttttctttttatcctttgatctgtcactatttcttcacaatgtcaaaagcctcagggcttggcttgaatggtgatcaaacccaaaggcacacaattttgggtctaatcctgaatctacacaatcaaaaatcttttcaattcagacccaaacaccatactttgtcttacaatactgaagtgcagccatcactaaagcactgctttcccctttgagctttttaaagaatgaatataatgaggttataaagaaatgaaacatttcttttaccaactgtactataataatacatgcatctaaagaaatgcatgcttccatgacctttcagaagattaaactctttcttggtgttgttgccattgcccacaacacttattgtgaaatttctttgaaatctacttcaaagatattttcccaggttcatcaaaaaaatcaaagtgatcaatttattttcacagaacattcaatttacctaatactttcttcctttcattctttctttacctccttctacttagacttgacctctcctgcactcctctgattgttgattcgctttcatttaacaaatgttaattgaaaatcaagctctgtctgtgaagatgacttccctctacctgtattaaactgtactgtcgaaaacttcctctaagtctctctaccccattctccaactttgcaaggaacaacactcctgatggtgcctcttttaataggcctaatcctcacctcattttgtagaccctctagctgttctgatttttttgttgttgtttgcttttttgaagattaggctaggacaagacctcctaatcccaggatttgaaagacaaagttgtaccaatgaacacttaagcagagggacatcaggaggtgactaatttatatgcatgtttctaataaaattatgaactatgactgggtatcatgaataactagaagatactgttccatcaaatctgcacggacactctattctttaactttcctcctgggcgtcataaaaatttttaatcttatttccaactggacctctccagaaccctgcatgaggaactcaacccaacatgtttaaaactaagtgtattttctctctacagagtgcccttcctcttatatttattttaattagcaacacttccatcacctaaaggaaagtgagttagcctagattctattttgttatccctttcatctagccaagtatcaccaagtgtcatacaatctatctcctacatacttcttgaatcagcctcaggttctgcatctagtaccacagctctcatcatcatccactagatgaatgtcatagccttttagatctttctgcctcaggatcatctctctccaatcagcccttcatgggactatgaagatgatctttctaaaaaacaaactatttatgtcactgtgtagcttaaaaagtctttcttgtttcctatagccttgaagataattttccaactctctgctactgcttatattttgagcagctaatgctacccttttctcactaaagaaaccaagcacaagcaagaatgcatccatgataacatgttctcccttctcatcttctgttttgagcagtcttcttacgtatcacaataataattgtgggtcatttctatcacagcactgtcacattataacttgttctcttgaatgaacttcataatctttaaggagaggggctatcacccaatatttggcacagtgcttgtgataggcagaatcatgcctaatcctgagagcctgtgaaaaaaaatatatataattatatatataatatgttatatataatatatatgttatagataatatataatatatgtaaatatataatttacatatattatatataatttatatatataatttacatatatataaattatatatataaatcaaatcagacaaggctgtgcatttgcaggttttctttggagggtgcttttccctttattaataaagaacagatcaccttatttcctcaggaagaggtagaaattgaagggctgtaataacgcccctttctctgcctcttcatctagatgaaagcagatctaactgcgggtggcattaaaaaacatgatgtgaagaggtataagaaatatcttcttcacaattatgcctccttcatgagacctcttacatttctttatttcacctatatttagaaattatgtcaattaagaatccccatttgctgttagctgttggcttcatttgagaagttactacagatgtagacctgcggccaacggaacaggcctgggtggaggaaatagaggcccgcaaactgatctggaataaagaatgaataagccaagaattaaagacccccatggatgctagaattcagaacatgacagaatcagaacaatggctcaagaatttgtaattattaatgctcagaggcgaaccaaaaaaaaaaaaagtttcactttaggcaacaggacacccactgccaaagatatcaagggaatcagtgttcttgttaacagcaatactttgggaagctttgcactcataggtgtgggcaaatgaaagtgtagttatactgaaaacaatgatctgtagagaactttgaaactccaagagaattttacaattagctacatctttgtgtgaatcatctaagcaaactctatgtctcctaacatctacttaagttcggccactctgggcagtgggtgaaaagtaagaatgttgaagaattttaggtcaaggtaaaaaacacaagtgatcagaaataacaagaaggaaaaaatcagaaactgttaattttagtaaaggcagcacctatgcatatgatgcactcctggcctccaggagtttacatttgttagtttcccttcaaaacctaacaacatttacatagagggcatacatttttaaacaggtgtctgtgtgaggtgattaagtgattatgtttttatgttttctctgcttggagatatcgtgattcacttgagtcctcctctcaaggcttagaggaaggaagccgactcagctactactgtgagttctcttcaatgagatatggaagattagctaattgttcaccaaactgtacctcttttcctcctgagcaggcagctgtatttcccagcatcccctgtagttaagcgcaggcctgagttctgccaataaaatgcaagaagtgttgcatgacaattccaaatctggctctgaaaggcttcctgctgagtctcccatgcttattatcttccctcaattgactagtgaggtgcaaatatacagcaggaaaactcgaggccctagaggatggccaagtcactgtgtgaaaggaaccttagttccctgaatgattgcctggaggaaaagtccctctcagcctcacttacctgcactggactgtgataattataaagcaatcagcctttttcatgtcaatccactgagagtctggcattgcttattacaactggttaacctaacaaatatgtatgggtatctcaggaatgcttcatagtgatccatttatcttctttatggttgtggaaagtgtgtaacttaagaacacttttatgtaaagcacattttaaaatatgtgcctgaaaagggacagctgaaaacatgtacatatgtataataaactatttgcaaaaaaaaaaaaaaattggggggctttgactgttttaatacatctcctgttatcttcaaaactgattttaagcagtactttaaaaagaagtgaaaaatcactggcttggggaagagaagaaaatgaaataaacaagacatccaaagttacttgaatggatgcacattcttatatatagctggaaacaaatagtactttgtgtcaggttttacagtctgtgggatctctcagatgaggttcatgctgtgaaaatgaattgcaaaggagatgacaagaacagatgtttgctcaagatgactgaagatgtttctgaaagcatcaaagtgtacagtctacaagttatcagcagacaggtagattgtagccaacttttagatttgtattttcagacaaaattggcttctctaagggtagttttattatacttggtaatgaaagaaagtgatctgtgtgtcacttttaacttagattgtgaataatcacgtacataaatacatgtgacgcatgtttatttcaacccaaggcatccctctttacaactgagcaaagaacatgcccttgtcaggccccagattgtgatgctcaagacctcacaaatagaagcaggaggccctatctgttctttccaagacttacactgcctaggacgaaggtccacaatccctatgttgactaatagtaaggctaaaagtggaaggaatacagaataatccaatctggtccactcctactctaaagccctgactgtaacagaatgtcttctggcttccaatagaaacaaggaatgacctagaagctaagaatataagcttatgaggccgacttaaccaattatcaggttggacatttaaatgtacctgtgttatataatggctgttcttgcactgcaataaataaatatctgggactgggtaatttaaaaagaaaaggggtttcattggctcacagttatgcaggttgtataagaagcacggcgttggcatctgctcagcttctagagagacctcaggaagcttacaattatggcagaaggcaaagcgggaacaagcatatcacacggccagactaggagtaaaggagattgggttggaggtgccacacacttttacacaaccagatatcctgtgaactcaagagcgagagctcacgtgttatcaaggggatggcctaagccattcatgagggatctgcccccaggatgaaaacaccacccaccaggccccatctctaacactagagattacatttcaacatcagatttgggtagggacaaatatccaagctacagtatttctctgtgtttcattttgaagaaaatgttaaatggaagtaataatattttctcacagcattttttgagaagtaatataattaatacatgttaaactcttttaagagtgtctgatgaatagtaaactccatgccatccactatatcatggttatcattcatggatcaggttaaaaaaaaaacgtagaggatagggaagtccccattctagtggcagtcacagaccccttgttctgtgattcttggagagcaggcaagcccctacttcagtggcttgcctgctagatggaccaggagacttggagtcaatagttctttgatacactaatccagacccttcacaagcatgtggatccagactcctaaggggtgatacacctctgtgcctgtgctgatgagcgggtccctgctctggccactgctttgggataaaaagcttctcccaggcaaggtggtcccaatcctccaagtggtcaacaatttctgtcacttactccccatcctggcccagaacagggctggggccctggtcctattgccattatcttccccaaaatcctccagaatctgatggcccttttctactagtgagacagagtccattataattcagaaaacaaaagaggaattggaaagtatctgcccctatctcccagaaaaatcttcagatttttataaaaattggtatatcttactgcagagctatacaaagtgaaacaagtgttttttaaaaatctgaaactgtaagcccagcaaaccttccaatctaaagaaaattctgacaaaaccaagataggccacccaagatttgctccaagaaaaaaaaaccatttctggtttgcatgagtaatgtgttattatttataaaaatattgtcaagcacttaatataaatttacatattcttgatatatcattttcctctttaataaaataaaattcacccaaagtatatcatagttctcaattagctatgttccaattactgcataactttttcataaattctatacatacttacgtgtatttaatcataaaaataaaataattttaactattatctaaatatatttaaaccaaatatttaagtaggtaaatgacataaatatagaatatttacatacaatattaatatatatcaatatataggttcaacaagactgcatttagaatattctatataattctgtgggttgggtatgacacatttgagtgcattaagaacatactttttaaaaaatgctgatcattgacattcatatattaatacatgaaatctgtatatatttagaaaaaatatttgattccaactttaattgcctcagaataatgtaagatttttaaatatagtatatgactacatgggaatttaattaaaaacctatgcttaatgaattggtacaatgaagatcttaacaactcaatgggatcagtttccatataggtagatgtcccagatacaaacttttctaacttccccctaaaataactataaacactaaggaaaacataaaaggaaatacctcatttaaagcaggtacttacagtaagcctaattccaggatctggaaagaatttcaaaatggcttaaagtggattttaaagcatacctggtggattgcccagaacagaaaacacttgctcatctgaaatcatacacacacacacacacacacacacacacacacacacccctaaaaaaacaaaactataggtcctcccctgctgtttgcctctccacactcaatatctatctcccacaacctttaagacataatagaattttaacaacctgaaaacttgagtagctgggcattacagccagctgggatgtgtatagcaagtagttttttactagtattattgtatgtacacatgagcacaattaatataagattacattattgatgcttacattctgatatgattgacatgctgaaaggggcggagctactaagccctatagacacaaaaggaagtgagtcatgcatgtgaacctcattttaagaaatgccaggaagaaaattgttgagaacttgtctactccacagccactgctttaaaggcagcatgagtaatctatctgccactatccgccacgcaccctccccactgccattagtgctctcttcacagatccagtaggggactgcagcacatgggtagcaaatcaaggaagggagaaacacgtgaactaaggccattctcacagtgctgtgccacacaaagctcctcctgtctgtgcccttgctgacagcgctgcttggaatgctatctgtgcagaaccactaatttccctttgcttcctgaagaaatatggaccccagctggctggctcacagcgggagtagaagaaaagatcccattgcagagcagtaatgatgcagaaaaggaaagcctcctagatactaggaactgggcttggagctttgtgttccaattgtcttctcaatctgtgaaagaccaaacaaaggagcagagaaagaatctcagaaaagcagcatacccacactggctctggagaggtgggccgtccacacaaatgcacaaataagaaaataaaaacatacagtaactttga

SEQ ID NO: 2524 - DNA, 16963 bp, Homo sapiens
tactagtgacatatttgtgctcatggagaaaaatagttcacgaaatcccttccagacaaggatattcagcagtttaagagagggtattggacaaggctcaggaggttacatatgcttctatgagcagctcttccatcttccctttcaatgctagatgccttagctcaacctaggccaacttagtcttatccttttttttatcccaaaggagtaaaaataaaggatacttatcagcatttttccatctcacaatctgcacagaaatgaatcattcattactaaacttcctttacacaccatagcctgataagaaaacaaataaagcttaaagaaaaatattaaaacacatttgtacaatctcataccaatagcaaggcaaagtcaagtcaaaaaagcatatatttaaagaaccacttcttgtgaatgtataaatatttgtatctttgttgggaacttatatattcaaaaataatatacacaacaaaaattatattacttacataagatcatggagagaaggaaattccattaaaacaaggaacaaatatctttttgtaaggatgagttcctgtcctagggtttgaagtctagatatcatgtcagggaaggtatgtgtgggagagagggtcagggtgaatcccttagagtgatgtagagaaggagatggggaaaaaatgtgcaggggagtggggctagatggagtttggggagggtagattatcatcactgactctattcttcctataaaaaatggaaataattaactcctatatttccagcaatataaaatatatataatagtataaaatatatctttcataaaaattccaaatattgtacacatatttggggctcagtaagatcagttaagttgcacaagtcatatagatactaaatgtggagccaggaaatgcagcaaattcagaagtggaatatgacattctagatttaagagtttgtcaaggaaactttggaaatctactgttaaaactcaaactaaaaattaaactccttcactcaaaaatgtgactacataagatgcaaaagcatttatcaataaaaccaaatgtaggagaagatgattccctctcatccactgcaaattcctacctgaggtgacaaaatcatttcctccacaaaataatcacacagtgtgaacttaagtgtaatggtatcttacctttagaacgttgtctaagcaacattataggagggaaactttggttactgaaagatatagcccaaagggctatgctattctaagaaaagaacaaaattttctgtaatgagttttctggtaagcacagaactttgtaaccctggagttgaataatatgtcccatttgtacatagctgatattcaaaaaattcaataagagattcagctttgtggacattaataccatgacatttgacttcccaactatttattaacaaaaaatataaaaatccacaaatatgttataaagcaaaaaaaaagaaggaagagagaaggaagaaagaaggttaaaataaaagagagtagaaacaaaagactatagcagtttagttctaaaggagagggagagctttatcaattattgagttcactctctcatgttacccagtgtggaccacggccagaacacacatcaaaaacacaattcctaccctggtatttttcctattgcaccacagtataaaatgcaagaaaccatattctccatttattaaatataatcataagaaaggcatgacttatgcctatttttaaaattatctctacacaattagtttgcagcattctttatattttaaaatgagtttactttggatgtgctgttaaggtaaataatataaaattgatagtatctttcacagttcagttgacattcacagaagctatccttactttgtctaatatatcccaagcctcattttctatgcaacacaagtaagagactagaatgaggtaaaaggcaactgttaatcaatttgttcttatagaacaacactagctttttccagtttttgtatgtgtgtgccaaagacttattcttatcaccttgagtacataatgaacctcctaggattaggcaggtggatgatatacaaagataaaaagtgagaagtgacaagtgttctagatatctaatgctgtgtaacaaaatgccccaaactgaatgagcaacagcaaaatttattttgcgtatgaccctgcaatctgggtaggatgtaaagtagatagatcatccctgttccactcagcatccactgatgccccttgaggtgtaggggctggtgtcatctgaagtaccaaacaaatagtattagagttggggatccctagacatctcttgtctccaggtggtctctccacatgatttctcctacatggtagcttcagaatagctgagctttttgcattttggctcagggatcccaagacatgagcccaagagagagaatcaggtgaaagccatactgcttttatgacctaactcagaagttaggcaactttgcatctgttttgatcacaagccttcccagattcaaggggagagaatatggacctcatctccacgtagacaagtatcaactgtatgttgcatgaggagaaaatgtgggatagatatattggtggatccactttgggaactaaaatctgcaccaatgtccttccagcaagacttaaagtgacatcatgaaacctgagatcaagagggatttctcctgaagcaaagcataaaatggagaggagattacaaatggagagaccagttaggaggttattgcaattgtcaaggtagaaattatcatggtgagaactagtgtgatgataggaacagaaaggagacttccaagagcacttgttctgacccttttctcaatggaaaatgagagagaggagaaaataaaatagaaatgtaataaagacgggaagaggaacagatctgagcagacaggattaatttggcttagaaaattttcagttgttcttgtggaatgttgaggcagaagtgtccagtggtcattggaaaatgagagtctagagctgtactgttcattaagaccacatacgactattgtgttattgaactgtggctggtttgaattgagaagtgctctaagaaaaagtacacactgaattttgaacacttagcaccaaaaaatgtaaaatatgtcaatattgtttatcttatttcttgaaataatatttcagatagttgggttaaataaaatatattaaaattagttttaccttgtgtctttttacttttattaatgtggctgctagaaaatttaaaatgacaggctgggcatgatggctcacacctgtaatcccagcacttttggaggccaagggggcagatcacttgtggccagaaattcgagaccagcctgggcaacatggcgaaactcaatctctacaaaaaaatacaaaattatctgggcatggtggtgcatgcctgtagtcccagctatatgggaagctgaggtaggaggatcacttgagcccaggaggtcgaggctgccatgaatcaagattgcaccactgtactccagcctgggcaacagaacaaaactctgtgtattagtctgttttcacactgctgataaagacatacccaagactgggcaatttacaaaagaaagaggtttaatggacttacagttacatatggctgggaaagcctcacaatcatggtggaaggcaaggaggagtaagtcacatcttacatagatggaagcaggcacagagagagaacttgtgcagggaaactcccccttataaaaccatcagatctcatgagacttcttcattattatgagatcagcataggaacaacctgcccctatgattcagttacctcccaccaggtcactcccacaacacatgggaattcaagatgagatttggatggggacacagccaaaccatatcaccctgtctcaaaagaaaaaaacagaaagaaagaaaagaaaatttaaaatgataaatacttgtcccattataattttactggactgttggtctagttttgatgagaaagcatatagggaatactttaccctagctctacactatacctgaaagcatgggattgaatgatgtctcaaaggagggaattttaaaagggaaaaaagaggaactgagaagataatcttaggaattctcacaattaaagagtagagaaggtaataagcagaggagttcatagcttcatctcctacatttcctattatatgtttatgtaaatatttactgaaagaataagtacatggaaaatgaattaatgtttgcttaatttaagaaagttcttcatgctgctcagcaaacattctttatttccctaaacccccatctactttcgttctcctaaacaactatttccttccgtctcttcaaaccttgaacctcaaatatttcctctcctatcctcactgtcagctgatgatcttgcatccccattctttaagaaccagaagcaattacaagggaaggaacctcttccctaagctttgctcccacccacctcatctggtctgcataccttcatacccatctcctctccctttaccatgctccaacttagccaacccttccacttgtacaataggtcccagctccattcgaaaaagaacacggccccaacagtactttctctcctgcaccataatgtcccctctctactggattgtttgtccaatcagtatagaaaagtgctgtttctcccatcttaatgcagccctcttttgatactacttcaccctccagttattgctttttctcttcttccctttgcatcaagatattttaaaagagttgtctatgcatgccgcctccagtttctcttccttatcctctcctgaatctacatcaatcataatttccaccatccagctgtccttgtcaaggtcactaataaagttgccaaaccggctctcagtccttgtcttatttgaccgctctaaagcaattgatgcagttggtcattttcatctacacttggcttccagaacagcatacattcctggtttaccttctatgcccctggctgttcttttcaatatccttaattgaccccttgtcatctccctgtcctttatgtgttggagtgcttcagggcccagtccttagagctcttatattgtttatgtattttctaagtcaatcccttccatccaaacacacctggaacacacctgtagttgagaaagttgggtttattactcactacaacagggagaacacatactcatacataggtaaccatgatagttttagtaagatgaggttagaaaggattattacaaggtttaggatttggttggatgattttggagagagtccaaggaagggaagtttcactgtggactgagtgctgtctgaaacttctatgattatctcaataaatcttatctatagagaagggcagactagagcaaagctacaactgtaactagcaaagaagcaacagttaataatcgaaataggaagatagttgatcttctttaaaaaatattcatgttttgtctgtgtctattttttcttgatccattgtggtcagagtggccttgcccaatgttggtgttcaatgcaattgtttatgggcaacaggggaacaccagggcttaggtaacagtgcgaggcaggctcctgaatgtcaggggttgcttttgtctaatctcatctaatcccatgactttaaattccatcaatatactgaatattctcaaatttatatccctagttcttatagccatgaatggccatgacagccaaaaagtcttcacctacaaggcttttcatactgaacatatctgaatctagtgtcctgatggtcccctcccaatctgcttattggggtacacttccccatctttgtttagataactccatcctttccagttattcagaccccaaacctttcttgactcgtatatactttatctatcatacatctgatatttggcaaatcctgatggctgcacttacgaaatgtacccagaatttgagaacttgtcacctctccagggctatccctctgttccaagtcaccatcatgcccctcctggactactggaataactcctaactgcccccaccctgattctaccttttctccacttaagtcgattctcaactcagcagccagaataatcctgttagaaaataagtcagatcatgccacccatctgtggaaaaccctcgaataagttcccatctcaaagtaagagagccaagagcctttctatgatgtgcttggtctggatcttctatctgacctcatctcctgttatccccatcctaacccacactgttttagctacacctccttgttgtcctttgaacacctagaaaatcatctatttgcaatggtcttctctgcccagatgactgttcagggcctttgcaatggtcttctctgcccagaaaatttcttccccagctatctccatgtattccttcctccattcccccagggttttactccaatgtcatctcagggtgttcctccccagcctttctgtctaaaatggtaacctcccacgcctgacatttcccctccagattaccctgctttatttttccccttagcacttacattactctctagctaatatactatatatttaccattttagtgaattgtttctctcctaacccccatagggacaggacttttggttttttcacagctgtataaagagtactcagtacgtatttgttgctcgagtgctgtattgccatgccagagagagtagatactgagactgaggaggatggctgcctggcagagcagtctggcccacatctccactggctggaggggttggtgttaaatatgcataggtgtgatgctgtttctggttccgatctcattcgtggatggagatgtctacctgtcgtgtatgctcaagccaatggcactgtatccatctgagtcatccctccctgcccagagagtgccccgctccagccattctatgtgcctgtttctgtgtatcccagatcctaggcagccaggcccagcatgagccataacattgtgctttgagctagacagcagcgcctgacatgttgtttttcctttcttagatatcattagacaaaagcttagctagggagttggaggaatgtatcattacaaacaaacaaacacaaaaatcgaagacagtagcagttcctcagttagtagctggaagggccacaggttgtcaatagcaggatggtattcggtaatcattacccttctcttttatcctaattaaattatcctagtcctaacaaaaggaataaatgaaaagaaagagctgacagtaaataggtttatagaactgaactagaaagattagaaattgcttttgtgccaaattggaacatttaataaaccttcttagaaatcttaaaatgtattgagagtattttctttaagagaattttcaagtgttgtatttgcaaaatctagtgatgtgtgacttattcctcacaaaatccagcctgtgtaattaatctttgatcaaaatatgtgtgtgttatatactttcatatatttatatttatttctgtatatttattttcatatatttgtatgcttaaatatatgtatttataaaaaatggataaaattttacctttttgagtatttttaagttttggattgtccttgatcataataatcataatagattaacatttttaatttagttttgttcaaatgacttagtgttgctccaagcagtttagaagtaaacagtaactttgctagcatccgcattattttcaaagttcagagaaaacaattttgtgatggatggaatgtttcataaatataggccacaagtccagggttttcaaagaaggatgtatcagatggaataataccagtagtacttgcttcctccgtttctttcagccattttatgttaacagtgatgttacttgactggccttagaggatgaaagaatcagaccactggagacagtgcatgctgaatttggcatctgcttttctctgcatcatcagttactagtgttttgtttgatctgtaacatgtaataacagatgatggaggtcgcaaggtgttttttttgtttgttttttttaagtctttgttctctttattttgctgtgttaaattttgcacttactttaagaggctccaggtcatagaaagaataggtgagcctctaatggacaagtcttgcagaggctgccttctagagacaggaagcctggtttctgacttaacctatgaagcagttaggactcttcctggacccagaaaaacatacaattgaaccaagtcgttttatgcatgacccattctacataagtaatctttgacacaggattatgtatacatatagacttaaattcgatatcattgcaccttgatgagcaacaagtagcttaagcaaaaaagggactttactataaggatacagtggcagtacctggaacctaaggcacctatgaatggtgctgggcctcaggaatgggcaggacccaggggccatatgcctggaggtgtgctcctgttctctcccactcctctcttcacttgctctccaacttctccgttatttgcttttcctctttcctctctctcctttgctttctcccagttataaaatctgcttttcactatgcagtaaaaaggaatggatccttattggctctggctgagtcaggtacccatgcttgcccatcagtggaagttgtggtcaactgggaaaacatagctggaaggaggctcacagctgtaaagactggtatgtgaacatcagggtaggagaactgggggtggggtgtggatgcttcccagaaagggaaccgggaaaaccatttaatgtgtctactgtaattctttctggttcagtgagccttttagtgggcagaaaatgagttgctcccaagttttaaaatctctcacagtgcctttgtccctgttccctaaacagccttttccatggttcccctccgccagtggaataaagccaaaactagcttaaatgtaacagggaaatccttcatttagattacatcaacctagctttttcttttgccactgcctctcttacaccatgaagtccagaaaaattgaactatcttccatctcctgaaatggctttatctttcccagctcttactttcacttggatggtttaatctagtggctatagttttagtatgcatcagaatcacctggaaggcttgttaaaactcacatcattggaagaatccacagaatttctgactcactaggtctggggtggaacgcaaaatcttacatttctcacaaattcccaggtgatgtagaagcagctggtgctgggatcatgccttgagaaatttaatttctcaggagtgctcttccacgcatctacatttatgcaaatgttaagattacttcattcttagctgctatgtcttattttgtcttccttagctgttaaaccaaaagtaatttctgtctttactgtgcttctgtagctagttggaattctcttaaaccattacctaccttgcattacaattaatttgtaagtgaatattccttaagggtaataataacttacctatttttgcattatccatagtgcatatcaaaaatattttctaggcatatcactggtgaacagcaacaattttgactttctctttactgttttggatgccctttatttctttctcttgtctgattgctctggctaggacttccagtactatgttgaatagaagtggtgaaagtgggcatccttgtcttgttccagctctcagggggaatgctttcagtttttccctgttcagtataatgttggctgtgggtttgtcatagatggcttttattaccttaagaatattttctatatatttttaattgaattacagatgtagaccataaccttaagaaatatgaatcctttcataggaaactggagagtatttcttatttttttcttactcataatagttgtaccttaattcttgacttacatggtccatgaactacagtttgtgaagaggtgagtggataccacttttggatcatctacattgtgctagctaacttgcatattttattttaaattctgtcagcaaccctgaagatacatactgttaatctcattctacagatgataaaactaagtctcagaacagctaggaaacttgtccaaagtcacggtaggaagtcacagaaccagaatttgtaaagggcagcccttatgatttatctttttttttttttttttgagacagagtctcgttctatcccccagccaggctggagtgcaatagagtgatcttggctcatggtaacctctgcctctcaggttcaagcaattcgcctgtctcagcatcctcagtagctgggattacaggcatgtaccagcatgcctggctaatttttgtatttttagtagatattgggtttcaccgtgttggcaaggctggtctcaaactcctgacctgaagtgataaaccgccttggtctcccaaagtgctgggattacaggtgtgagccaccatgcccggccctcttatgattttttatatcccacacttccttcccatggagaaaatacttaacactgatcatgaagtgaactgccagcaatcaaagaggtgataaagtccctggaacacagcaggtgtccaggagaagatggcccaaccaggctgccaggaaaacactcctggcttcctgatgccatttgccatgtgaagctgtatgccagatgctggattgtgagaatggagagtctttccttaaaggagaaaagtggcttcaatgattaagaagcatgaactttcatcagctttttgtacttcttctcatatattactaaaaatctacgttttttttccaaaagtaaattctgtcttttttttttattcctgaactcaaataattaataaaagaacaggcttatatgcaaaatgttacaactacagaccttactggttcaagtaattacttgaagaaatatcatatcttaaaatatttccatccagtgcatcctttttattagcactctataaatttgctgtcactgtgatatctgcagggaatgcttataaattaaaaaatcaaataacaaaactaacatcgccacattttttttttaacaatctgttctgaaggatctgagtagatgcagttgaaatatggacatacagtttgagtgattagaatttataggggaaacagtaccatttctacatgactttcatttgcatttgtttgttattctcctaattttgtctgcagtagccttggggatgagttctgttacatcgtgatatcttcctttatataactaagtttagaagtcaatcagactactgaataaattcataatatctagtcccatgatgtagataaagcaggaaatattttagctaattcacttgggggagacttcttgatgcaaggaattggaaatgggagcaaatatacaacaatgctaagtcatcacctaaaccaagcaatgataaaactttgaagcccttaggtcagggaaaagttagtaagttacacattgctgtttaattcttgttatggggaatacccatcaaagtgacatattatccactggaagattcgtgcattctttccttctgccctgtaggtggcagacttcttggctaagacaattacctcttcttttgtggcatttggggaattagcatacctttcttccagtcctttgagaaagttctctgagactagattcttgatgcaaaggtcttaatgataaagaagttctttgtaattgcatggtacatttactctgtggcaaaagcaaaataaacattcttttccatgaataggaagatctttacgcaaaggatcttaaaaattgacataattactcactagagaaactatgcctattctagaagggacaagggagagattcaaataatagggaaaattctgtgtactaccacaactagacaggagggtatctttgcttttattaatgcctagaggagtctgtctaagctttataaaacctcttaaccaaatggtgttattgcctgtgattctgcaggcaggggtggcagctgcattttaagcaaccattttccactgagttacccaggtaaagaaaggaagttgaatatctgacctatgggtagaagacatgtctcaacccttaaccctcacaattgcagtgagccatcttctcttggcatcatcatttgctccctaaaactggatcacttccattcataaacaaatgtgttctaaaaaaagttcaccttaataaaaaaagaaaagaaatcctcccaagcttgactcaactcccacttgtgcctacaaaatcatttctatgctttctcttggagcaacacgtgtcaggtgagacgaactgcctacccaggtcttctttacttctctgtcttattcatcctgtggttaaaatagcctttgtatattgttgattctcaatcttcatctcaaggctgcacagttcctctgcactttagactcctatgttctattatattactggatgtttactaggtacctaaaacttgatacattgaaaatagagaacatctgtggtggcagatgcctgtagtcgcagccacttaggaggctgaggtgggaggatctcttgagcccagaagttcaaggctgcagtgagctacaatcctgccactacatttccagcctgggcaaacagtgagaacctgtctaaagaaggggaaggaaggataaaaggaaggaaggaagagaggaagggagggagaggaagaaacaattttccactctccacgcactaaaatctgagccttcctagtcttcctcatcaaagaaaataataaccccattcacccagttattcaagccaagaacttggtaattaaccacttcccttcaaccctacactgccaaagaagaggctggatctgagatatacatttggaagtgatagaacttgcaagatatcttggtggttttgatctagggggactccctatatctacattgacccctacagtcccttttccaaggatcactgggagtcatagtttaaacacttaaatcaggtcactccttctactcagaatttttaaatttactcctatttctcttacagaaaaacccaaattcccaaacttgacctataagcattggtatgatcagactcctgcctgcccctccaaccttactgcttacctgtctccctcacacaggatgctcaagccacactggcttctgttaaataaaaattatagaagtccattgttttgaactaagatcctgcacttggctccaacagataaagggctaaaagataaaaactcacaccaaagttctgtcaccaaacaaccaatttcccaaacaggccagtttcaatcttccattggcatgataatgaagttccctctgctttaagttatgtttccactgttctgtctccctactcccgccctgcaagaaaagcaacgctgaaatgaccctctacttcatgttccttgtttctgcttttttccagtcctgttaaaactaaccccctctgatcaactcattggaacacttacattttatggattctagattcacaaataaagccaattgaggtctttaaatttgttgtaattttgtcttttgacactcctttctgttccttgaacaggacatactttttcccatttacctgaggcctctgccttgttattggttttccttgctcttttcttggcagtcccagtctaatgtgtccctccaccccccaccccacacacaccaccttcccagaccttcccagaccaccacatgataaaacagcctccctaaaggcagcagggttggtttccatcagggcacatatacctctccctacacatccccacacccctgtgcccacccccagtcccctgcccctgtaatttaaaatctccttgctggtttgtttgcttacttccctctctggttcaccacgacaggtcgagtacctggcacagcttgtggcacacagtaggtttttcattgaaatttattaaacgtgaatagataaaagttgggcttgcccctactaaatttgacaaagtgaagtcaactccatgtcagaagccctttatcaccccaccccagattcccagggaattaactcatcttgaggtatgatggaccaagatcagatctgttgcactttccccaagctatttgcaacttaatggagagggaaagagaaaggaacaagaagtttttgtgtatgtgcagttcacattttgaaagtgaagcaaatgcgcttatccaaatgtgaaaagtagcctggatgatcctcagtatcattctgttttataaaggatgtaccattcatgtttaagagccagtgcatgctaatatttcagaggagatgggtactttgagagtctgatgcaagtttagacagaaatctaaatgaaatgcatatacgtaaagataattacatacaatttgagtggggcatgggcctccagaaacctatccattatgcatcctgaagatcctaaacaaatcgtccttctattttactatgtgaacaagattccactttctttcatggtaaatcctgggtcattgattttgtttatagctcttcctaaagcaatttgaacttccccactgcccttatagcttgaagagaatatgttaactgggaagagtgaaaggaaggaatactaacatgtgttagacacgaaaatgtatccagcactctgcaatgcaagttctgaggaatttatttctcaaatttaattctcatatttatttatttattacagaattaagttatcacatttaactataaaaacaatccagtaagactgtgagtcccatttttgcagactgaaaaactgagggaacaaaaggacaaataacttacaaataagaagtttatgatggagcctagattcctatccagattataaattcattttctgaatcttatactacatattcatattttaaaagtggctgattcattctttcatttaactaatgatctggacacctcctcctcaactctctgacttcgtcttctgttgctcttccctttgctacttttatccaagccacattggcttccttcctattccttaatctaacatccttaaggaaaagtctgctatagaagctattaatagactattggtggtgagtctgtaaaatataattatttatatgaataagaatctataccttcttaagaaatgtattttggtaaaaattatttagaagatgattgcctctactaagatacttgcaatatagatatatttgtgaaattaaaacatattatccattctaaagaaacaattactaattaaaatggttacagaacaaatagttttacaataaaagcataaacaaaatctcattaaaaatgtgctaatattttacccagtttgtagatattaactccaattcttttaaacagcggcagatttatttatggaaactgcaagcataatgagttcaaatattctactacattctatataacacatttactggccaaaacatggcttttaaattgtgactattggaaaaatactgcacatttttatatattcatgtccttttgctttttaaaatatactttttatatattcatgttctgttgcttttctggaaataaaatcactctcttgacctgtgaatattagtatataactgagaaaacttataaataatgaagaatccatttcgtatggtgaacatattaaaattgttgtatggtttgtgactcccacaatcactgtaaatctttcatgggtgaattttcctctgtggccttcagccatgctcagacatgcatttcccattccataccagctagctattctcctgctgttagatcatgtaccaccaaaaattaattttcctacccagacattattataatactgaagttgctgtgaatccttccctatccatatttttattttccctcatatgtatctatttataaagagtgtattatactatgcttttatttgtttctatcaccactatgctctcaatatttggccaatgttagtacatgaagatatagtgcatttattttaactcttacataatatgtcatatataaatggtaatctacattgtttccaatttttcactattaaaatcaatgcagctattaacatccatggcacatacatgagaatttccctactattactagtatagaatgcaaattttcaacattactagatattgctaaactgccctctaaagtagtttgaccaatttattctcccaccactagtatttgataatttccaattccctataacttctcccatatttggtacggccagatattttcatttttttttcttacctgatgagacataaaattttatgcccttgatttttttttaaacttgtatgatcttgattactggtaagcttgaacattttcttatttattggccattttcttatgccttgttataaactccttgttcccattcttgagtttttattctactcaatcaattggttttcatttcttactaattcgttggagttataagcctggaacctaatctttttattttcatttgttttgttatataaaaagactcaagtatatataacacaattatcattttttgatctgtaactggccttttagctttttattttgatatactacagcttttaagtggttgtggtgtagttaaattgatctgtcttctcccttttggcttgtttttgttttgttttgtttgggttttgtttgtttgtttgtttttgtatgcttttaaagaactctcttgctattccaaggcagaatatatatgtatagattcccctatattttctacaaaatttaaactatttttgattcaatatctatgtgtttaaatttgtctgcattttagtttgttttaaatgtcagctacaaactcaatttatctttgtatttgtacaacttattacttcaatgtcaacaata

SEQ ID NO: 2525 - DNA, 21856 bp, Homo sapiens
tgagaatgtagaagatcaaatccagaccacagccgaaaccttgataggagggacacatgatgaattagcctataggctgaaaggtctggaggaagttgtgatggtatgggtcagatatcttccacttcctctgtgaagtagtagaaagtcattttttgagaaagcggaagtggggagagtggtgacttgaaagagtcactttgggatatggtagagcaagttaattgggaaatagcggataattaggcaatttgaagttggtgactatgaactttgagaagcatcaaatctctcaatccatttctgtcaatttaccctactactgaatgatttaattcattttgtgtcaccagcacctagcacagctcctggcacaaggtagatgctcatatttgactcaattagaaatggcaaatatctgaattgtctgaacacaaacagtaaatggtaaataaatactggccttcttttaggtttgcaaaacacaattgatttgatagtgaaggccaacatatacataaagaaaaaccagaggcctcgattttacattcaaggtaggtcactggtacacaggaagccagctgaggagaggtacaagtgaggggacgtgaggagcacgggtggtgagtatgagatggctgcccagtcacctctgctgaaaaccacctttgagagtagcaggattctagaaacaggatcaaaagaatcagtgtagcaccatatatcactgcctctgtaagaaaactgtgcttgtcaacctggagtttggggaaaagctttaaaggaaacctgtcattctgtactccagcttccaactttgcaaaaggcacttttccttggaactcaggcagaaaaataataaatcacgcctagctctcttgctcaggatccagtcccggttccccacctgtagttccctccagctgcttcctgctacttccattcctgcaccttatgctccagctattccaaagtacttcctggcttaaaacaccaagtgatgttgtaagtcccaagctttgtaagtgatgttctctctcactggagtcctttctctccccagccccttccattataaattcccactcctcctcctcagatgtctcttcttctacaaagcctgtcccgcccctttcacagagtaaagaagcccacccctactgtgtccctgaacgtggctttaggcatggaagaaactacatttaacctttgttccccataacttgaaaagcaactggcacatcatagattctcaatgcatgtctgttgaattgagttttactgttcatctaccttgcagacaaatggcatttcttagatatcaattctttttgatttcctttttccaacccatggactataactttttttttttaactaatttcaggaacacatacgatgtatgcactactggagtctgaataaaatttctaaaaagtagaaataatttaaatgaaaactgatttctttattctatcagtttttgaactcaaactgtctagaaacaagaaggttcatattgatttaaagatgtataaaatataacaaaagacatgcgggttatggaaataagactgttcattctccaaattcacaaatattagaattaaaggcacccctgaaagcctgaagaaggtggctgtagaataaataaaaggagtgccactttacacagcaggtggcaaacatgaaacgttttattgtaagaattggtacagacttgaaagtataagtacgttccaaggaggacttagctataatctaggatgatggttccagcatgtcactgggtggaaattagagctatttactttgtcagcagggcatgcccaccccacacttactcacgaagtgccacctgtatctttgccactgtagctggagcaccgagcaagatacatccagttggtctgatctaactcagcacagcatttctggtgcttttatactctctagaatcatagctatgttgtttggagaaatttattttcttgaaataggatgcagttctttctttgattcatccaacgtaactctcatcgatcttttaaaataaaatatcttccaaaatatttacttcattgaacaaatacatgagggaggtcaaagagatatattgcataccccacccatctgcatgctgaatgtctttctaaaccatcaacccttgagaagggaaaggctgagttaccaagtggactgaggtggatatgtggcaattggaaccatattgaaccatgcaggaaacaaaaagaaaagcacagaaagaacttatctggaactaaatagcaagttcggttcacaaaagttttattcacaagtttttccatgtgaagaccttaaaattccactcaataaacatgtttataaaataagcacacaaacagcctggaaacacatgttagcattatataagaagtagagaaagacaatgaaatcagtcctgtcctccttatgctaattttgatttaatgtctctagggacctgtgctcatggaagaaaatcaaggaacatcttaacatggaaaacaacagaaggctaaacttgtggctcagcacaggagagggtagtagaaaacctggaattgacgccctcttgaaggctgccaatgtttaataacccccagagcccattgttgtaagatgtggctaattctagcagtagttactcataaaagacaagggtataaatctggaaacctaagataaagactatgaagaaactctgaggagaaagagattggtcgtaagcaagcgtggaagaaaagtggcagccagtgtggaggaaggaggggcagtatgtgagtggataggctggggctatgcatatgagttgtgttctctttgctctgtacaacttcacttgccctcttaccactggggtggaagaatagcagcaccagcccaccttcgtagcagttatggggtatatttggggcagagctggaatctgggctgcattgggagaagattagcctacccctaaacggttcctccacctcactgtccctctccacagcccaaagcttaggacttgacaaccaagtagcaaactaagttgtaaaaagagagcaggctcagagcagaggcatagacagttttacctaagagcagagtttcttataaagaggcagcaaatgctaacctcaagtacaggctttggtgatatgaactctgtgtcctggggcactccatcaccctcctcttcttaaactcaccaggaatgacaaagactaggatctggctctggctcttcctctatatgactgatacctgaagcagacaaagtgggatagggttcaaggcagcagtcatgatgagaggcaatacactgaacaacttacacccaataaatcagaactaatgaaaacgagaaatcgagaagttaaaataagcaaaataaatgtcatcaaagagggaagagagattattgataacatgaagcaggaacaagaagttataaaaatctgaaaagaaaaacaatatatgaagaatataaagttgaaacaacttcctagatggaataaatagcagaatggatacaaccaaacaatgattgagagcagatgcagaaattatctcataaggtattggaaaagaaaaaagatataaagtgtaatagttaagatctgtggaatatacaagtgtccacatctttttaacaacagtctcagaggagaggataataaagcagttgaggaaataactcctgaaaatttctatgaattaaagaaaggggaaaaactatagattaaaggtctaacaaggaaaagaaggaagagaggaagggagagagggagggaaggaggggaaagaacaaggaaatgagaacaaataagaaagaggagaaagaaaaagaaagaaaagaggatggggagaagaaaggaggagagaagaggacaaaagaggacaggagagaagagagggaaaaaagaagtcaaatgtatagaaaagaatcaaggactaacagactacactgaaggttcttaacttgttttggtgccatgaatcactttggcaatctggtgaattctatggactcattctaaaatgaaaaaattttaaaaattgttattaattgcataacacaaaatacataagattataaataaaaccatttatgttgaaaaatagttaccaaaatattttttaaaaaacaaatttatgatatagtaataggtgttctcccttattaatgagaacacaacaagacttagtggatggtctaatactgtaattttgaagaaccacagccaacccattttatcatggatgaaaaaaatatacattgttgctgacacaaaaatgtaagttggttgtaactgcagcctaaccaagtattaatgataaacatagctacatggataaaagtagaaaacaaagcaagatttatagtacgataccactgataaaaattaaaaacacattcacacgcaaaacaataccacagacttaacaaggttacacacattatgtaaaacaattacatcaaagacaccaaagtgaatgctaagggagaaaagggaattggagcagtgatcagagaagatgaaagagaaagaaaataagacaagaagaaggctttgcaccaatcagtgatggcaatgtgctctaaactaaggataatgattaacataactctcagtacctaagatctaattaaaacaaacaaccccatcaaagatgggtggaggctgaaagtcagacattattggcatttgagagaatagaaaaaaaattacaagatagcaactaaagattttatacaagtaaacccagactttgtcagctctaatagtcctaaaattgctgttttcagagatgtccttaccccacctcaagagagtacaccattgagaccaggtcaggcataaaagcctgtcagcctagagaggacatggaatagctctcagaactgtcctaatctgaaaggccagccacaaattgtcttttccagttcagacaaaggacatcctcaccgtccactctcttgtcagtggagacagaaaaaaactcaggaatccaatggttgtccagacatttgggtgaagacatgacattccatttgtcttcaatcattactgccgctataataaaaataccttagtctgggtaatttataaacaacagaaagttatttctcacagtttcaaaggcagggacgtccaagatcaaggcaccagtacattcagtgtctcgtgagggcttgattgtgcttcaaagatggcaccttgctaatgtgtcaccacatggtggaaaaggagcaagggagcctcttttataagggcactaatcttatccatgacagtggagccctcatgacttaatcacttcccaaaggccccgcctcttaatactatttcatcaggtattaggttctaacatgtgaattcgtagggggacacaaacattcagaccatcacaccatctataccaaaaaaaaaaaaggctgaatatgctctcctggtctttttactgccccctagctgtaggtggtagcaataaacaactggttgttttcattctgtttctctatctgcctcaccacctctagaagggccctaacttaagttggagtgacagcatacaaaactctccaagcaagtcctcttggtcccccaatatgccatgaagcatgctccccaggagaaagcctgtatggaaattacgctgatgcattcctccttgcattcaggtttggtaagagcaggctgtgtgcaagtggttacagctgctcagtggaccaggctgtggaaaacaaaaacgaaggctttgatttcatctctcccgggtattctccacatcacttttgttgtgtgcgaactaataataacagatctgatctacatacagttcttcttgtctaaaattactcatttaaattaagcattttagtcactgtttgataataagatgcaaggtaaagtacttgtgagcacagaaaattaatagaaaggaaacactgagcgtatgttgagtttagccaccagcatctatttttaaagatgacctaattaattgttacatagaatgtcaggagaaaagaaacactggcaaagcttttagacaaggcaactactaactttaaaagtatggcactgctgaaacagctgtataaaagcttgcagcatgatttcaacacagttgtcaagcatgctggaataaatacatggcaataaaaagccatgtaaatttctgggagaaaaaaaaaatgacaggactgaaagttgaactttaaaaaaattgtaatttttaaattgtgtgtatctccttaagataatcctcatttagtaaatcatatttacagtcattttgccacaggcttttcttccctagctatacatgtatacagcaccatgaagctttacactgtttttcataagagttacggttatttaaatggcaaataaaccaaagacaaagacttggtttttattaaattacagcatcctaaaatttaaacaaaataatccaaatgctgaattcctccctgaaaaactgacataaattgcaataaaacatgctcgcaaaactgaagcatcctactttattttcacaaataaaaggtgattctgaaaattgacttcacttctaaagtaggaaagcaaaactaaagaataaatactgtaatggaatgtaaaagaatatgtttaatagagaggttttataaaagcattgcctaagcataagaaaactagaaaatggtattttaaagactattaacatacatctctttcaagaaaacactaatctaataccacataaaaggagaggtagcatatatacacctacttagattaaaccccagccaccaatatacactctgaggtctttataacccctccttgcaaaaaaggagggtgtttgattagtgagtttaccaaattcacattaactgggagtggaaacctgccaacgggacttgcagggttgaaggatagaagaaactcactcatgtcatgtccctctatccaaatttaataagataaacaaaaactagcaaataaaaattaaaacaaaaactcaccaacaaatagcaaacaaagaaaaagccacaagccaaggccattacctcagaaaataatgggtgaggaaaaacaaagaagattccagagcagagcagggcggcctgtgtaagggtgtaaggaggctccatcacgcgcgcgcacacacacacacacacacccctcacaagttacacagcagagctgcaaaatcctgcaccctcacatcaataatggatctggaaagaggcgaacttagtagggtgggcctttttcccttttctggggagctgtggaagggatgctagggagaaaaaagcagttttctggcaaaagagaagcctctaggctacaggatgaattgagggaggatcagaagcaagtggggacgcctccagggatagaggtcacccccctccccccgcccttaggtgaacatttagcattacctctctcagaggtgagaatccagactaactcctgcacccacctcgactgagctctctggctcccagcctattcccaggaaacagaaaagtggatcaaacaccaaaaagcagagcctgagtggtcttttcttagtagaaacaagagttctcagattagaagagaaagacagtcaaggacgatggttatttctggatgatgggattagaggtcattctttttactttcttctctgtactgttccgagttgcttaaacattctttatcatacacttaaaatttttacttacaacaaaaacaattttaattgaaagaagaaacgcgactatacaaatttttaagaaccatgaacctgaggtaggaaaacaacaaactacataatgttcctgtcttcacaagataaatcccacctgtgtggccctttgatctttgagagaagagcaaagaaggaaaagaggagggaaacatcaagatttagaaaaaacaagatgcacaaaagaggaagctgatctgtgagatagggaggtccaggctctactggaacagctggagagatagaatctttcttccagtcctagattttccctcccatttccagcctatactcctacaaattgattcttccatcatccaatcaccaccaaaccctgacactcagtctcagtcagctctagctagggaagcaattgcagggggctgatgtgagaattgcattactttagtgcatgtgtgtccatgcatacacttatgtgtgcgcatgcatgtgtacagtagagctgctgaagcaaaagacttattccaaacatgaacgatgatatctgaaagaaaatataccttctttacttgaatgcactttttctaccaaaaaaactattaaataactaatttctataagacatgaataaagacaactataatgacaaacaagattcaaagggtaccctagaacttaaagtataataaaaatatatgtataaaaaaagatttaaagggtgcatcagcagaaacacacactattctgtcactgtttaccctatttcagtggatttaaggatcactgattatacgatgtacccttattttatgtgctactatgagagaaaaaaaattatcaggtaaattataactcagtacttcctcatcacatcaactgcaagacacatgctgatcacagggatgttagagtgaacacaatggaatattactcattgctcacacacctgtcaagatgtgtgatccttgatgggtcctttaactcttctggttatacaatgttgaactatatagcatttgtaagatcctcttatgttctgaaaattctgtgcttccaggtctgtggttttctcccagaactaagatattttggagccctggggccttccaggccacaaagaacaggagctacaggtgggatctgtggtttggaaagactaagaggctccaagcctttggggcagccccttcctcagctctaacaagaaggcaccagtgaaaagacagctttcctccctcagccaccgcctctctctcacccatacctccgttcagggctttttcccacttattcctatttcttggttcctcttttcccaggccagaagagaaagcagcagaaaggaagatcccaggcctttttcttccatctaatcaagacttcaggatggctttcttgcagtcagggaatggttgcctgggtaaccaagtattaactataaggatctccccttctctctttttgctagactaaccattctggtttctccctcctgtctgagtagggagttaatagtaaaaggatttatttaactaggctctggattttataacccttgctggcttccaacagcgaactccaaactgccttttactggaggcttgtcttaaatgaaccagaactactttttctcatctattattttaaacctaattggaacacagcaaagcgaaacaagtttgaaaggcagtcagagtagcttccctatgccatgatttatcaatgtctgaggctagcatattaaaatatagctcttgttttgtaccatcaagattggatgaaaataagaatgcctttagaagggaaagggctttcttaaccaaaatatctaactctactccttatcactgttcacagagtagattattgtatttagttatgtggatgatgggtggggcccaaagaaatagatccggggtctggggtacagtgtggtaaatgcaagcctgaaaagatatcttcagaagaaggtgtgtaacagagggataggggttgtagtaggctgttcttgtattgctataaagagatatctgagactgggtaatttacaaagaaaagaggtttaattggctctcagttctgcaggctgtacagggagcatagacctggcatctgtttctggtgaggcctcaggaagcttatcaggcaggggccataacagcctgcccttctctctggcttcttgttgagtttaatcagtgcaaaggacttgccagggatgagaaagtaggaaagacaaattgagttacgtataacaccctctttccctgctgggttggcagtgactgtttctctgctgaaggccacagctcctgcctggcagaactctcctacaaatacaacctccatgggtttcagcagcttcttcaagcctaggtggtagggggttccccctgtaactagggcatgggtgcttcaccatcccatgttgaattcccttaattccttttataaataaatccttccataaccactttcttcagaattatttatccatgtataagaatgatactgtgattattttttcaagtgggctttaccttttagagatacatcctgaagtatttagggacaaagtgatatttaaatgaagcgtgtttggtcatgatttgataaccgtcaaagctaagagatcatgatttggtaatcatcaaagtaaaagcgttcagggtctttataattttccctctacttttgcacatgtttaaaatttttccatcataaagaaattttttaatgataaaaaaaatgtttaagcacccctttgggagatgctgtttcccatagggacctggactgacacaggagcagaggaggaatgagcagagaatatcagcaagatgaatgatatagtttggataattgtccctacccaaacctcatgttgaattgtaatccccaatgttggaagtgaggcctggcaggaggtgattagatctggaactgaatttctcatgaacggtttagcaccatccccttggcactgtcctcaggatagtgagtgagttcttgtgagatccgatcatttaaaggggtatagtaactcccccctcactctcttgctcctgctctggccatgcgatgtgcctgctccccctttgccttccacaatgtttgtaagtttcctgaagcctccccagaagctgagcagatgccagcatcatgcttcttgtacagcctgcagaaccatgagccaattaaacctcttttctttataaattacccagagtcaggtatctctttatagcagtgcaagaacgactaatacaataacaatggcctacttcataattttgcctggagttagccctaaaagtaaaggctgcaagtgatgtgtttgtggtcctttctgaactgggactagacagtaaaatctcaataattcactgtaattaggaaaacaattcaatctgactcagcaaagatctgtattataaactatttcttaaattcttttgaaacttgaacaatgtattcattcagtttggactggccttcacacacacagactttggagagttccaatcttatttctcagcacaccttgttggaaatctttataaaaacctctttcatagccatcgtaggcagcttttcctcacactatcatagagtacctggccctctctccacttcaaaacactcatctcaaaatttagcttgtttcacctctcctttaaagtctgtcttaaccatattggcccaaaaggaactcttcttagaaattattatctcacctccaccaatccctaggtgaccttgggcaagttacttaacctctcagacctcagttttatcatctgcaaaatgggactaataacagtacttatttattagaatttatatcagtattgaatgagtctgagattggctaatactaggcattcagtcaacgttaggtactatattaccatttattcagcaaatattccactatatacctggttttttctaagtcctgaggatgtaacggtgaaaaacataaagcccctgccctcatggagcttcctttctagcaggagaggcagataataaacatgtaaacagatatatatatatatatatatatatatatatatatatatatatatatatatattcaggtttcaactagtgctaaatgctatggcaaaactaaaatgagtaaaaatgatggaaaatatgatttttggtacagtggactgggatgccctttctaaaagggtgacattttgatgataaaacacatattgaaattagtttttaagctcattttactgcctaaaaagccctcttaaatatatatcaaaagctttcaaatatttgggaatgatatattttccaactcagtagccatgataatccagaatcccaacctgggttggcagactcatcggtggacaagttcacatcgtaaaccttcagcatgcattccaaacctgccttttcctttcattttaaatgttatcttcctcatgttgtcttcctaatactgacctaatttttcaaacatggtgctttgtcaccgcaacttcttcacactgttgacagagtcttctcttgctgccttttcacaaaggtggccttttactttcttcacctttgtttcctaagaaattgcccacagcctgccttacacctttaaactggtttcatgccactgttcagctgttttccttttatatcagagtcactgtcactgaattattccacctctttactccctcttctttattctctttgctgccatatatagccaaagtgaaaggagatcccaaaagaagctgctaactttggggaggtgtgtttttggtactggtaggagtgggggaatcagagaaatctgggcatgggagagttgaagcaacatgatccaagagctctgacatcagttttctgacaatttcaaaatctgtgaataaaataaggatgtgtgttataaagtatcaggagaatcaggaagataaataggatgctttttcgcaagggaaaagaatttctactaatgaaaatcatcaccaatgactcctttgtaattgggttaatggaatgattttaaaacacacacccacctctagctatataaaataatacaggatactttaatcctgagatcctggacttttcccactgtgaagcaataaatataaataaatatcttggcttaacattcctctttacctcctgcttcttctctctggtgattttttttccttcttctttatgcacaaggccccagatcactcaagattagaaaacataaaaggctcagaaattaaattcttaagattaaggaattcacttaagccacataaatttagagcctttctttgccagccaggaactcagcaactcagattaataaacctcgtttctgaagttgtgataaatgaaggccatacaaaatcagccaggttttcagcttgttgcagggtccacatgagtgctgggatggagccatcaaccaaagattggctcatgcacaaaacattccaggagccaggaaaggcggcgatgggactgaacacaaagctctttagtatgtgcaacaattaatgttttaaatattaaaacaaattaatatgagagagaatgttgctttcttataacaaaaactcaatctcatctcacaagttaaaatattacagagaagaaaagatacctgaaaatgctagctttttgcactctcacatccttatggagtcctcttatgaaaatatcctggattgttctagtttaaatttttttaaaggatctgaatatttgttcttaaataacttgtttaaactagtattggtcaccttcaagtgccctctggtgtaacttattttaatcttccagacaatactttaccctgatcaaaggaaaggattctttttttgctccttttgtgtttggattaaaaattatgatctgcaagcatgagttgaattaaattgaaagtttcttcactaagagtaggaaatcactaactctaaaacatccttttaaaatctgggcatagaaggtttagagtctggcttcccagtgtggctgaaggtggaaagtgggggcaatctgcaggcaaaaaggaggcaccctgtctgtagagaatttacaaacataacaaacactttatacaagtaataaagttttaataatgaaactgaccaaaaaccagtctgctccttatcatcatgtacatgccaacaattctaactaatataagtgataaaatgctgttccctccccaccaaaattttgttgtataagttctaacaattgttgtggttactgttgggttttaataatatatatgcaaactttaaattagcacgtttttactgctcatccttttatacaggcatacgttttattgcactttacagatattccatttttcacaaatttaaggtctgtggcaacctttcatcaaacaagtctatcgctgtcatttttccagcagcatgtactcacttgtgtctctgtgtcgcattttgatcatccttgcaatgtttcaaactttttcattattattatatcctttatcgggatctgtgatcagtgacttttgatggaattattataattgttttggggtaccacgaactgtgcccatataaaatggcaaatttaatcaataagttttgtgtgtgtcatcactgctccactgatcagccattcctccatctccctccttcttctcagacctttccttcctattccctcagacacaagattaaaattaggccaattagtaaccatacaatggcttctaagtgttcaagtgaaaggaagcctctcactataaatcaaaacctagacttcatgaaagacctaaaaccatgaaaaccctagaagaaaacctaggcaacaccatttaggacataggcatgggcaaagacttcatgactaaaacacaaaagcaatggcaacaaaagccaaaattgacaaatgggatctaatgaaactaaagagcttctgcacagcaaaagaaactatcatcagagtgaaaaggcaacctacagaatggcagaaaatttttgcaatctatccatctgacaaatggctaatatccagaatctacaaagaacttaaataaatttacaagaaaaaaacagccccatcaaaaagtgggcaaaggatatgaacagacacttctcaaaagaagacatttatgcagaaaacaaacatattttaaaaagctcttcatcactggtcattagagaaatgcaaatcaaaaccacaatgagataccatctcacgctaggtagaatggtgatcactaaaaagtcaggaaacacatcctagagaggatgtggagaaatacgaatgcttttacactgttggtgggagtgtaaattagttcaacattgtggaagtcagtgtggtcattccttaaggatctagaagtagaaataccatttgacccagcaatcccattactgggtatatactcaaaggattataaatctttctactataaagacacattcacatgcacacatatgtttattgcagcactgttcacaatagcaaagacttggaaccaacccaaatgcccatcaatgatagactggataaagaaaatgtgacacatatacaccatggaatactatagagccataaaaaagtgtgagatcatgtcttttgcagggacatggatgaagctggagaccatcattctcagcaaactaacacaacagaaaaccaaacactgcatgttctcacacataagtgggagttgaaccatgagaacacatggacacaggaaggggaacatcacacacgggggcctgtcgggtgggggctgaggggccaggggagggatagcattaggagaaatacctaatgtagatgacgggttgatgggcgcagcaaaccaccatggcacatgtatacctatgtaacaaacctgcacgttctgcacatgtactgcagaaactataaaaaaaaaaaaaacctctaacttttaataaaatgttttatttatttctatgtggaataaaaatcaaaaataagccaggaaaaaaaaaagctagaaatgaggaagcttaatgaggaaggcaaataaaaagctgagactggccgaaagctaggcctcttgcactaaacagccaagtcgtgaatatgaagaaaaaattcttaaggaaataaaagtgctacccagtgaatatatgaatgataagaaagtgaaacagcattattgctgatatggagaaggttagagtggactggacagaagatcaaaccagccaacacattcccttaagccaaagcctaatctacagcaagatcttaactctcttcaattctatgatggctgagaaaggtgaggagccagcagaactaaagtttgaagcagaggctggttgatgaggtttaaggaaagaaactatctccaaaacataaaagtgcaaggggaagcagcaagggctgatgtagaagctgcagcaagttatccagaagatccaactaagatcattgatgaaggcagctacactaaacagattttcagtgtagctgaaacagccttctattggaagaagattccatccaggattaactagagaggaaagctcaatgcttggcttcaaagtttcaaaaggcaagctgattctcttattaagggctaatgtggctggtaactttaagttgaagccaatgctcattgactgttttgaaaatcctagggcccttaagaatgatgttaaatctacattgcctgtgctttataaatgcaataacaaagtctgaacaacagaacatctgtttacagcatgatttactgaaaattttaagcccactgttgagacctactgctcaggaaaacagattcctttcaaaatattattgttcgtagacaatgtaactggtcacccaggagctctgaaggagatatacaaggagataactgtgattttcatgcctgctaacacaatatccattctgtagcccatggatcaaggaataatttcaattttcaagtcttattgttaagaaatatattttgtaaggctatacctaccatagatagtgacttctctaatgaatctgggcaaaatatgtagaaaaccttctggaaaagatttaccattctagatgacattaaaaacatttgtgattcatggaacagacagttctcaaaagaagatatacaaacggccaacaaacatgaaaaaatgccccacccacatcactaatgatcagggaaatgcaaatcaaaaccataatgtgacaccaacttactcctgcaagaatcgccatactcaaaaaatgaaaaaataatagatgttggcatggatgtggtgaaaagggaacacttttacactgctggtggaaatgtaaactactaaaaccactatggaaaataatgtggaaattccttaaagaactaaatgtagagctaccatttgatccagcaatcccactactgagtacctacccacaggaaaagaagtcattacataaaaaagatgctttcacatgcatgtatacagcagcacaatttgcagttgcaaaaacatggaaccagcccaaatccccatcaatcaatgagtgcataaattgtgatacacacacacataccatggaataccactcagccataaacatgaagaaaataatggcatttggaccaacctgaatgggactggagaccagtagtctaagtgaagttaagtcaggaatggaaaaccaaacattgtatgttctcacttataagtgggagctaagctatgagaacgcaaaggcataagaatgatacaacggactttggggactcaggggaaagggtgggagaagggtgagggataaaaaccacccactgggtacagtgtacactgctcgggtgatgggtgcaccaaaatttcagaaatcaccactaaagaacttattcatgtaaccaaacaccatctattcccccaaaaacatattgaaataaaaaaaatgaattaaaaaaaccattcgtgactcaggagatcaaaatatcaacattaacaggagtttggaagaagttgattccaaccttcatggacaacttggagaggttcaaaactttggtggagtactgcagatgtgatgcaaatagcaagagaactagaattagaggtagagccttaagtatgactgaattgctgcaatctcatgataaaacttgaacagatgagaagtcgcttcttatggatgagcaaagaaagtggtttcttgagatagaatctattcctggtgaaaatactgtgatcattattgaaatgacaacaaaggatttagaaaatgacataaacttaatttataaagcagcagcagggtttgagaggatggactctaatttttgaaggaagttctaacgtggataaaatgttgtcaaacagcaaagcatgctacagagaaatattttatgaaagagttaattgatggggcaaacgtcattgttgccttattttaagaaattgccacagccatcccaaccttaagcaaccacgaccctgattagtcagtagccatcaacatcaagtcaagactcactgaagccttagatgatcattagcattttttagcaataaatttttaattaaggtatgtacattactttttagacataatgccattgcacatttaatagactataatatagtgtaaacataacttttatataaactggaaacaaaaaattttgtgtaattcactttattgcaatattcactgcattgtgatcatctggaaccaaacccacaacatccccaaggtatgcctgtatatattataatctacaagtaagctaattcagagaaatcccagttatacagctgactccagacacatgcagtcttggacacacacatatgtgttccataagcaagtttgtgaaggtttgggaatcattccagctcacttcgaaaaaacttatgatactccatattctgacatttaaacagaagattcaaaataaataattataggatattacttgcaaaaaaaaaagaaacaagtaaattcatcattccacatgattaatggaatttttgtttttaaaaatgtaaagtgacgaaatgaagtacagaatgtgagatgtagtatttttattggtaagtgtaaactttatacatgattttgctaaactttaataatatctttaaaattgatatttcttttgttattcttgtgattatttaataaactttaatattatttattactgtcataaaccaataattggttctttccctttgtgcaaaaatttatactaatgtaattaaaattaccaatccattacttttttccttttatgtacataacattttttatgtttctttactttttaaaagcataattatatatatgaagtccagtaaaaaatttccacaatttggctgggtgtggtggctcacacttgtaatcccaggcctttgggaggccgaggcaggtggatcatttgaggtcaggagttcaagaccagcctgaccaacatgatgaaaccccatctgtactaaaaatacaaaaaaaattagccaggtgtggtggcacatggctgtagtcccagctactcaggaggctgaggcaggagaatcacctgagcccaggaggtggaggttgcagtgagccgagatcatgccattagcactccaggctgggtgacagtgcgagactccgtctcaaaaaaaaaaaaaaatccacaatttgtatttcctttatggccattattatgcatattatatattattcatataaaataatttttaagataattttgtcacctaaaggaaggaggattaaaacgttatgtgctctgagtgcaaacatgctttgtaccaacatgctttctggagttttctcagattctttgactttcttactttttgtctcatacaagcttgcatcaaaattgtgagctggcttaagatggtggattataggaaaactagaagaaaacacttcctagaaaggaatagaagacaagtaactaacatgcatttattcgcccctttattcattcaacaaataactattaaccatctaccaccataccaagcactggtctaggcaccaggaatattatttcatgccgtctggaaggttgccttttaatagaaaaacacagacaaataacaaacataatgaacaagtaaattatgtaatatgttagaatgcagtaagagctatagaaaaaaataatgaattcagcatgataaacgagtgccaggacattggagttttaatagggtagctattggttattgggaaggtatcttttgatcaaagacttgaataagttgagaattagccatgtggacatctagggaaagtgtattctgggcagagaaaaccaaccagagcaaaggtcatggggaaggggcatgcctggatcgttccaggaaaagcaagaaggacacgaagcagagagtgaaagggaaagaaaggagtagtagatgaaattagagaggtcaggaggatcagattgtacagagctttcttaaacctttaaaacgactttgtcttttactctgggtgaaacagggaaccactgcagggctttaagcagaggaatgacatgatacaactcatgatgtttaaaacagtggccttagtataagtgggttgactaccttaaaagccctccaatcttcctggagcgatatggggtggcccacctaagacatctgtccccattcatcaccaagattgatccgtctgatctgactgactaggagtaccattcttccctgccttcttgccttgcatcgtcctaaaggcgcacacctggtcaaccctttcagatttaggagaggcattcttcaggtaagggtctagaggtgctacctgatgctaaaactttgaccatttgagattatttttcacctactatcttcaagactcttctgtaaaactataaattgctcttgaattcttaacctatgaaaactgactttttgatataaattaaattagcccttaaccgacaattaagcagataactgacaggtgggaatgaacaccagaaacattcacagcaacacacacacgcacccctagacctcaatatttagatattcatcatacatacattttctatccacaattgactacaatgctaatagttctcaaacgtacacaagatgtacgtaatgtcctgtccatttgtttccctctttcactgtcataactgaacagggattattggaggatatagtgaaaagaagggcaaactcagatgttgtgcatggcagccatgctaggaagtaggaaaagtagaggcaagaagacccctggagaaagatttgtctgcctaaagtttgaaccaaagccagcttctacctcaggccaacccattctctgaacagaaggaaaggatgcttcctgaggtactgacctggcctatgaactttaccctcaggagagctgaccaaaggatgtctcctggtagcctaattggtcctcttggtcctcaaattctcttttttaaaaactattacattcattctacctatgcgttttttcaataaattgtattaatatttcttagtcacaatagaaggcttttaacttctcaattatttttcagtctcttccaagggtagtactatcagaagcaagatgaaaagcatcaaggtgggtaccaatttttacccacacttagcaccaaaagttgaatttgaagctaggattgggcaaatacaagaatgactatttcctaaccatgtataaaaagctgtttcaaagttttctctgatgttcataaacatcaagtatcttaccagtaatcacagttctaagctggtaattttccagtacgtaggcttccatacttctgaagcctacatgtgaatgcttatattacaggtgcttctttcccttaaggtagtcacttatgggaacagcttatggacaaacagggagcttttgtgttgagtgtaatagatcagcctctctttcataaatgacagcttctacccagattagttttataaggagatggcaactccctatttgatataattttacatgcactagaaagttttccttgactccatcactcatgaagcttacccacctaatgaaaaaaatgtctaatgataaaattagacagcatgcaagaacagatgactaatgtaaccaaaactatgaaaagtcttagaatctaaaggagatgctagagatcaaacactaacagaac

SEQ ID NO: 2526 - DNA, 35669 bp, Homo sapiens
ttaaacagtttccagcacaccactggaccctacccagacctactgaaccagagccctgaaggtggaaccccacaatctgtgtttcaataagctttccaggtgattctgatgcacattcaagtttgagaatcactgttcccatgggccagctctagtggtatcataagaaagaaaggaatgtgggggtgcccaaggagtaggatttcacaaggaaactttggaaaaggtaaagaaagaagagagaaagtaaactaggccctggggccttcctccaggcaaagaggcaaccaggcacttggcaggaaatacccctggacggagatgagacctgcagccccagggaatggaaggaggaaagagaatctggtgagtaggtgggatgcagccaacgtcaaatagtcatttttccacgtatccagatgagggagatggcgtcaattactctaagtcatgagatcggaagggcacaggataattggctggaaaaatgctcctttgggtgcatatttctgtaacaaagaaaaacacatttatgagcatttgttttgtttgtttgaggcagggtctcactcagtcacccaggctggagtgcagtggcacgatcatggctcacagcagcctcaaactcctgggctcaagcaatcctcctgcctcagccttcccagtagctggggctacaggtgcacaccaccatgcctggctaagttttgtatttttggtaaagacaaggtctcactatcttgaccaggctggttttgaattcctgggctaaaaggattctcccacctcagcctctcaaagtgcttggattacacgtgtgagccaccatgcctagccatgagcatttcactgaagatagaaggaagagaaatcctacgaagtgtttttcagggaagggatgaaaatggaaaatcctagcaaatgctcattactactcatgtaaatgtgtgcaaaatgccactggaattttctttccttttttccgttgtgaaatatttcaaacatatagaaaaagacaaggagtaatataacaaaagccttgtacctaccaccagaaatagcaagtgctaccattttgccacatttatgtcagatcattttttaaaagaaatgagacagcccaggcacagtggctcatgcctgtaatcctagcaccttgggaggccgaggtgggaggattgcttgagcctaggagtttaagaccaacctgggcagcatagcaagaccccatctctacaaaaaacaaaaaattaatggggtatggttgttcgtgcctgtttcagctactcaggaggctgaagtggaaggactgcttgagactgggaagttgaggctgcagtgagccatgatcacgctgctacactccagcctaggcaacaaagtgagaccctgtcaaaaaaaaaaaggaaaagaggaaagaagaaatagagaaagagagaagaaaggagaaagaaagaaagaaagtaagaaagaaagaaaaaaggaagaaaaagaggaagaaaggaagaaaaaaagaaaaaaggaagaaaaagaagaagaaaggaagaaaaaaagaaagaaagaaagaaaaaagaaagaaggaaggaaggaagagagagagagaaagaaagaaaaaaccttacagacacagttgaagtctttgtgccccttttccttcctccaactgtcctgaagttggtaggtattctcacactggtgctcatactttaccatatatgtattactcgtaaattacacctagcattgctttgagtgcttcttaatttatgtaagtgatgtcacactaaacccaccattctggaacctacttttttttcagctaaattgtgtttccaagatcggtccatgttgatgcatgatacattcatttttactgctgaataacatgaaactgtacaaagataccacaatccatccactcacctactaatagacatttgtttccagtttttcaccatcacaaatgattctgcagtggacatccttgaacatgcttctgtagagtagacccctacaagtggtgttgctgggccgcagggaagatgcgttccagttattagacatgctgtcaatttactcgctagcttggctgagccagttcacgcttgtgccagcagcagacaaaacaactgaaaatgttatttattcagtgtgctcttggattgggctctcttctgaatgcaaaaccaattataaggattttctctagttcgttcccgacctttgttctccaattctactttcccttaaagtcttaaattctttagccataaattcttctacaactagggttttccagaatctgacctagtggccaagaagaaatgactggtatgtgtgttacaggatggagtcgggtatgtgtgtgtatgtgtgtgtgtgtctgtgtttgtagctttgtaccaaagccaacaagaaagaactggaaggacaagactttccatagcatcttttaaatgatgcatcaaacccaggaaagaggggtaaccagtgtgacccagaatccactctcaagctataggtcctttcctccccctcttatttgttgggggtcaagggggagttgtcccaggacattactctgtggctccatcttccctgctccccaaacccaccagactccagacacttctctaagctgtgtaaacctaggggtgagggaaagaggtactctgtgcagaggaggggcagccccatgtgttcatctggggtaaagggctgacttttggccccaggcctaagagctctctgtccatgccaaagattcctcctgcatctgggcctgtggggttgggagagctgccaaaatcctagactgggcagtgacagtggagagcctatatcttggccactgagccgattcctcagccccaggaccatacagaagttgtctggaattccttccctcacaggccctgaagcaggagcctccaaggcctctgaagttgacttgagaaaaggggatggggggataaggagggggatagggattcaagggaccaccacaaagttgcctagctcaaaccaaagacatttcaagaggcaggaacctgaagtgaatgaaaaagcacaattcacagttaagcgagagtagggagggccctgacccaaagactatttttgtgttttttgtttgttttttagggtttttttgagatagggtctcactctgtcacccaggctggagtgcagtggtgcaatcacagctcactgcagcctccacttccgaggctcaagcaatcctcctgcctcagcctccccatagcagggaccacaggcacacaccaccacacccggctaatttttaaatttttttgtagagaagggatcttgctatgttgcccaggctggttcaaactcctgggctcaagcaatcctcctgccttggcctcccaaagtgctgggattacaggagtgagccactactcctttctttctttccaacagaaagactatttttggatgggatttctcccccagcaaacacttgaagtgtgacctacaggagttgtttgtttggaggggggcatttgtcctttatcaaaaagatgaaacctggttgggtgtgagtttcttgcctgtaatcccagcactctgggaggctgaggcaggaggactgcttgaggccaggagtttaagaccagcctgggcaacatagggagaccctgtatcaacaacaacaaaaaattaaaaattagccaagcatggtggtgcacacctgtagtcccagctactcaggaggctgaagtgggaggatctcttgagcccaggagaacgaggctgcagtgagccatgatcacaccactgcacttcagcctgggcaagagagtgagaccgtatcccaaaaaggaaaacgataaagcatgaacatcttggcgtccttgttccacagactccttttggcccagaacagtctgccctttgggcagcaggtggcttgcttcagcctggaggccaggaggcctactcaggcgcccagggcgattcaccaagggacctcacctctgagccccgcctaccacccaatgaggacgcgcggacatgacgtcactgcatcctgttgcccagcccagaccaggagaatgggacaagctggagaaaagagccagtggaagtgccagatgccaagagagaagttgggggaaaaaatggtggagggcaaatgagtcagcagcaagtttaagcaatgaaccattgcatcacggggtgtttctcaaattcttgtctacttttagaaaaagtacgcaatgacattcagtgggcatcttgattctgaaatagctaaagaaaatgttaaaaatgcagtgggtgaagatgtgcccacattaacctcttttctaaaacaacagttgacaattgtgctacatgtccttaagcaaatcttttagcctgcctgttccttagtttcctcatctgtgacatgaggggaatgtatgaaaaatatctctggagattccttccagtctaacattctgtggtttgatgattgatactatgctcacattcttaatactcaggctgtgtctacacagtgccaagacaactagctaattcagtgagtatggacaaaatgttcttccaatcaattctttggcacgctgtagacaaattggcacttcttttcattttacaactggttgctccggcttcttcttgaccagtgcttcttcaatggtggtatcctgacatgctgtatgcctggagcacttaggaggtgtgtcctaggcagttggctatggataatgaactgttgaggttctcaaatcgttgatgacttttttttaatcaattagaacagattcaatatggtcctatagtaatgcccctgctgcttagttgcaatccgatatgcctccctgaaaggaagaagtggtggaattacagctgccggacagagactgcctgtagccctgaccctgttggatgcccatgggagggtgtcatgtgttgtgcatgtgaatgtcatttatcatctgcaacacagcacttgagaatgactgatggaaacccctgagacatggtcggacatcaaggcactggagactcaggccctggagaaatctgagccagcatcctatgacgcaggtgcaaaccaggaagagtacagaatggagggcctgttcattatgcctgtctcttggtccaaaatgaatgatttcaccataatctgttcatagctggggaaggaaagggggcgtgaaatagcgtttattaatcatgtaggggccaagcccagtgccagacactcgtggcaggttttagtgttgctcgccatgtactttttattctcagctgtccagggggattacacttcctccctcttgtggtttggaagagtaatgtaaaattctggccaatgggttgtgggtagaagtgacatgtaccaactgaatgccagggcatttcgctgatagttttagaccctccagagctccctctccctctagcatgggaactggcaacagtctggtggctcttccatcaccagctggaatcctggaatactaggaaaccgagctccgagaagagacatgaggcgtgtgtatcatgcattgcacgtgaggatggagtaaaactttgttgttgtaagccaccaagattttcaggctgcctataactgcagcacaacctaattttgtgctgtctgatgccatgttttatataacatggtagtgtagtagaaaaatgtgagccttagagtttaaaatgctgggcacgatgtctcacgcctgtaatcccagaattttgggaggccaaggtgggaggatggtttgagcctgggagttcgagaccagcctgggcaacatagtgagactccattttattttactttttaaaaaaataaaataacaatttaaaaaatagagattaaaagacatgagctaaaacctaaacactcactgactgtgagcaaatctgttagcttctttgagtctcagtttcttcatctataaaatggcacgatgtttttattaggttcggaaataatatttaaaaatatctagcacaggatttggcacatagtagatgctcagttacaatgattataatttcatgtattcctcaaaataatactatgagtaaagagagggtatgggtgtaagagaaaggatagtcattactgatgtttcaaatgccgtcatacactatggagaacactgaccagggaccccaagggtaggggaaggtttgaagtcatctgtgtccaccctcccctgaactcagagaagtcctagaagggagagaaggcctgaagacaccatttacaatttagcctttccactgccagaggaaaagcagattctacttatggtagtgactattgacaccttcagcatataaaataagaatatagcagtggagtgagttagtgtccctgttagtttcactgaagcttgttatcctagcaaagcgccagccaaggtctttcccaaaggcgcaatgaactaaactcttctctgaaatcagcttattagtattatcatgaccacttcagctagctcacccaggacctgggaatgagctggagagtgaactacagaggaagggagagaaagagaatatcctcaaggcagcaggggattgaggggtcctttgtctcctcctgcttcccagcaagtcttgcctgatggaggaacaagagcagtcagaggacggggtggggaaattccaattctgtgtgtccttccttcaccatgccagctgctctggaaacctccagttccaggtcagatgcctgctgcagttcccacttatatttaatttggtagagtatatctcctccaatcccagttttctccaaggtctgctcccagatcatcgtttgcctcttaaataccacatcctagccatgaacttggaattctgaacattcaatggcctgcccccttggaacgcctcaattctgcctctgggatgaaagttccttgcacgttttcacacacatggagtgcagagagtcactgaggacccaaggagaacttgaacatcaccttgaccacctgtcatcagcaggaagtcaggctggaagcacttgttgaagcccccacaacctttggtgaatgaaaaatagagatgttccattccagacaaagcactgcatgcttgggcagctgttccacctgccaccaatccaacccggatttgctcttcactgacttttcacttttccacgcagaccaagaccccatgaaaatgcccatggccagtggggtgactgatttccagcaaatgtgtggtccttctaaattggggaggtttaccagaagcatgtattagatgaacatggatttgtgacctgtgctcaggtccctgttagtttcactgaagcttgttatcctaggaaagcaccagccgaggtctttcccaaaggtgcaatgaactaaactcttctctgaaatcagcttattagtattatcatgaccacttcagctagctcacccgggacctgggaatgagctggagagtgaactacagaggaagggagagaaagagaatatcctcgaggcagcaggggattgaggggtcctttgtctcctcctgcttcccagcacagctttaaaccctgtgctcagggtttaaagcatggcgagaatggaaaccggatggtgagattgagtcctggtggggctagttgacttcattttgatcaagatcacagattttacccctgacccagattaaaatctataaaatgggcttttgtgaccatgagagacacaagcagtgacgtgcaggagcagacttatagtggcttgtgagagccaggtgtaaaatattctggagctttgtaagccaatttttaaaatcattagtagcttgaaatctatcgtggtgcaagtatttataccatggaaattggtaaacccctacaaatcggggtttctcttcctccttccctcctcctccttctttgtgagagctagtttaccaaggcatgtgtgtcttctcgcaaaaccattctttcattggaaaaactattccagatatgggatcaggggaacagttttgtatatgggaagaacatagctctctggaatcacagacagctttgaggactcaaaaaaaaaaatcaacaaccaacttttaacattgatagaaactttgattagatagggagttgtggcttcagtgactgtgctgagattttaaatttaaaagatcttgctgaagtgaaaattacatgtaaatgttgggttgtatagcactgtaggagtctgtaaaaagagctgtagtaatgttctgtaaaaagtctttattgaattctcagtagagcagtggtctgtcgttgatgtggcttccagggagggagcatctggcccccaatccttgcagagaggggctgacacccggattgctgctgactgtgcccactgctgtgggggctgctgcaggagggaaaaagagctttgaataatctgttacgagctcaaccgtgtcccctaaaattcatacattgaattcctaatcaccaatgtaactgtgtttggagataggatctttaaggaggtgattaaggttaaatgaggtggggcaccaatccaatctgactgatgtccctatcaaagaggaaatgtggacacacagagacacactggggatgagcatgcatagagaaaaggccacatgaggacacaatgagaaggttatgtctgcaagccaaagagagaggcctcaccagaaactaagtctgtgggcaccttgatcttggattctcagccccaaaactgtgaggatgtaaatttctgttgtttaagccagctcatctgtggtattctgctatggccgtcctagctggctaataccatctgcaatccagattgcttatttctgttcttatctgttgattgatcagttttacagggtaattgaccttcctccacaattcttcaggctctcctaaccctgcctgagattctcaatgtgcctagtcacccaactgtgacaccaaggggtggggccatggagactgactcagaacttggcaggttaccttagggggtgacagtcagattgaacgtgtgtagaacttagctctgccagcatttagctgcagaatcatgagcaagcctttgtcccctttatgcctcagcgtcctcatctgtaaaatggaggcaaaaatattctcccttataagattatgttgatgataaaacaagatcatggaaggataagcacgtggcacagtgctcagtgagcactctcttctgaagcgaagcaggcctggggacagcctggcttagagatggctctgcttgccctagcactgggtgggtggaggaggcatcgggggatggggagggtgcctgagagggcagggtcattcctctccaggtgacctgcactgtggggagcaggtcacctcactaggacagttcctcctgggaccaagaccttccccctgttgaatttttctccctttggttgttccctcacagaacatgctcttcatggagaatactgtgtggcttaaataagataatcaagtaaaagcttcacagagagcctggctttcagcaggcactcaatacatggtaacgatttctacatctgcagttcctaaagcagctttcacgccaccccccagggcagctgtagccacagaattgaggcataatttggacactgttggtagaaacagcattgggtaactttattaaccaatttggttcagccttattaaggaggagagctccattcatgccaaaggcttctccaagcccttcgcaaataaccaggattcaacagcctgaactcccccaagaatgactccgtgccagaacacagcacaacccagcagtgtggcccttcctgattctcccatcctccttgccacatgggctgatggaggcttaggttctgtggctttaccgagctccaactctcttcctgcacttgagcaagagcacttggtgacctggtgagatggtagaaatggacacaagccctgactcctggcaggagacttcagacttgcagcatgtgcttaaaccacaggaaacggtgtggctcacaagtggtctgagcccaggaatgatgaaccccatgatgctgggagttcatctcatcgagtcagctctgtgacatttgggccatggagctgtggacccagctctccaggaacttctgcctgcagtgactgaaagctcttttgacacttttctattttactatcccctgggatcctgctgagcacacagggaggcttcagtagaagtcactttgtgtctctgtgtcaccttctgattaaaataactttaaaagtcatgttctgggccatgcacggtggctcatgcctgtaatcccagcactttgggagattgaggtgggtggatcacctggggtcagttcaagaccagcctggccaacatgacaaaaccctgtctctactaaaaacaccaaaaaaaaattagtcagtcatggtgcgtgcacctgtaatcccagctactcaggaggctgaggcacgagaaccacttgaactctgggagtagaggttgtaatgagccgagatcgtgccactgcactccagccagggtgacagagcaagaccctatcaaaaaaaaaaaaaaaggaatcaaaaagaaaaaaaagtcatgttctggaatggcctgcttcgtaggtacaaaagagcagggtttgcagagtcaggcaaaataaagggttggcttgcaatctaaccttatcagagacctggtggctaagggacccttctgtggagatttgcgagaatgtactcagcagagaggtgaggctcagaaatgaattcaggtaaggaaaatcctctgctgattcagaaaaagggcactcacgagtttctaacattctggaaacatcacatgttactctatttactccctatttactctctttctatctgcagggcccaaagcaggatggagataaagatgcccagaagaaaccaaagccttcttgggggaaactgtaagaagtcaggagggaattctttattagaaattgaagatcccgctgggcgtggtggctcatgcctgtaatcccagcactttgggaggccgaggtggacagatcacctgaggtagaagttcgagaccagcctggccaacatagcaaaaccccatctctactaaaaatacaaaaattagccgggcgtgatggcacgcacctgtaatcccagctactcaggaagctaaggcaggagaatcacttgaacttgggaggtggaggttgtagtgagccaagatggcgccattgcactccagcctaggcaacaagagcgagactccatctcaaaaaaaaaaaagaaaaagaaaagaaaagaaaaaaaaagaaagaaagaagttgaagatcaaagctggagaccaggactcttgacaaatctgaccagatttgaaacacacctaagaaatgtaagactcaattaattctacatgagcctaagaattaaaccaaataaagaatgacaacacaagtaatgaggatactggcttatgcctaggtgtttgtatttctttaggtctaactccaactgtatatcctattttaaattaatatttgttattctttgttttttgttattttaataaaaagctctatttaaatgtatttaaataacattagccagatgtggtggctcatgcctgtaatcccagcactttgggaggctgaggcaggtggattgcttgagctcaggagtttgaggacagcctggccaacatgatggaaccacgtctctacaaaaatacaaaaattagccaggcatggtggcacacacctgtagtctcagctacttgggaggctgaggtgggaagactgcttgagcctgggaggttcaggctaccatgagccttgatcacaccactgctctcaagccaaggcaacagagtgagaccccatctcaaaacaaaacaaaaagagaacactaatgccgttagaaaagaatgctttcattactaacaccactggggagccaagcaattcaaacccgcctgactccatgtggcagcttatttcaagtacaggcaaggagactcaaaggaaataaacagtgtgtgggggttctagcgatgcaaacctataaggttcttgtaactatcataatgcttgatcaatacttattaacaaaccacattctaggaggaacaagttttaaaagcctgaaaattggacagccaacgtcctaaaggtgagtgagtagcagtgagagagagaccaaacacagtgtgtccctggggtgatgctgctgtgctttaggtgaaaatgtcagtaaatggtttagccttcacatacaaaaaagcacaccaaattctacagtagtgaaaggtggaggcattctgtgcaaagtcaagttagactccttggaggttccaagagctcagaggagacccttgggttttggagatatcctggggcaacttgtttggttaaaaaatgtagaaaaggaaacactggggacccacaaagagatgaaaaactactcttttgtggaaactttcatttctcatcaaatatccatgtacccacccacttttctgaccctcttccattagttaggggccttgtggctgatagaaaagtgactgatgctgcttctgggctgatgcatgtaggagctggcacccaacatgccaactcgggccacatgctgaggtgtcagggcgggatgtggaatagagctcctcctccaagctgacttgggcgcattgtgtaagcacgcaagaagcctgggaggtgcaaggcctctgagatttcagaggtagtttgctcctgcagtttagcctcatttgatctggtgtgtacatacttcattcctatgccaatctcagtaaccaggccaggaggtaatagaacctctgccattaacccatgtgtgagcttgaggaagtcactcttctctgggtgtcattttcctcatgtggaaatttagagttgggtcagttggcctttctgctctgtcagtctccaattttgtatttttgaaaatttccatctaatagtgtctgaaaagttgccagtactagtgtctgtctatccctgtctattatctacatagacaccgccccatccacccatctgtctatgttcatccatccatcttcccagaatccatccatccttccatccatccatcctcccatcatccatccttccatcatccatcctcccatccatccatccttccatcatccatcctcccatccatccatcctcccatccattcatcctctcattcattcatcctcctcttcatccatcttcccacccatctccatcctcccatccatccaccctcccattcattcttcctcccatccatctccatcctcccatccacccatccatcctcccatccatccatccttccatcctcctattgtccatccttccatcctcctattgtccatccttccatccttccatcctcccattcatccatccatccttccatccacccatcctcccatccattcattctttcatccatccatcttcccatccatccatccttccatccatccatcctttcatccatccatcctttcatccatccatcctcccacccattcatcctaccattcatccatcctcctattcatccatcctcccatccatctccatccttccatccatctccatcctcctatccatccatccttctatccatccatccttccatccatccacccatccccccatccatccatccatccgttcatcctctcatccacccatcctcctatccatccatcctcccatccacttatctgcccatccatctccatcttcccatccacccattgctccattttactcctgtttcattatgaagggagctgggacagctgaaatagtgtttgggactcaacaatttgcctccccttccctacatcccttactgtgatggttaattttatatcaaactggctgggccacagtaccagatagctggccaaacactattctgggtgtttctgtgagggtgttttggatgagattaacatttaagccggtgggctttgagtaaagcagattaccctccaccatgtgggtgggctccatccaattagctgaaggcctgatgacaactggcaacagcaaaacatcctcagagatacacacatgagcagaaatgcaggagcatgctctgaattccctaacataaacatagaagggcacacaccccacatgcttacaaacgaaaaattcaaggtgctgctcagaatgtgctaacacaaagcaaatgctgtcacagtacctcagcactatccctcccgcccgcactcctgctctgcccagggtcatccagtgcctcttggccagtcagcatcccctgcaccaactctgccacccccatggccccttcctgatggtgcttctgattggttgcaacatggacactcagagtttgggaagaggaagcagtgattgtgctgtgctttgcaacccctccgcctgcccccactccccaattctctctctttctctcttttttttttttttcagagaacttagcagtaaaggctaatttatgaagtccctaaagatttgaactttctgcagaactggctgcagtttccagtgggttagagtctacttggagtagagcagaagctgtgagctgtgctgccgagaggagggaaggaagaagccacagcccaggacccacacccgtccagcatccccaacagccttcctcccctacagagagctcaaagatgacaccgactgttaggtgtgggataagagggacacagggtgtgggatgagatccagaagagcaggaagggggaggggtcaggagctctgtggttggagggaccacctccgttactaacatcccagtcaaattcagaaactatccaagccctggaggctcctaaaggcgcttgctccacccttgtaccatcccagttccctcctaagtttgcaagatcaaatccagtttaaggctactccttcgattttctcatgtcatgagctgacacccactgctgggaccaaatattcatttccctccccatgaaagccaaagctctattcggtaaggataaattcacattaaaaataagaggtttacagtcaggtgtggtagctcacgcctgtaatcccagcactttgggtggccaaaacaggaggatctcttgagctcaggagttcgagaccagcctggtcaacatagtgagactccatctctacaaaaaatttaaaaattagctgagcatggtggcaagtgcctgtagtcccagctagctgggaggccgaagtaggaggatcacttgagcccaggaggtcaagtctgcagtgagccaagatcgcgccattgcacttcagcctgggcaacggaacaagatcctgtctctaaaacaaacaaagaaactagaggcttttttttaaattattttttaatttttttttttttttttttttttttttggagatggagtctcgctctgtcacccaggctgcagtgcagtggtatgatctcagttcactgcaacctctgcctcctcagttcaagcgattctcctgcttcaggctcctgtgtagctggcaagcaccaccacacccggctaatttttgtattttttagtagagatggagtttcaccatattgaccaggctggtcttgaactcctgacctcaagagatccacccttctcggcctcccaaagtgctgggattataggcgtgagccactgcacccagccatcgaagtagaggcttaattttccctgttgaaaataacagaagagccgggcacggtggctcacacctgtaatcccagcactttgggaggccaaggtgggcggattgcctgaggtcaagagttcaagaccaacatggtgaaaccccgtctctactaaaaatacaaaaaaattagccaggcatggtggcgtgcgcctgtaattccagctacttggaggctgaggcaagggaattgcttgaaccagggaggtggaggttgcagtgagctgagatcgggccactgcactccagcctggatgacaaaatgacacagcaatactctgtctaaaaaaaaaaaaaaaagaaagaaagaaagaaaagaaagtaacagaagagactctcccagcccatctcacttccttttcctagagcacttacttttggaaacctgtaatcagtagttctttctctgtctcttttaaatgtatgtaaatcttttgaaaagctaaataagcctcttgccaactttaggacccaggtatgtctttctccaaggacctgggaatcatccctttgaaaggtaatcatcaaggaacatagctccccatcttctagtctctagagaagcataggagcctaacttcagctccaacttgcaaaactaccttttgccataaagaaataagaagtttatttttcctttggataaaggcaattagcaaacacagatggccactccaataaccaggagactttagaatgaactatgtgtgacaaatagaactagtcccctgaaaactagttattgtttaacgtgagaacacgtatgtaacagattggagctgcttggctggacaaaaggtaagactcctttctgtctttgcaatctcttcgcagatcacctggcatgcgcgtcccattctggttgaatgcttgtgcaataataaaactgttttctttcttttcaacctttgtgaagaggttttctgagttgagagattttgtctgtaattatcgttccccagcaattcttgtgctctcctaaagagaggatacccaggcctttcaggaggagggaggctgaggtagcaccactggcaggggagggaaggaggaaggagagaggaggggcatgcaggccctgccaaggtcagacacagctggtatagcagagcctgggcatcatccaaaagaaacaggctcaatccatcctgtacagttccccggcttccccagcccccagcccgtcttccttcccaggctctctgccctgggttcacttgccctcctttatgcatcgaatgttaaacttcttttgttttccccttcagcagttcttgcccgctttgcatacagatgctgtgtgtaatagatgcacggtaagattccattctctacctgtccgccaagtcccctttgtttccacagtgaacctcattcatctggaccccattcatgacattttcaaaaatcactttcctaagcaaagactaaagtgtattttgctttttctgtaaaggaagatgatgtcaagtaaatttatcaacaaacttgctgggagccactcaattgacttgagatcaggaattgtttttgaacatttgatgacaactttgcatactggattgtcaaatattgattatttttctcctccaccctcactccccacagcttaaatgggaccccaggcactgccctagtcaggttgggggctagttggctacctaaggggaaggcctgaagaagcaatttggtttaagcctttgagctctaattctcaacactggctgcatttcagaatcaccagaggggctttaaagtatatatgtgaatgtgcagatcccacccccagcgtttctgtcttaattgaggcgtggtggtgcccagggcagcatctgccttgacagctcccgggtgggagtctctatcacatctgtcagtcagtgctccctgtgagttcagaagcctagaggtaaaggcctctcaactctagttgctcattacagcaccgagagagctttttaaaaatatgaatgctggcccggcgtggtggctcatgcctataatcccagcactttgggaggtcgaggtgagtggatcccttgagcctaggagttcaagactagcctggacaacatagtaaaaccccatctctacaaaaaattagctgagggtggtggcacgggaggctgaggtgggaggatcacctgagcctgggaggttggggctacagtgagccgtgatcaagctgctgtacttcagcctgggcaacagaacaagacacagtctcaaaaaaaaaaaaacccaaccaaacaaacaaaacaaattgaatgcctgtcacaaagcccagcgattctagttttattgggctggactgagacctgggcaccgggagcctctgatgcgtagccagagtgagactcactgggagaggggaaagaaccgtgacttctcagtaagactgactaagcctagtgtctgggctctgctgggtaagtgtaagcaggttgattcacctctctgagcctcaattttctcatttccaacattggagtgctgcaacccaccatgcagggttgactgcagctggtgtcttccacctgcatggcctgcgttagctctctcagtagttctccttgtcagaaagtggacatttaccattagtaattaactatgttaccaataagaattcagttcttatcaatagaaaggtgctgcttttggggatgtgaaaaagaagatgccagggcccgcctgtcctcccagtctttgacaagtgtcaggacagtggctcttttccatctctcataaaatcctgtttcaggaggctggctcttttgaatcaaattgtacttaattaaatcctccctgaaactcaggggagtttcataggaactctgcatatatttacagcctttggccaggcacggaggtttgcgcctataatctcagcactttaagaggccaaggtgagagcattgcttgagcccaggagttcaagaacacctgggcaacatagggagacccccctgtctctaccaaaaataaataaataaattaattaattaattaattaattagctaagtgtggtgacatacacatatggtcctagctattcgggaggctgagttgggaggagagacagagcatgggaggttgaagaggcagtgagctgcgatcttgccactgcactccagtctgggcaacagagagagacctcttctaaaagaaaaaccggctgggcatgatggctcacgcctgtaatcccagcactttgggaggccaaggtgagtggatcacctgaggttgggagttcgagaccagcctggccagcatggtgaagtcttgtctctactaaaaatacaaaaattagccaggcatggtggcgggtgcctgtaattccagctactcaggaggctgaggcagcagaatcacttgaacccaggaggtggaggttgcagtgagccaagatcactccattacactccagcctgggcgacaagggcaaaactccgtctcaaaaaaaaaaaaaaaaagaacccaaaaaccaaaagttctgcatgctagatcttattgtaaagaatgcatatttgtattacaaaataaatgaaaagcaagttagctcaggaactgagcctggaacttactatcagatcacatggattccagagcatctgtgtgtgtttggctaacacccctcaccccttccagcctccatttgctccactaaattttagactgcgattctgaaaagtggggttgaaaatcctgttgctgctacgaagactgtgcaattctatagctcattcctaatgtcattgtcagcaggccaaggatgcagtttcacagccctgctgggtgtgaccgaaaggctttctctaagtgtgccctttcattaaactttctgaaactgctattggctttgcactcagcgaggtgcagaaagggataaagataaaacagatacagattctgcctacctgccctcaaatagattgaggtttggaagttcagacaggtcatgcatgtaactaactctaacacgcagtagagaagaggtctggctgggagtcggggcaggcttgctagaggagggagtattttaaccatgcatcaaggaagagcggagtatgggtaacggggcaggtgatgcccttgtcctaatgtcaaggatgccaaggtccaggatgtaaggaggcaggaggcagttcccggagatcttggattatttttaggaggggtgaaatagctggtcaacaggtatgcatgttttaaggtctttactgcaccttgcccaagtgtcctccagaaaggatgctccaatgtacacttagccagatattaagatgcctggagccttggtctgaaaatgcaggaggaagaggtgcaggggctgtgaggtggagcggagtttgtcctgtcagctcaacaaatatctttcatcactgggctgtctgtgtggtgtgcagagatgaaaaatggacacattcctgccctcagggagctcaacctactgggagagatagaccacagcccaaaagtgtgggcaaacctagggctcccttgaaagttataagcaggtgttgtttgtttgttttgagaaagggtctccctctgtcgcccaggctagagtgcaatggcaagatcacagctcactgcagcctcaaagtcccagggtgaagcgatcttcccacttcagcctcccaagtagctggaaccataggctcatgccaccatacccaggtaattttcttttttttagagaccacgtctcactatattgcccaagctggtctcaaactcctgggctcaatcaatcctcccgcctcaacctcgcaaagtgctgggattgcaggtgtgagtcatccagcctggcctacgagcaggtttttgagctgaaaagagtctgtcctttctggattctccctctttgaggcacctcattcacctcagtggaattattcacagggttccaccagtaatccttgggttccctgactctccaaaaggcatctaagcttcctggcttcatattgcctgactctactccctcccacatttctttgtcccagctatttaacttcagcactggaggaatctccaaggtgcttgaagagttctgcccagcttcccgcaaggctgtgccttctcaggtcatcgagcaaggaagccatccctgagagtctcatccgagagcccttgcagtgggcatccaaggccataaatatttgcatgcctgtgaacccagctttcagaaatgatcttaaggaaataagcatgagtatttgcagagatttatctataagattatgcatgagagccttatttataaaagagaaaaatcattgaaaatgacctaaattttcattcatagagtttgactaaataatttatggcatattcacacaatgcaggagttgtaaattacatcatggaagaatatttaatgacatgaaaagaaacttaaggcatttgcaaaatactgtgtactacatgatactatttctgatagtaaaaaatatatacaaacgtagagacacaagggagagagaaaagtcatgtatcaaaaatataaaactttcatgatttcagggtagtggattaataagaaattttaattctcttttctggatgttttctatgatgttcactatttgtttaatcagaataaaagatactctatttttgaaaatgatatctcctggcacaggacaatgattcccatctgaggcacatgcgggtaggaggtgggtgctggggagctgcactgcttaggccaggagagtccccctgagctcccggctgctgggacacacttctcagccatgccctcctctgcaaagtgccatacagcaaccctggttatgcaacaagctgcctcggccctgggcaaacagatcctctgactcctcggctccattacaggccataatgggacaaccagacctcaggcccgatggttgcataaaagcaggatggatagatttttctggtcactgtgttccacccagctgagcaggcatattcagactccttccctgctgtactgcttagctcatgcgaagcaggagccttcttcaggcagccttccggactaactccactatgccgtgtgcttcaaaagcccctgctctaatccataatgaacacttgcagagtactctacttgtaataatccaaacgattctcatgacaacactataagtgggtactgtgatgcttttgtgacaaatgaagcaacggaggcagagagagcacaagcgattacccaaagtactatgcagagccaggattcaaacccaggcagtgcagccccagggtcagcccggaagacaccacgccatgcagccccctggcagataattgctatcacagccacatttgcatggtgattctgagttgtttccaaatttttgctggaagactatggattcctcgaaggcatgaattgtgactttcacttccgtgggaccatccagggcccagcagagcactgagtgcacagggccttcccaggggcttgcattctcggctctgaagcccgccttctttcctactccagctgcaggtgcaagtggtgaatcctactgagccataatcttgctgctagaggcttatctagaggtgcttatgcaagcagtctggcaaaacacctctttagggacaaacgtagagctggagacttgggacgcctcaggatgtgtcagatcacagctttctgcagggcacaaggcttcttgctgcttctccagaacatctctccaaatgcctgtgcagccctgggtacctgggcagggtccagctctacaaaggatcatggctcgagtccttccgctccaatgggaaagaccaaccaagtgagagaaagagcatgccgcccagagggggagctggttgccattgtcctcttggctgtcatttgtttcttcagggtttccaggctggcttccaaccgaggatgtaagaggctgttaccaagtccaggcagatcagcacaaacatattaacaggggttatctcagcgtggtgtgatgagggatgactttttctcatggctttgcttctctgccttttctaattttctgcaatgcacatgattatttgggcaattaaataattacagggaggggaaagtcactgttcttgctttgtcccttgcaggactctttccccacacttatatgggctgctaagctccaatgtgccctctattgcatgtggcttccaccgagctctttctgatcttcacaccagcaaactcccatctctactctgtcctttccacacccttcactgtgtactgatctgctcaaatccttgcagattataaaatgtttcactggcccgagcctgctggtccccacaaccctgatttcaaaagaagtcatcttttgtgtccttgcagagcgtgcctggattgtgtctctatccttggtcccttacctggactgtagccccagttaactgctgaataccagcagctgggtgtcctcagcaaccatgtccacatgaagcatcttagtctcacccactccttctgtgtctctacgagcagcattgagctgtagatgggaaagtgtatggaaatatgatcactttttccctagggcaaagagggttggtgttcttttcttcaaaatttattttgaatctgtcttttctgtctccccactacccctcactcatgctcctgagtcactgctgagctccagggctgtacctttctcattttggaatctctaggatctagcatagtacccagtgcacagtatgccttcaatgtatgcctcttggttcaatgaatgaatgcatgaaaaaatgggcaaataagtaagttttaataatttgtcaccttgatttttatttcttgcaatccttcctgtatttcttgcaatccttgttttattccttgcaatccttcctatatgtctctgccagttgaatcttccaaagtggtgactcgaccacgtgaatctcctctggtgactttaatggctcccactgtctgcgaaggcctttcaaaacccagctgcttgttacctttctttgcaaggattttctctctcactcctcaaagctccattctggctgacttggcctctctgtatcctttcctgcccttgttgagttgcccttttctctgtgtagccacttagctgcctgtgctgatacttgctgctggctaagcttgtcataagttcagtgtgacaccctttcccgtgatgggctgattacagtaaggtcccaatctagtggtgcctccctctattgctgggttgggtaatctcccagttactctgggtttgaccatgtgacttgctttggtcaacaggaaacaggatgttagcagagacttgaaaagtgcttgctcattggggtttgccatcttttgctgctctagggaatccagcagctgtcaccatgtaaacaagcccaggctagaccagttaccctcatcatcttagctgatagccagccagccaccacaggcatgagtcaggccatattgctggacccacagaattatgagctaaataaatagtcttgggttaagccactaagttttaggcatagtgtgttatgtatctcacaaacatataagactgtgtgtttgttgactggaggaagagatgctataaagaccaccttttaaaacttcccaaatactgccactgatgtcctgatggaggtatgaaaacatccactaaaatttgtggtttattcatttttcattattttgtttaaggaggtctatagtggaagagggagatatttggggaaattttgtatagactagctttcacgatgttagggaattattattgtgtgataatggtcttgcagttacacagaaattcttccttattttttgggaagcaccaaagtagggataaaatgtcatgatgtgtgcaatacactttaaaatgtttttgccaaaataattaatgaagcaaatatggaaaataataattattaaatctaggtgatgggtatattgtagttcactatagtattgcacacttttctgtatgtttaaatttttcatttaaaaaactttgagctagacaccaggctatgagctaggagcatagcaatgaccaaatagactcctaccaactcaaagaatgcacattctctgggaaacatgtttccattaggaagcctcgaatgcaatgtgactgtggtctccaggacctgtgtgatcctggcttttcctgttccctccgcatcatcactgcaggtgtgttttcccaagttttaaacatttaccttcccagtggccttgcgtctagaggaatccctgtatagtggtacatgaatataacacataacaaaaatcatctctatggtgtgtgttgttcctggggttcaattcagcaaattttccctgggcacccatgtgttcttggcactggaaaagtaccgggactgaaacagttgatggcccaatccctgtcctcttaaaacctaagggaggagatggaaaggggcacccaacccagactgagagacaggaattagctgcaaggggaactaggaaaagcttctttaaggatggagaggccctagtggaatggggagattcttccgggagaagcgatggatgcacagttgggcatccccacagacggactggaaagaaaaaaggcctggaggaatcaatgtgcaatgtatgtgtgttccctggttcaagggctgggaactttctctaaagggccaggtagaaaacattttaggctttctaagccaaggcaaaattgaggatattacatgggtacttatacaacaagaataaacaatttacacaattttttgttgacagaattcaaaactttatagacacagaaatgcaaatttcctgtaattttcccatgagaactattcttcttttgttttgttttgcgacagggttgcgctgatcctcccgcctcagtctccctaagtgctgagatgttgcaggaagtcagggaccccgaacagagagatcggctggagccgtggcagaggaacataaattttgaagatttcattttaatatggacacttatcagttcccaaataatacttttataattttttatgcctgtctttgctttaatctcttaatcctgttatcttcataagctaaggatgtacgtcacctcaggaccactgtgataattgtgttaactgtacagattgattgcaaaacatgtgtgtttgaacaatatgaaatcagtgcaccttgaaaaagagcagaataacagcaatttttagggaacaagggaagacaactataaggtctgactgcctgcggggtcgggcaaagggagccatatttttcttcttgcagagagcctataaatagacctgcaagtaggagagatattgctaatttcttttgctagcatggaatattaatattaacaccctgggaaaggaatgcattcctggggggaggtctataaatggccgctctgggaatgtctatcctacgcaatggagataaggactgagatacgccctggtctcctgcagtaccctcaggcttactagggtggtgaaaaactccgccctggtaaatttgtggtcagaccagttttctgctctcgaacactgttttctgttgtttaagatgtttatcaagacaatacgtgcaccgctgaacacagacccttatcagtagttctcctttttgccctttgaagcatgtgatctactccctgttttacaccccctcaccttttgaaacccttaataaaaaacttgctggtttgaggctcaggtgggcatcacagtactaccgatatgtgatgtcacccccggcggcccagctgtaaaattcctctctttgtactctctctctttatttctcagccagctgacacttatggaaaatagaaagaacctacgttgaaatattgggggcaggttcccccaatatctggtgcccaacgtgggatactgagattacaagcatgagccactgcatctggcctcttcttttgatttttttttttcaaacttttacaaatgtagaaaccattcttagcttttgggcattaccaaacccggcagtggcaggctcggttcaccaacgtcatttgcagttccccgctttatgttatgggttttgttttgttttgttttttttattgagacagagtttcactcttgttgcccaggctgtagtgcaatggtctgatcttggctcactgcaacctccacttcccaggttcaagccattctcctgcctcagcctctcaagtagctgggattacagacactcaccaccacacctggctaattttgtatttttagtagagatgaggtttcaccatgttggccaggctggtctcgaaatcctgacctcaggtgatccacccaccttggcctcccaaagtgctgggattacaggcttgagctaccacgcctggctgggttggttctcaatggagtggtttgtttttggagctgctctgcgcagtggggaccagaataggcctgggttcctagcccattgctattccttaccagctgtggattctaaggaaagtcatttaacctcgctggaccttagattcctcatccctgaagcccaagggtaaaacaaaacaaaacaaaacaaaacaaaccaacccatcatgtaaagcggggaactacaaacgatacaggtgaaacatgcctaccacaccactcacaggctatgatgacaaaaacgtggctacatctgggaccaccccccaacccccactttgtacgtaggaaatacggagttgaggatggagacccacagtatgtccagagtgtccccaaaggccacagtgcccgcctggagccctccagagagcgtgcactccctggggtgccagccagagacaacttgccctgaggcttggaactcgattctccgcgtgccagagaaggggtgggacttcagaacccccaaccccgcaatctgggtcggggagcctggcgcactgcgggccgctccctctaaccctgggcttccctggcgtccagggccgtcggggccgagtcccgattcgctcccaccccgaagccgcgccaggaccaacgagggcgcagccgtatgccccagcccgctccgcggagcccctcacagccacccccgccccgaccgcgccccgcgcggctcgaagcaccttcccaaggggctggtccttgcgccatagtcgcgccggagcctctggagggacatcaaggatttctcgctcctaccagccacccccaaatttttgggaggtacccaagggtgcgcgcgtggctcctggcgcgccgaggccctccctcgaggccccgcgaggtgcacactgcgggcccagggctagcagccgcccggcacgtcgctaccctgaggggcggggcgggagctggcgctagaaatgcgccggggcctgcggggcagttgcgcaagttgtgatcgggccgctataagaggggcgggcaggcatggagccccgtaggaatcgcagcgccagcggttgcaaggtaaggccccggcgcgctccttcctccttctctgctggtctttcttggcaggccacagggccccacacaactctggatcccggggaaactgagtcaggagggatgcagggcggatggcttagttctggactatgatagctttgtaccgagttctagccagatagaaggttaccgggagctggggagcgttggatttgctgctgggctgtgccggtgcccagaaggcaggaccttgcagaaccagccaggtccctgggagactgtcagacccaccaacctggtggcattcgcagagctgagatgcattggaaattgccttgggcacatccccaaagatcaggatgtcccaccccagtctgaaggagataaagttgggggtaggagagacgcagatgcaagtgatcagtctcagtcccagacattgccttgctctgcgggtaggaattcaggattcattttccagggaagttcctgacctctgaatgagaggggctgtgtaaggccaatgcctgggaggaaggcaaggatgagtagaggtggggggaaacaagtgtcaggaagactcaaaatcttccagagaaattgtgcagggtcttaccagatctgtcctcaaagccatgcaaattgccttctttgcaatgcatacaatgaggtgtctctgggggtcagaactggttattagggaacttctagccaggactgctaaatacgcgctgttggcccaccaggctcacctatagccttccttcagtctgggcttggtttggatttcactgtgggtgccatcgcctttacactcctgtttctatagtttaaagatagtggtgctttgggaaagtgactccttaaatacagttaggtccaagtgagacaagtggcctggctgtcatttcagaatagcagcttccaagaggtgattaatttctgttggaagggtgatctttggggaggtgggtgaagagcagagacttggtggtaccgttccaggagcacaggctctcttcctttgcagtgcagaatgacctctggcagccggagttgtgtttgttctgtaggattctgaggtgggccatgggcagctggaactggggaattttgccaatctctttcatattaggattgtctgcagaaccagatatggaggcttctagcaacgtgagtgctcctgttctaatgcccttagaaacaagaaggccacactgatcatttctctcacttaggcagggagacaaggcaagagagaaacagtggatgcttttaggttctttcccttcccaagcagttgtggacattgggctgaggggaacatttccacattggctaaaggagcgtcctcctcatattttgtacattttatacccaaaataactcttcttggtatttggggaaatattttcctccccgtccattccaggaaatggctccaagtgccaaggacagagccagggaagttgcaatgaattcctgcccgtcagccccaggcagatgccttgcacgtctgagtggcccatgcagagcgtggaggtggccgccacggaacctgggtcaatgtcccacccccgcttagatgccaccaggggcgtgggagccaaggagagaagaggggctccaggaaggtagagtccttgtgtcttgtgcatctgtgaacagcactggtatgatttaaaggaaaattgagccaaattttccggcagtcagttaccccatccccaccggggtaggagtctggcagccgcagctccattctggccagtcggcagagagccttgaaattcttctttgtccacacagttgtctcagagaaacagagaggttgtttctgcttaaaaacaacacacttggtgtctgggcccacagactcctttgcacttattccacgtgtgacagccaatgtgcctcgttgcttagcagacagcatgttaccgtctttcctgctcagtttgttagctctatggaatggaatttataatcaatgcccataccaacatttcactaatatcataggagatttagtctccatctgggtgtacattacatttgctctggggtgctccaggctggggggttgccaaggaagagaagagaaaccgcagagaagacgggagggcagggcaggggtctctgagaaggggaggggtcccagagtgcaggagcaggagccaggctcatgaaaggggccacgggcgggagtatccagggacggcagtcaagatggagcacagcttaggaagctgaagggaatcctggcccacctgggtgctagagggcacataggaagtgcaggaagcagaccaaggtccccaagagagggagacctggacgctgaagcattttctgtctttattaagacaactccgtaagaattcctgctgggccaaagtgaattctaggatgcgactttaagatgggagcaagcgaaccattgaggaggcaggttaccctagttagccaatgcagatcgagaatgggaaatctttcatttattcatgcaacagatatttaacgaagccctgccgtgttccaggcctgtgatagatgctggaacaggtacagagatacaggtgtcattaattgatcagggcaacctctccttctgagtcttgctggagcttcagatgcccctcacacagagctcgagggagcctcaacaattgatcagaagtcaggcaccatggctcacgcatataatcccagcactttgggaggccaaggcaggtggatcactggagcccaggagttccagatcagctggggcaacatggcaaaaccccatctctattaaaaaaaaaaaaagtaactggatgtgatggtacacacctgtagtcccagctacttgggaggctgagaggtgggagaattgcttgagcccgggaagtcgggggtccagtgagccttgatcacaccactgcactccagcctgagtgacagagcaagaccctgacacacacacacacacacacacacacacacacacagattagagctgaaacaggagtagaaacctatctgtatctctgatgagatcagatctttctgatgaacagaaagaatgtaacccctgtactcacaccctctctgctggttacatatgttaacacgatttctcaaatgaggcttttggttgcaaataagagaaaatcactcacgctggccctgtgtttttcaaattgtttattgtgatcaacatttgaaaaaagagccgagactctcaagagtgcattacccacggtaagggtgaattttacttcttgacacttatttctcttacatgtatctatctgtctcaaatgaaaaatatatttagaaagttgaaagctatccaagtgagtataagaaaagagtatctcaccctgaaggctaaggacagggagggccaccaggcctcacgaggacccaggaaccacaaagaaggctaggaaggagcacaggcggtgaccatactctggctcagtggctatgtgggctctggtctctctcagctgttccatgcatatgaggccaaatgtggctaccctagagcttctgagccctcaacagagatgaactggactctctgcagccccactctaaattcctaagagagaagttgattgacccaatcagggtcaggagaaggaagggaggaggaaagggaggagagaagagcctcttcgtctcttgcctaccactggccaggcaattgtagccaagggggctggagtgtaaatgcaaacatagccatcaagggttgtgtatgtgtgtgtgtgtgtctgtgtgtgtgtatgtgtgtctcttgggtaggttagatctcccaggaggtccctactaaacagacttaagcccgcaaaattttagctctccagcctcacacactccacccctctaccatattgaatcttcccaaaccaactatggctttccctaactccggagcttggcctggaatgccctgcttcccctctttcccctggggaacgcctgtccttcaggcctcagttcacacactgcctcccttgcaaagctctcctcccatccccggagtccctcttcccctttgttctttgggttctatgcttcttccctcataactcccaccaggttgtgttaaaatgagttgttcaaggtcctgtctgttccactagattctgagcaacttggagaacgaagatccaaacttcgctgcctttatttcctcctttgttcttttctcatccccaagtcccttccaacttggagttatgaagaaaggaaggaaggaagggtgggagggaagaacaggaggggatcccacaggagaatgtgtatagggagaggactcagactagctaaagcttttccctcataattaatagcaaataccatgttacctgaatttaattcacagtagcatacaaaagactcgctttgttctccccattgatgtcatcagagggctgtgggcaggcctaatcttggctcaggaggccctccagcctggatctaaagagcagcagatgggccaggctcggtggctcatgcctgtaatcccagcattttgggaggccgaggcgggtggatcacgaggtcaggagtttgagaccagcctggccaagatggtgaagcctcgtctctactaaaaatacaaaaattagccaggtgcggtggtgggcgcctgtatttccagctacccgggaggctgaggaggctgaggcaggagaatcgcttgaacccgggaggcggaggttgcagtgagccgaggtcacgccactgcactctagcctgggcaacagagcaagactccgtcaaaaaaaaaataaaaaaataaaaaaataaaaaaaataaagaggagcacacatctctgcccatcctaactcccactttgacattgaggtccccaggatggagggtctgcctccatctgccttgtcccctgcaatggtgggaaggtgatggagctcaagtctagaggccaccagcttcttagggaggtaggaggtggagggtggggtgcgggccctgcacacaactgccaagtgaggatgggggtggggtccacctgaggataagtaacagtgaggctggtgcagaggacccaggtggaggtagacagcagaatttgtggtggggtggatggcacattatataagcctctcttgctgccctgtttactgagattgtttcattatcttttttggcttttgtttttaagagatggggtcttgctgtgtcacacaggctggagtgcactgtgtgatcatacctcactgcagcctcgacatcctgggctcaggcaaacctcccaccttggcctcccaagtagctgggaccacaagcgtttgccaccacactcagctatttttatttttatttttattttttttagagatggggtcttgctgtgtcgcccaggctggtcttgaactcctgggctcaagcgatcctcctgccttggcctcccaaagccctgggattataggctgagccaccacacccagccacatttcatctgtgcagctccaggggctccacattctactcttctcatttcttctccagggtacccatggcaagggatgagggtagaagatggggcagccaggccttgattaaaggagaaggaaggcagcctgtggagagggcagcccagggagtgcagagagaagtgggccatgagggagacagcagagtgcaggctgcgtcccaaatgagcatacagcccactgtgagcccaccatcttcctagagacccctctcctctccaggagctgcttcagtagcactcagaggaaagaatgatgctgtatcaacatttcagcagctcatcttttaactctaagaaaatggcagctcctaaatgttcaaaactgctttggaaacttctggagagaggttttgcagctcaggcagacagctgatcgcggcctttcttccaccccaacccatgctctccccatgctctcctgccacagctgcagcgggcccctgggtcctacatttgcagccctttgtctctgagctcagacttccaattccaagcggcagctgggcaggctcaccagcatgtccagccagtactaggacatcagcaggagcccaaccacctctttccaaaatctctcctcatgtctctcctagtttccatctccatccttctagtcagccaggctgaaaacatttgctcctcagggtgcagaagggaaagctttgcctcccttcctggtgctcactgcccctgcgattccagcccaagccctccccggctcctcaccctggtgtcagctggaagccaccatctcctaaacccacctgtgttcttccacctctgccagggctgccctctcctccaccttcacaaactcaattcctacccattctcaggtcccttatcaaatgccatctcctccatgatgcctccctgattcccctgctggaaataatggtgataacagctaaggcattggggttggctacgtgccaggcaaggagttggcactttacatgctttatctcatttcagccacataacatcgacaggtggcattatgattcatatcatccccatctgatagccaggaaaactgagtcccagagaggttagccactttcctagggccctgtgctctgactcaagcatagctctgaggaactctagcattcatcagtttaagcaccatgactttctttgctgagtcacccaaggcatttcttcatttaaatgttcttccttggccaggcgcagtggctcaggcccaatgcggtggctcacgcctgtaatctcaacactttgggaggccgaggtgggcagataatctgaggtcaggagttcaagaccagcctggccaacatggtgaaaccccatctctactaaaaatacaaaaaaatgaggctgggcgtgatgactcacacctgtaatcccagcactttgggaggccaaggcaggtggattacatgaggtcaggagttcgagaccagcctggccaacatggtgaaatcctatctctattaaaaatacaaaaaattagccaggcatggtggcaggcacctgtaatcccagctacttgggaggctgaggcaggaaaatggcttgaacccgggaggtggaggttgcagtgagccaaggttgcaccattgcactccagcctgggcaaaaagagggaaacatcgtctaaaaaagaaaaaaaaaaaattagccaggctgggtggtgcatgcccgtaattccagctactcaggaggatgaagcaagagaattgcttgaacccaggaggcagagattacagtgagctgagatcacaacactgcactccagcctaggtaaagaacaagactccatctcaaaaataaataaataaaaataaatgttcttccttgcaatgaagttaaatatgtaaattctcaaaccagttgcttaagggcacagttttgttctttacctatatttttaacaaatattttatgtaagtagttgacaaaatcaaatactgtgtacactaccgaggcttccctgggaaagccatcagcctctgccccatcccttcccactcctgattccactttcct

SEQ ID NO: 2527 - DNA, 37923 bp, Homo sapiens
ttaaacagtttccagcacaccactggaccctacccagacctactgaaccagagccctgaaggtggaaccccacaatctgtgtttcaataagctttccaggtgattctgatgcacattcaagtttgagaatcactgttcccatgggccagctctagtggtatcataagaaagaaaggaatgtgggggtgcccaaggagtaggatttcacaaggaaactttggaaaaggtaaagaaagaagagagaaagtaaactaggccctggggccttcctccaggcaaagaggcaaccaggcacttggcaggaaatacccctggacggagatgagacctgcagccccagggaatggaaggaggaaagagaatctggtgagtaggtgggatgcagccaacgtcaaatagtcatttttccacgtatccagatgagggagatggcgtcaattactctaagtcatgagatcggaagggcacaggataattggctggaaaaatgctcctttgggtgcatatttctgtaacaaagaaaaacacatttatgagcatttgttttgtttgtttgaggcagggtctcactcagtcacccaggctggagtgcagtggcacgatcatggctcacagcagcctcaaactcctgggctcaagcaatcctcctgcctcagccttcccagtagctggggctacaggtgcacaccaccatgcctggctaagttttgtatttttggtaaagacaaggtctcactatcttgaccaggctggttttgaattcctgggctaaaaggattctcccacctcagcctctcaaagtgcttggattacacgtgtgagccaccatgcctagccatgagcatttcactgaagatagaaggaagagaaatcctacgaagtgtttttcagggaagggatgaaaatggaaaatcctagcaaatgctcattactactcatgtaaatgtgtgcaaaatgccactggaattttctttccttttttccgttgtgaaatatttcaaacatatagaaaaagacaaggagtaatataacaaaagccttgtacctaccaccagaaatagcaagtgctaccattttgccacatttatgtcagatcattttttaaaagaaatgagacagcccaggcacagtggctcatgcctgtaatcctagcaccttgggaggccgaggtgggaggattgcttgagcctaggagtttaagaccaacctgggcagcatagcaagaccccatctctacaaaaaacaaaaaattaatggggtatggttgttcgtgcctgtttcagctactcaggaggctgaagtggaaggactgcttgagactgggaagttgaggctgcagtgagccatgatcacgctgctacactccagcctaggcaacaaagtgagaccctgtcaaaaaaaaaaaggaaaagaggaaagaagaaatagagaaagagagaagaaaggagaaagaaagaaagaaagtaagaaagaaagaaaaaaggaagaaaaagaggaagaaaggaagaaaaaaagaaaaaaggaagaaaaagaagaagaaaggaagaaaaaaagaaagaaagaaagaaaaaagaaagaaggaaggaaggaagagagagagagaaagaaagaaaaaaccttacagacacagttgaagtctttgtgccccttttccttcctccaactgtcctgaagttggtaggtattctcacactggtgctcatactttaccatatatgtattactcgtaaattacacctagcattgctttgagtgcttcttaatttatgtaagtgatgtcacactaaacccaccattctggaacctacttttttttcagctaaattgtgtttccaagatcggtccatgttgatgcatgatacattcatttttactgctgaataacatgaaactgtacaaagataccacaatccatccactcacctactaatagacatttgtttccagtttttcaccatcacaaatgattctgcagtggacatccttgaacatgcttctgtagagtagacccctacaagtggtgttgctgggccgcagggaagatgcgttccagttattagacatgctgtcaatttactcgctagcttggctgagccagttcacgcttgtgccagcagcagacaaaacaactgaaaatgttatttattcagtgtgctcttggattgggctctcttctgaatgcaaaaccaattataaggattttctctagttcgttcccgacctttgttctccaattctactttcccttaaagtcttaaattctttagccataaattcttctacaactagggttttccagaatctgacctagtggccaagaagaaatgactggtatgtgtgttacaggatggagtcgggtatgtgtgtgtatgtgtgtgtgtgtctgtgtttgtagctttgtaccaaagccaacaagaaagaactggaaggacaagactttccatagcatcttttaaatgatgcatcaaacccaggaaagaggggtaaccagtgtgacccagaatccactctcaagctataggtcctttcctccccctcttatttgttgggggtcaagggggagttgtcccaggacattactctgtggctccatcttccctgctccccaaacccaccagactccagacacttctctaagctgtgtaaacctaggggtgagggaaagaggtactctgtgcagaggaggggcagccccatgtgttcatctggggtaaagggctgacttttggccccaggcctaagagctctctgtccatgccaaagattcctcctgcatctgggcctgtggggttgggagagctgccaaaatcctagactgggcagtgacagtggagagcctatatcttggccactgagccgattcctcagccccaggaccatacagaagttgtctggaattccttccctcacaggccctgaagcaggagcctccaaggcctctgaagttgacttgagaaaaggggatggggggataaggagggggatagggattcaagggaccaccacaaagttgcctagctcaaaccaaagacatttcaagaggcaggaacctgaagtgaatgaaaaagcacaattcacagttaagcgagagtagggagggccctgacccaaagactatttttgtgttttttgtttgttttttagggtttttttgagatagggtctcactctgtcacccaggctggagtgcagtggtgcaatcacagctcactgcagcctccacttccgaggctcaagcaatcctcctgcctcagcctccccatagcagggaccacaggcacacaccaccacacccggctaatttttaaatttttttgtagagaagggatcttgctatgttgcccaggctggttcaaactcctgggctcaagcaatcctcctgccttggcctcccaaagtgctgggattacaggagtgagccactactcctttctttctttccaacagaaagactatttttggatgggatttctcccccagcaaacacttgaagtgtgacctacaggagttgtttgtttggaggggggcatttgtcctttatcaaaaagatgaaacctggttgggtgtgagtttcttgcctgtaatcccagcactctgggaggctgaggcaggaggactgcttgaggccaggagtttaagaccagcctgggcaacatagggagaccctgtatcaacaacaacaaaaaattaaaaattagccaagcatggtggtgcacacctgtagtcccagctactcaggaggctgaagtgggaggatctcttgagcccaggagaacgaggctgcagtgagccatgatcacaccactgcacttcagcctgggcaagagagtgagaccgtatcccaaaaaggaaaacgataaagcatgaacatcttggcgtccttgttccacagactccttttggcccagaacagtctgccctttgggcagcaggtggcttgcttcagcctggaggccaggaggcctactcaggcgcccagggcgattcaccaagggacctcacctctgagccccgcctaccacccaatgaggacgcgcggacatgacgtcactgcatcctgttgcccagcccagaccaggagaatgggacaagctggagaaaagagccagtggaagtgccagatgccaagagagaagttgggggaaaaaatggtggagggcaaatgagtcagcagcaagtttaagcaatgaaccattgcatcacggggtgtttctcaaattcttgtctacttttagaaaaagtacgcaatgacattcagtgggcatcttgattctgaaatagctaaagaaaatgttaaaaatgcagtgggtgaagatgtgcccacattaacctcttttctaaaacaacagttgacaattgtgctacatgtccttaagcaaatcttttagcctgcctgttccttagtttcctcatctgtgacatgaggggaatgtatgaaaaatatctctggagattccttccagtctaacattctgtggtttgatgattgatactatgctcacattcttaatactcaggctgtgtctacacagtgccaagacaactagctaattcagtgagtatggacaaaatgttcttccaatcaattctttggcacgctgtagacaaattggcacttcttttcattttacaactggttgctccggcttcttcttgaccagtgcttcttcaatggtggtatcctgacatgctgtatgcctggagcacttaggaggtgtgtcctaggcagttggctatggataatgaactgttgaggttctcaaatcgttgatgacttttttttaatcaattagaacagattcaatatggtcctatagtaatgcccctgctgcttagttgcaatccgatatgcctccctgaaaggaagaagtggtggaattacagctgccggacagagactgcctgtagccctgaccctgttggatgcccatgggagggtgtcatgtgttgtgcatgtgaatgtcatttatcatctgcaacacagcacttgagaatgactgatggaaacccctgagacatggtcggacatcaaggcactggagactcaggccctggagaaatctgagccagcatcctatgacgcaggtgcaaaccaggaagagtacagaatggagggcctgttcattatgcctgtctcttggtccaaaatgaatgatttcaccataatctgttcatagctggggaaggaaagggggcgtgaaatagcgtttattaatcatgtaggggccaagcccagtgccagacactcgtggcaggttttagtgttgctcgccatgtactttttattctcagctgtccagggggattacacttcctccctcttgtggtttggaagagtaatgtaaaattctggccaatgggttgtgggtagaagtgacatgtaccaactgaatgccagggcatttcgctgatagttttagaccctccagagctccctctccctctagcatgggaactggcaacagtctggtggctcttccatcaccagctggaatcctggaatactaggaaaccgagctccgagaagagacatgaggcgtgtgtatcatgcattgcacgtgaggatggagtaaaactttgttgttgtaagccaccaagattttcaggctgcctataactgcagcacaacctaattttgtgctgtctgatgccatgttttatataacatggtagtgtagtagaaaaatgtgagccttagagtttaaaatgctgggcacgatgtctcacgcctgtaatcccagaattttgggaggccaaggtgggaggatggtttgagcctgggagttcgagaccagcctgggcaacatagtgagactccattttattttactttttaaaaaaataaaataacaatttaaaaaatagagattaaaagacatgagctaaaacctaaacactcactgactgtgagcaaatctgttagcttctttgagtctcagtttcttcatctataaaatggcacgatgtttttattaggttcggaaataatatttaaaaatatctagcacaggatttggcacatagtagatgctcagttacaatgattataatttcatgtattcctcaaaataatactatgagtaaagagagggtatgggtgtaagagaaaggatagtcattactgatgtttcaaatgccgtcatacactatggagaacactgaccagggaccccaagggtaggggaaggtttgaagtcatctgtgtccaccctcccctgaactcagagaagtcctagaagggagagaaggcctgaagacaccatttacaatttagcctttccactgccagaggaaaagcagattctacttatggtagtgactattgacaccttcagcatataaaataagaatatagcagtggagtgagttagtgtccctgttagtttcactgaagcttgttatcctagcaaagcgccagccaaggtctttcccaaaggcgcaatgaactaaactcttctctgaaatcagcttattagtattatcatgaccacttcagctagctcacccaggacctgggaatgagctggagagtgaactacagaggaagggagagaaagagaatatcctcaaggcagcaggggattgaggggtcctttgtctcctcctgcttcccagcaagtcttgcctgatggaggaacaagagcagtcagaggacggggtggggaaattccaattctgtgtgtccttccttcaccatgccagctgctctggaaacctccagttccaggtcagatgcctgctgcagttcccacttatatttaatttggtagagtatatctcctccaatcccagttttctccaaggtctgctcccagatcatcgtttgcctcttaaataccacatcctagccatgaacttggaattctgaacattcaatggcctgcccccttggaacgcctcaattctgcctctgggatgaaagttccttgcacgttttcacacacatggagtgcagagagtcactgaggacccaaggagaacttgaacatcaccttgaccacctgtcatcagcaggaagtcaggctggaagcacttgttgaagcccccacaacctttggtgaatgaaaaatagagatgttccattccagacaaagcactgcatgcttgggcagctgttccacctgccaccaatccaacccggatttgctcttcactgacttttcacttttccacgcagaccaagaccccatgaaaatgcccatggccagtggggtgactgatttccagcaaatgtgtggtccttctaaattggggaggtttaccagaagcatgtattagatgaacatggatttgtgacctgtgctcaggtccctgttagtttcactgaagcttgttatcctaggaaagcaccagccgaggtctttcccaaaggtgcaatgaactaaactcttctctgaaatcagcttattagtattatcatgaccacttcagctagctcacccgggacctgggaatgagctggagagtgaactacagaggaagggagagaaagagaatatcctcgaggcagcaggggattgaggggtcctttgtctcctcctgcttcccagcacagctttaaaccctgtgctcagggtttaaagcatggcgagaatggaaaccggatggtgagattgagtcctggtggggctagttgacttcattttgatcaagatcacagattttacccctgacccagattaaaatctataaaatgggcttttgtgaccatgagagacacaagcagtgacgtgcaggagcagacttatagtggcttgtgagagccaggtgtaaaatattctggagctttgtaagccaatttttaaaatcattagtagcttgaaatctatcgtggtgcaagtatttataccatggaaattggtaaacccctacaaatcggggtttctcttcctccttccctcctcctccttctttgtgagagctagtttaccaaggcatgtgtgtcttctcgcaaaaccattctttcattggaaaaactattccagatatgggatcaggggaacagttttgtatatgggaagaacatagctctctggaatcacagacagctttgaggactcaaaaaaaaaaatcaacaaccaacttttaacattgatagaaactttgattagatagggagttgtggcttcagtgactgtgctgagattttaaatttaaaagatcttgctgaagtgaaaattacatgtaaatgttgggttgtatagcactgtaggagtctgtaaaaagagctgtagtaatgttctgtaaaaagtctttattgaattctcagtagagcagtggtctgtcgttgatgtggcttccagggagggagcatctggcccccaatccttgcagagaggggctgacacccggattgctgctgactgtgcccactgctgtgggggctgctgcaggagggaaaaagagctttgaataatctgttacgagctcaaccgtgtcccctaaaattcatacattgaattcctaatcaccaatgtaactgtgtttggagataggatctttaaggaggtgattaaggttaaatgaggtggggcaccaatccaatctgactgatgtccctatcaaagaggaaatgtggacacacagagacacactggggatgagcatgcatagagaaaaggccacatgaggacacaatgagaaggttatgtctgcaagccaaagagagaggcctcaccagaaactaagtctgtgggcaccttgatcttggattctcagccccaaaactgtgaggatgtaaatttctgttgtttaagccagctcatctgtggtattctgctatggccgtcctagctggctaataccatctgcaatccagattgcttatttctgttcttatctgttgattgatcagttttacagggtaattgaccttcctccacaattcttcaggctctcctaaccctgcctgagattctcaatgtgcctagtcacccaactgtgacaccaaggggtggggccatggagactgactcagaacttggcaggttaccttagggggtgacagtcagattgaacgtgtgtagaacttagctctgccagcatttagctgcagaatcatgagcaagcctttgtcccctttatgcctcagcgtcctcatctgtaaaatggaggcaaaaatattctcccttataagattatgttgatgataaaacaagatcatggaaggataagcacgtggcacagtgctcagtgagcactctcttctgaagcgaagcaggcctggggacagcctggcttagagatggctctgcttgccctagcactgggtgggtggaggaggcatcgggggatggggagggtgcctgagagggcagggtcattcctctccaggtgacctgcactgtggggagcaggtcacctcactaggacagttcctcctgggaccaagaccttccccctgttgaatttttctccctttggttgttccctcacagaacatgctcttcatggagaatactgtgtggcttaaataagataatcaagtaaaagcttcacagagagcctggctttcagcaggcactcaatacatggtaacgatttctacatctgcagttcctaaagcagctttcacgccaccccccagggcagctgtagccacagaattgaggcataatttggacactgttggtagaaacagcattgggtaactttattaaccaatttggttcagccttattaaggaggagagctccattcatgccaaaggcttctccaagcccttcgcaaataaccaggattcaacagcctgaactcccccaagaatgactccgtgccagaacacagcacaacccagcagtgtggcccttcctgattctcccatcctccttgccacatgggctgatggaggcttaggttctgtggctttaccgagctccaactctcttcctgcacttgagcaagagcacttggtgacctggtgagatggtagaaatggacacaagccctgactcctggcaggagacttcagacttgcagcatgtgcttaaaccacaggaaacggtgtggctcacaagtggtctgagcccaggaatgatgaaccccatgatgctgggagttcatctcatcgagtcagctctgtgacatttgggccatggagctgtggacccagctctccaggaacttctgcctgcagtgactgaaagctcttttgacacttttctattttactatcccctgggatcctgctgagcacacagggaggcttcagtagaagtcactttgtgtctctgtgtcaccttctgattaaaataactttaaaagtcatgttctgggccatgcacggtggctcatgcctgtaatcccagcactttgggagattgaggtgggtggatcacctggggtcagttcaagaccagcctggccaacatgacaaaaccctgtctctactaaaaacaccaaaaaaaaattagtcagtcatggtgcgtgcacctgtaatcccagctactcaggaggctgaggcacgagaaccacttgaactctgggagtagaggttgtaatgagccgagatcgtgccactgcactccagccagggtgacagagcaagaccctatcaaaaaaaaaaaaaaaggaatcaaaaagaaaaaaaagtcatgttctggaatggcctgcttcgtaggtacaaaagagcagggtttgcagagtcaggcaaaataaagggttggcttgcaatctaaccttatcagagacctggtggctaagggacccttctgtggagatttgcgagaatgtactcagcagagaggtgaggctcagaaatgaattcaggtaaggaaaatcctctgctgattcagaaaaagggcactcacgagtttctaacattctggaaacatcacatgttactctatttactccctatttactctctttctatctgcagggcccaaagcaggatggagataaagatgcccagaagaaaccaaagccttcttgggggaaactgtaagaagtcaggagggaattctttattagaaattgaagatcccgctgggcgtggtggctcatgcctgtaatcccagcactttgggaggccgaggtggacagatcacctgaggtagaagttcgagaccagcctggccaacatagcaaaaccccatctctactaaaaatacaaaaattagccgggcgtgatggcacgcacctgtaatcccagctactcaggaagctaaggcaggagaatcacttgaacttgggaggtggaggttgtagtgagccaagatggcgccattgcactccagcctaggcaacaagagcgagactccatctcaaaaaaaaaaaagaaaaagaaaagaaaagaaaaaaaaagaaagaaagaagttgaagatcaaagctggagaccaggactcttgacaaatctgaccagatttgaaacacacctaagaaatgtaagactcaattaattctacatgagcctaagaattaaaccaaataaagaatgacaacacaagtaatgaggatactggcttatgcctaggtgtttgtatttctttaggtctaactccaactgtatatcctattttaaattaatatttgttattctttgttttttgttattttaataaaaagctctatttaaatgtatttaaataacattagccagatgtggtggctcatgcctgtaatcccagcactttgggaggctgaggcaggtggattgcttgagctcaggagtttgaggacagcctggccaacatgatggaaccacgtctctacaaaaatacaaaaattagccaggcatggtggcacacacctgtagtctcagctacttgggaggctgaggtgggaagactgcttgagcctgggaggttcaggctaccatgagccttgatcacaccactgctctcaagccaaggcaacagagtgagaccccatctcaaaacaaaacaaaaagagaacactaatgccgttagaaaagaatgctttcattactaacaccactggggagccaagcaattcaaacccgcctgactccatgtggcagcttatttcaagtacaggcaaggagactcaaaggaaataaacagtgtgtgggggttctagcgatgcaaacctataaggttcttgtaactatcataatgcttgatcaatacttattaacaaaccacattctaggaggaacaagttttaaaagcctgaaaattggacagccaacgtcctaaaggtgagtgagtagcagtgagagagagaccaaacacagtgtgtccctggggtgatgctgctgtgctttaggtgaaaatgtcagtaaatggtttagccttcacatacaaaaaagcacaccaaattctacagtagtgaaaggtggaggcattctgtgcaaagtcaagttagactccttggaggttccaagagctcagaggagacccttgggttttggagatatcctggggcaacttgtttggttaaaaaatgtagaaaaggaaacactggggacccacaaagagatgaaaaactactcttttgtggaaactttcatttctcatcaaatatccatgtacccacccacttttctgaccctcttccattagttaggggccttgtggctgatagaaaagtgactgatgctgcttctgggctgatgcatgtaggagctggcacccaacatgccaactcgggccacatgctgaggtgtcagggcgggatgtggaatagagctcctcctccaagctgacttgggcgcattgtgtaagcacgcaagaagcctgggaggtgcaaggcctctgagatttcagaggtagtttgctcctgcagtttagcctcatttgatctggtgtgtacatacttcattcctatgccaatctcagtaaccaggccaggaggtaatagaacctctgccattaacccatgtgtgagcttgaggaagtcactcttctctgggtgtcattttcctcatgtggaaatttagagttgggtcagttggcctttctgctctgtcagtctccaattttgtatttttgaaaatttccatctaatagtgtctgaaaagttgccagtactagtgtctgtctatccctgtctattatctacatagacaccgccccatccacccatctgtctatgttcatccatccatcttcccagaatccatccatccttccatccatccatcctcccatcatccatccttccatcatccatcctcccatccatccatccttccatcatccatcctcccatccatccatcctcccatccattcatcctctcattcattcatcctcctcttcatccatcttcccacccatctccatcctcccatccatccaccctcccattcattcttcctcccatccatctccatcctcccatccacccatccatcctcccatccatccatccttccatcctcctattgtccatccttccatcctcctattgtccatccttccatccttccatcctcccattcatccatccatccttccatccacccatcctcccatccattcattctttcatccatccatcttcccatccatccatccttccatccatccatcctttcatccatccatcctttcatccatccatcctcccacccattcatcctaccattcatccatcctcctattcatccatcctcccatccatctccatccttccatccatctccatcctcctatccatccatccttctatccatccatccttccatccatccacccatccccccatccatccatccatccgttcatcctctcatccacccatcctcctatccatccatcctcccatccacttatctgcccatccatctccatcttcccatccacccattgctccattttactcctgtttcattatgaagggagctgggacagctgaaatagtgtttgggactcaacaatttgcctccccttccctacatcccttactgtgatggttaattttatatcaaactggctgggccacagtaccagatagctggccaaacactattctgggtgtttctgtgagggtgttttggatgagattaacatttaagccggtgggctttgagtaaagcagattaccctccaccatgtgggtgggctccatccaattagctgaaggcctgatgacaactggcaacagcaaaacatcctcagagatacacacatgagcagaaatgcaggagcatgctctgaattccctaacataaacatagaagggcacacaccccacatgcttacaaacgaaaaattcaaggtgctgctcagaatgtgctaacacaaagcaaatgctgtcacagtacctcagcactatccctcccgcccgcactcctgctctgcccagggtcatccagtgcctcttggccagtcagcatcccctgcaccaactctgccacccccatggccccttcctgatggtgcttctgattggttgcaacatggacactcagagtttgggaagaggaagcagtgattgtgctgtgctttgcaacccctccgcctgcccccactccccaattctctctctttctctcttttttttttttttcagagaacttagcagtaaaggctaatttatgaagtccctaaagatttgaactttctgcagaactggctgcagtttccagtgggttagagtctacttggagtagagcagaagctgtgagctgtgctgccgagaggagggaaggaagaagccacagcccaggacccacacccgtccagcatccccaacagccttcctcccctacagagagctcaaagatgacaccgactgttaggtgtgggataagagggacacagggtgtgggatgagatccagaagagcaggaagggggaggggtcaggagctctgtggttggagggaccacctccgttactaacatcccagtcaaattcagaaactatccaagccctggaggctcctaaaggcgcttgctccacccttgtaccatcccagttccctcctaagtttgcaagatcaaatccagtttaaggctactccttcgattttctcatgtcatgagctgacacccactgctgggaccaaatattcatttccctccccatgaaagccaaagctctattcggtaaggataaattcacattaaaaataagaggtttacagtcaggtgtggtagctcacgcctgtaatcccagcactttgggtggccaaaacaggaggatctcttgagctcaggagttcgagaccagcctggtcaacatagtgagactccatctctacaaaaaatttaaaaattagctgagcatggtggcaagtgcctgtagtcccagctagctgggaggccgaagtaggaggatcacttgagcccaggaggtcaagtctgcagtgagccaagatcgcgccattgcacttcagcctgggcaacggaacaagatcctgtctctaaaacaaacaaagaaactagaggcttttttttaaattattttttaatttttttttttttttttttttttttttggagatggagtctcgctctgtcacccaggctgcagtgcagtggtatgatctcagttcactgcaacctctgcctcctcagttcaagcgattctcctgcttcaggctcctgtgtagctggcaagcaccaccacacccggctaatttttgtattttttagtagagatggagtttcaccatattgaccaggctggtcttgaactcctgacctcaagagatccacccttctcggcctcccaaagtgctgggattataggcgtgagccactgcacccagccatcgaagtagaggcttaattttccctgttgaaaataacagaagagccgggcacggtggctcacacctgtaatcccagcactttgggaggccaaggtgggcggattgcctgaggtcaagagttcaagaccaacatggtgaaaccccgtctctactaaaaatacaaaaaaattagccaggcatggtggcgtgcgcctgtaattccagctacttggaggctgaggcaagggaattgcttgaaccagggaggtggaggttgcagtgagctgagatcgggccactgcactccagcctggatgacaaaatgacacagcaatactctgtctaaaaaaaaaaaaaaaagaaagaaagaaagaaaagaaagtaacagaagagactctcccagcccatctcacttccttttcctagagcacttacttttggaaacctgtaatcagtagttctttctctgtctcttttaaatgtatgtaaatcttttgaaaagctaaataagcctcttgccaactttaggacccaggtatgtctttctccaaggacctgggaatcatccctttgaaaggtaatcatcaaggaacatagctccccatcttctagtctctagagaagcataggagcctaacttcagctccaacttgcaaaactaccttttgccataaagaaataagaagtttatttttcctttggataaaggcaattagcaaacacagatggccactccaataaccaggagactttagaatgaactatgtgtgacaaatagaactagtcccctgaaaactagttattgtttaacgtgagaacacgtatgtaacagattggagctgcttggctggacaaaaggtaagactcctttctgtctttgcaatctcttcgcagatcacctggcatgcgcgtcccattctggttgaatgcttgtgcaataataaaactgttttctttcttttcaacctttgtgaagaggttttctgagttgagagattttgtctgtaattatcgttccccagcaattcttgtgctctcctaaagagaggatacccaggcctttcaggaggagggaggctgaggtagcaccactggcaggggagggaaggaggaaggagagaggaggggcatgcaggccctgccaaggtcagacacagctggtatagcagagcctgggcatcatccaaaagaaacaggctcaatccatcctgtacagttccccggcttccccagcccccagcccgtcttccttcccaggctctctgccctgggttcacttgccctcctttatgcatcgaatgttaaacttcttttgttttccccttcagcagttcttgcccgctttgcatacagatgctgtgtgtaatagatgcacggtaagattccattctctacctgtccgccaagtcccctttgtttccacagtgaacctcattcatctggaccccattcatgacattttcaaaaatcactttcctaagcaaagactaaagtgtattttgctttttctgtaaaggaagatgatgtcaagtaaatttatcaacaaacttgctgggagccactcaattgacttgagatcaggaattgtttttgaacatttgatgacaactttgcatactggattgtcaaatattgattatttttctcctccaccctcactccccacagcttaaatgggaccccaggcactgccctagtcaggttgggggctagttggctacctaaggggaaggcctgaagaagcaatttggtttaagcctttgagctctaattctcaacactggctgcatttcagaatcaccagaggggctttaaagtatatatgtgaatgtgcagatcccacccccagcgtttctgtcttaattgaggcgtggtggtgcccagggcagcatctgccttgacagctcccgggtgggagtctctatcacatctgtcagtcagtgctccctgtgagttcagaagcctagaggtaaaggcctctcaactctagttgctcattacagcaccgagagagctttttaaaaatatgaatgctggcccggcgtggtggctcatgcctataatcccagcactttgggaggtcgaggtgagtggatcccttgagcctaggagttcaagactagcctggacaacatagtaaaaccccatctctacaaaaaattagctgagggtggtggcacgggaggctgaggtgggaggatcacctgagcctgggaggttggggctacagtgagccgtgatcaagctgctgtacttcagcctgggcaacagaacaagacacagtctcaaaaaaaaaaaaacccaaccaaacaaacaaaacaaattgaatgcctgtcacaaagcccagcgattctagttttattgggctggactgagacctgggcaccgggagcctctgatgcgtagccagagtgagactcactgggagaggggaaagaaccgtgacttctcagtaagactgactaagcctagtgtctgggctctgctgggtaagtgtaagcaggttgattcacctctctgagcctcaattttctcatttccaacattggagtgctgcaacccaccatgcagggttgactgcagctggtgtcttccacctgcatggcctgcgttagctctctcagtagttctccttgtcagaaagtggacatttaccattagtaattaactatgttaccaataagaattcagttcttatcaatagaaaggtgctgcttttggggatgtgaaaaagaagatgccagggcccgcctgtcctcccagtctttgacaagtgtcaggacagtggctcttttccatctctcataaaatcctgtttcaggaggctggctcttttgaatcaaattgtacttaattaaatcctccctgaaactcaggggagtttcataggaactctgcatatatttacagcctttggccaggcacggaggtttgcgcctataatctcagcactttaagaggccaaggtgagagcattgcttgagcccaggagttcaagaacacctgggcaacatagggagacccccctgtctctaccaaaaataaataaataaattaattaattaattaattaattagctaagtgtggtgacatacacatatggtcctagctattcgggaggctgagttgggaggagagacagagcatgggaggttgaagaggcagtgagctgcgatcttgccactgcactccagtctgggcaacagagagagacctcttctaaaagaaaaaccggctgggcatgatggctcacgcctgtaatcccagcactttgggaggccaaggtgagtggatcacctgaggttgggagttcgagaccagcctggccagcatggtgaagtcttgtctctactaaaaatacaaaaattagccaggcatggtggcgggtgcctgtaattccagctactcaggaggctgaggcagcagaatcacttgaacccaggaggtggaggttgcagtgagccaagatcactccattacactccagcctgggcgacaagggcaaaactccgtctcaaaaaaaaaaaaaaaaagaacccaaaaaccaaaagttctgcatgctagatcttattgtaaagaatgcatatttgtattacaaaataaatgaaaagcaagttagctcaggaactgagcctggaacttactatcagatcacatggattccagagcatctgtgtgtgtttggctaacacccctcaccccttccagcctccatttgctccactaaattttagactgcgattctgaaaagtggggttgaaaatcctgttgctgctacgaagactgtgcaattctatagctcattcctaatgtcattgtcagcaggccaaggatgcagtttcacagccctgctgggtgtgaccgaaaggctttctctaagtgtgccctttcattaaactttctgaaactgctattggctttgcactcagcgaggtgcagaaagggataaagataaaacagatacagattctgcctacctgccctcaaatagattgaggtttggaagttcagacaggtcatgcatgtaactaactctaacacgcagtagagaagaggtctggctgggagtcggggcaggcttgctagaggagggagtattttaaccatgcatcaaggaagagcggagtatgggtaacggggcaggtgatgcccttgtcctaatgtcaaggatgccaaggtccaggatgtaaggaggcaggaggcagttcccggagatcttggattatttttaggaggggtgaaatagctggtcaacaggtatgcatgttttaaggtctttactgcaccttgcccaagtgtcctccagaaaggatgctccaatgtacacttagccagatattaagatgcctggagccttggtctgaaaatgcaggaggaagaggtgcaggggctgtgaggtggagcggagtttgtcctgtcagctcaacaaatatctttcatcactgggctgtctgtgtggtgtgcagagatgaaaaatggacacattcctgccctcagggagctcaacctactgggagagatagaccacagcccaaaagtgtgggcaaacctagggctcccttgaaagttataagcaggtgttgtttgtttgttttgagaaagggtctccctctgtcgcccaggctagagtgcaatggcaagatcacagctcactgcagcctcaaagtcccagggtgaagcgatcttcccacttcagcctcccaagtagctggaaccataggctcatgccaccatacccaggtaattttcttttttttagagaccacgtctcactatattgcccaagctggtctcaaactcctgggctcaatcaatcctcccgcctcaacctcgcaaagtgctgggattgcaggtgtgagtcatccagcctggcctacgagcaggtttttgagctgaaaagagtctgtcctttctggattctccctctttgaggcacctcattcacctcagtggaattattcacagggttccaccagtaatccttgggttccctgactctccaaaaggcatctaagcttcctggcttcatattgcctgactctactccctcccacatttctttgtcccagctatttaacttcagcactggaggaatctccaaggtgcttgaagagttctgcccagcttcccgcaaggctgtgccttctcaggtcatcgagcaaggaagccatccctgagagtctcatccgagagcccttgcagtgggcatccaaggccataaatatttgcatgcctgtgaacccagctttcagaaatgatcttaaggaaataagcatgagtatttgcagagatttatctataagattatgcatgagagccttatttataaaagagaaaaatcattgaaaatgacctaaattttcattcatagagtttgactaaataatttatggcatattcacacaatgcaggagttgtaaattacatcatggaagaatatttaatgacatgaaaagaaacttaaggcatttgcaaaatactgtgtactacatgatactatttctgatagtaaaaaatatatacaaacgtagagacacaagggagagagaaaagtcatgtatcaaaaatataaaactttcatgatttcagggtagtggattaataagaaattttaattctcttttctggatgttttctatgatgttcactatttgtttaatcagaataaaagatactctatttttgaaaatgatatctcctggcacaggacaatgattcccatctgaggcacatgcgggtaggaggtgggtgctggggagctgcactgcttaggccaggagagtccccctgagctcccggctgctgggacacacttctcagccatgccctcctctgcaaagtgccatacagcaaccctggttatgcaacaagctgcctcggccctgggcaaacagatcctctgactcctcggctccattacaggccataatgggacaaccagacctcaggcccgatggttgcataaaagcaggatggatagatttttctggtcactgtgttccacccagctgagcaggcatattcagactccttccctgctgtactgcttagctcatgcgaagcaggagccttcttcaggcagccttccggactaactccactatgccgtgtgcttcaaaagcccctgctctaatccataatgaacacttgcagagtactctacttgtaataatccaaacgattctcatgacaacactataagtgggtactgtgatgcttttgtgacaaatgaagcaacggaggcagagagagcacaagcgattacccaaagtactatgcagagccaggattcaaacccaggcagtgcagccccagggtcagcccggaagacaccacgccatgcagccccctggcagataattgctatcacagccacatttgcatggtgattctgagttgtttccaaatttttgctggaagactatggattcctcgaaggcatgaattgtgactttcacttccgtgggaccatccagggcccagcagagcactgagtgcacagggccttcccaggggcttgcattctcggctctgaagcccgccttctttcctactccagctgcaggtgcaagtggtgaatcctactgagccataatcttgctgctagaggcttatctagaggtgcttatgcaagcagtctggcaaaacacctctttagggacaaacgtagagctggagacttgggacgcctcaggatgtgtcagatcacagctttctgcagggcacaaggcttcttgctgcttctccagaacatctctccaaatgcctgtgcagccctgggtacctgggcagggtccagctctacaaaggatcatggctcgagtccttccgctccaatgggaaagaccaaccaagtgagagaaagagcatgccgcccagagggggagctggttgccattgtcctcttggctgtcatttgtttcttcagggtttccaggctggcttccaaccgaggatgtaagaggctgttaccaagtccaggcagatcagcacaaacatattaacaggggttatctcagcgtggtgtgatgagggatgactttttctcatggctttgcttctctgccttttctaattttctgcaatgcacatgattatttgggcaattaaataattacagggaggggaaagtcactgttcttgctttgtcccttgcaggactctttccccacacttatatgggctgctaagctccaatgtgccctctattgcatgtggcttccaccgagctctttctgatcttcacaccagcaaactcccatctctactctgtcctttccacacccttcactgtgtactgatctgctcaaatccttgcagattataaaatgtttcactggcccgagcctgctggtccccacaaccctgatttcaaaagaagtcatcttttgtgtccttgcagagcgtgcctggattgtgtctctatccttggtcccttacctggactgtagccccagttaactgctgaataccagcagctgggtgtcctcagcaaccatgtccacatgaagcatcttagtctcacccactccttctgtgtctctacgagcagcattgagctgtagatgggaaagtgtatggaaatatgatcactttttccctagggcaaagagggttggtgttcttttcttcaaaatttattttgaatctgtcttttctgtctccccactacccctcactcatgctcctgagtcactgctgagctccagggctgtacctttctcattttggaatctctaggatctagcatagtacccagtgcacagtatgccttcaatgtatgcctcttggttcaatgaatgaatgcatgaaaaaatgggcaaataagtaagttttaataatttgtcaccttgatttttatttcttgcaatccttcctgtatttcttgcaatccttgttttattccttgcaatccttcctatatgtctctgccagttgaatcttccaaagtggtgactcgaccacgtgaatctcctctggtgactttaatggctcccactgtctgcgaaggcctttcaaaacccagctgcttgttacctttctttgcaaggattttctctctcactcctcaaagctccattctggctgacttggcctctctgtatcctttcctgcccttgttgagttgcccttttctctgtgtagccacttagctgcctgtgctgatacttgctgctggctaagcttgtcataagttcagtgtgacaccctttcccgtgatgggctgattacagtaaggtcccaatctagtggtgcctccctctattgctgggttgggtaatctcccagttactctgggtttgaccatgtgacttgctttggtcaacaggaaacaggatgttagcagagacttgaaaagtgcttgctcattggggtttgccatcttttgctgctctagggaatccagcagctgtcaccatgtaaacaagcccaggctagaccagttaccctcatcatcttagctgatagccagccagccaccacaggcatgagtcaggccatattgctggacccacagaattatgagctaaataaatagtcttgggttaagccactaagttttaggcatagtgtgttatgtatctcacaaacatataagactgtgtgtttgttgactggaggaagagatgctataaagaccaccttttaaaacttcccaaatactgccactgatgtcctgatggaggtatgaaaacatccactaaaatttgtggtttattcatttttcattattttgtttaaggaggtctatagtggaagagggagatatttggggaaattttgtatagactagctttcacgatgttagggaattattattgtgtgataatggtcttgcagttacacagaaattcttccttattttttgggaagcaccaaagtagggataaaatgtcatgatgtgtgcaatacactttaaaatgtttttgccaaaataattaatgaagcaaatatggaaaataataattattaaatctaggtgatgggtatattgtagttcactatagtattgcacacttttctgtatgtttaaatttttcatttaaaaaactttgagctagacaccaggctatgagctaggagcatagcaatgaccaaatagactcctaccaactcaaagaatgcacattctctgggaaacatgtttccattaggaagcctcgaatgcaatgtgactgtggtctccaggacctgtgtgatcctggcttttcctgttccctccgcatcatcactgcaggtgtgttttcccaagttttaaacatttaccttcccagtggccttgcgtctagaggaatccctgtatagtggtacatgaatataacacataacaaaaatcatctctatggtgtgtgttgttcctggggttcaattcagcaaattttccctgggcacccatgtgttcttggcactggaaaagtaccgggactgaaacagttgatggcccaatccctgtcctcttaaaacctaagggaggagatggaaaggggcacccaacccagactgagagacaggaattagctgcaaggggaactaggaaaagcttctttaaggatggagaggccctagtggaatggggagattcttccgggagaagcgatggatgcacagttgggcatccccacagacggactggaaagaaaaaaggcctggaggaatcaatgtgcaatgtatgtgtgttccctggttcaagggctgggaactttctctaaagggccaggtagaaaacattttaggctttctaagccaaggcaaaattgaggatattacatgggtacttatacaacaagaataaacaatttacacaattttttgttgacagaattcaaaactttatagacacagaaatgcaaatttcctgtaattttcccatgagaactattcttcttttgttttgttttgcgacagggttgcgctgatcctcccgcctcagtctccctaagtgctgagatgttgcaggaagtcagggaccccgaacagagagatcggctggagccgtggcagaggaacataaattttgaagatttcattttaatatggacacttatcagttcccaaataatacttttataattttttatgcctgtctttgctttaatctcttaatcctgttatcttcataagctaaggatgtacgtcacctcaggaccactgtgataattgtgttaactgtacagattgattgcaaaacatgtgtgtttgaacaatatgaaatcagtgcaccttgaaaaagagcagaataacagcaatttttagggaacaagggaagacaactataaggtctgactgcctgcggggtcgggcaaagggagccatatttttcttcttgcagagagcctataaatagacctgcaagtaggagagatattgctaatttcttttgctagcatggaatattaatattaacaccctgggaaaggaatgcattcctggggggaggtctataaatggccgctctgggaatgtctatcctacgcaatggagataaggactgagatacgccctggtctcctgcagtaccctcaggcttactagggtggtgaaaaactccgccctggtaaatttgtggtcagaccagttttctgctctcgaacactgttttctgttgtttaagatgtttatcaagacaatacgtgcaccgctgaacacagacccttatcagtagttctcctttttgccctttgaagcatgtgatctactccctgttttacaccccctcaccttttgaaacccttaataaaaaacttgctggtttgaggctcaggtgggcatcacagtactaccgatatgtgatgtcacccccggcggcccagctgtaaaattcctctctttgtactctctctctttatttctcagccagctgacacttatggaaaatagaaagaacctacgttgaaatattgggggcaggttcccccaatatctggtgcccaacgtgggatactgagattacaagcatgagccactgcatctggcctcttcttttgatttttttttttcaaacttttacaaatgtagaaaccattcttagcttttgggcattaccaaacccggcagtggcaggctcggttcaccaacgtcatttgcagttccccgctttatgttatgggttttgttttgttttgttttttttattgagacagagtttcactcttgttgcccaggctgtagtgcaatggtctgatcttggctcactgcaacctccacttcccaggttcaagccattctcctgcctcagcctctcaagtagctgggattacagacactcaccaccacacctggctaattttgtatttttagtagagatgaggtttcaccatgttggccaggctggtctcgaaatcctgacctcaggtgatccacccaccttggcctcccaaagtgctgggattacaggcttgagctaccacgcctggctgggttggttctcaatggagtggtttgtttttggagctgctctgcgcagtggggaccagaataggcctgggttcctagcccattgctattccttaccagctgtggattctaaggaaagtcatttaacctcgctggaccttagattcctcatccctgaagcccaagggtaaaacaaaacaaaacaaaacaaaacaaaccaacccatcatgtaaagcggggaactacaaacgatacaggtgaaacatgcctaccacaccactcacaggctatgatgacaaaaacgtggctacatctgggaccaccccccaacccccactttgtacgtaggaaatacggagttgaggatggagacccacagtatgtccagagtgtccccaaaggccacagtgcccgcctggagccctccagagagcgtgcactccctggggtgccagccagagacaacttgccctgaggcttggaactcgattctccgcgtgccagagaaggggtgggacttcagaacccccaaccccgcaatctgggtcggggagcctggcgcactgcgggccgctccctctaaccctgggcttccctggcgtccagggccgtcggggccgagtcccgattcgctcccaccccgaagccgcgccaggaccaacgagggcgcagccgtatgccccagcccgctccgcggagcccctcacagccacccccgccccgaccgcgccccgcgcggctcgaagcaccttcccaaggggctggtccttgcgccatagtcgcgccggagcctctggagggacatcaaggatttctcgctcctaccagccacccccaaatttttgggaggtacccaagggtgcgcgcgtggctcctggcgcgccgaggccctccctcgaggccccgcgaggtgcacactgcgggcccagggctagcagccgcccggcacgtcgctaccctgaggggcggggcgggagctggcgctagaaatgcgccggggcctgcggggcagttgcgcaagttgtgatcgggccgctataagaggggcgggcaggcatggagccccgtaggaatcgcagcgccagcggttgcaaggtaaggccccggcgcgctccttcctccttctctgctggtctttcttggcaggccacagggccccacacaactctggatcccggggaaactgagtcaggagggatgcagggcggatggcttagttctggactatgatagctttgtaccgagttctagccagatagaaggttaccgggagctggggagcgttggatttgctgctgggctgtgccggtgcccagaaggcaggaccttgcagaaccagccaggtccctgggagactgtcagacccaccaacctggtggcattcgcagagctgagatgcattggaaattgccttgggcacatccccaaagatcaggatgtcccaccccagtctgaaggagataaagttgggggtaggagagacgcagatgcaagtgatcagtctcagtcccagacattgccttgctctgcgggtaggaattcaggattcattttccagggaagttcctgacctctgaatgagaggggctgtgtaaggccaatgcctgggaggaaggcaaggatgagtagaggtggggggaaacaagtgtcaggaagactcaaaatcttccagagaaattgtgcagggtcttaccagatctgtcctcaaagccatgcaaattgccttctttgcaatgcatacaatgaggtgtctctgggggtcagaactggttattagggaacttctagccaggactgctaaatacgcgctgttggcccaccaggctcacctatagccttccttcagtctgggcttggtttggatttcactgtgggtgccatcgcctttacactcctgtttctatagtttaaagatagtggtgctttgggaaagtgactccttaaatacagttaggtccaagtgagacaagtggcctggctgtcatttcagaatagcagcttccaagaggtgattaatttctgttggaagggtgatctttggggaggtgggtgaagagcagagacttggtggtaccgttccaggagcacaggctctcttcctttgcagtgcagaatgacctctggcagccggagttgtgtttgttctgtaggattctgaggtgggccatgggcagctggaactggggaattttgccaatctctttcatattaggattgtctgcagaaccagatatggaggcttctagcaacgtgagtgctcctgttctaatgcccttagaaacaagaaggccacactgatcatttctctcacttaggcagggagacaaggcaagagagaaacagtggatgcttttaggttctttcccttcccaagcagttgtggacattgggctgaggggaacatttccacattggctaaaggagcgtcctcctcatattttgtacattttatacccaaaataactcttcttggtatttggggaaatattttcctccccgtccattccaggaaatggctccaagtgccaaggacagagccagggaagttgcaatgaattcctgcccgtcagccccaggcagatgccttgcacgtctgagtggcccatgcagagcgtggaggtggccgccacggaacctgggtcaatgtcccacccccgcttagatgccaccaggggcgtgggagccaaggagagaagaggggctccaggaaggtagagtccttgtgtcttgtgcatctgtgaacagcactggtatgatttaaaggaaaattgagccaaattttccggcagtcagttaccccatccccaccggggtaggagtctggcagccgcagctccattctggccagtcggcagagagccttgaaattcttctttgtccacacagttgtctcagagaaacagagaggttgtttctgcttaaaaacaacacacttggtgtctgggcccacagactcctttgcacttattccacgtgtgacagccaatgtgcctcgttgcttagcagacagcatgttaccgtctttcctgctcagtttgttagctctatggaatggaatttataatcaatgcccataccaacatttcactaatatcataggagatttagtctccatctgggtgtacattacatttgctctggggtgctccaggctggggggttgccaaggaagagaagagaaaccgcagagaagacgggagggcagggcaggggtctctgagaaggggaggggtcccagagtgcaggagcaggagccaggctcatgaaaggggccacgggcgggagtatccagggacggcagtcaagatggagcacagcttaggaagctgaagggaatcctggcccacctgggtgctagagggcacataggaagtgcaggaagcagaccaaggtccccaagagagggagacctggacgctgaagcattttctgtctttattaagacaactccgtaagaattcctgctgggccaaagtgaattctaggatgcgactttaagatgggagcaagcgaaccattgaggaggcaggttaccctagttagccaatgcagatcgagaatgggaaatctttcatttattcatgcaacagatatttaacgaagccctgccgtgttccaggcctgtgatagatgctggaacaggtacagagatacaggtgtcattaattgatcagggcaacctctccttctgagtcttgctggagcttcagatgcccctcacacagagctcgagggagcctcaacaattgatcagaagtcaggcaccatggctcacgcatataatcccagcactttgggaggccaaggcaggtggatcactggagcccaggagttccagatcagctggggcaacatggcaaaaccccatctctattaaaaaaaaaaaaagtaactggatgtgatggtacacacctgtagtcccagctacttgggaggctgagaggtgggagaattgcttgagcccgggaagtcgggggtccagtgagccttgatcacaccactgcactccagcctgagtgacagagcaagaccctgacacacacacacacacacacacacacacacacacagattagagctgaaacaggagtagaaacctatctgtatctctgatgagatcagatctttctgatgaacagaaagaatgtaacccctgtactcacaccctctctgctggttacatatgttaacacgatttctcaaatgaggcttttggttgcaaataagagaaaatcactcacgctggccctgtgtttttcaaattgtttattgtgatcaacatttgaaaaaagagccgagactctcaagagtgcattacccacggtaagggtgaattttacttcttgacacttatttctcttacatgtatctatctgtctcaaatgaaaaatatatttagaaagttgaaagctatccaagtgagtataagaaaagagtatctcaccctgaaggctaaggacagggagggccaccaggcctcacgaggacccaggaaccacaaagaaggctaggaaggagcacaggcggtgaccatactctggctcagtggctatgtgggctctggtctctctcagctgttccatgcatatgaggccaaatgtggctaccctagagcttctgagccctcaacagagatgaactggactctctgcagccccactctaaattcctaagagagaagttgattgacccaatcagggtcaggagaaggaagggaggaggaaagggaggagagaagagcctcttcgtctcttgcctaccactggccaggcaattgtagccaagggggctggagtgtaaatgcaaacatagccatcaagggttgtgtatgtgtgtgtgtgtgtctgtgtgtgtgtatgtgtgtctcttgggtaggttagatctcccaggaggtccctactaaacagacttaagcccgcaaaattttagctctccagcctcacacactccacccctctaccatattgaatcttcccaaaccaactatggctttccctaactccggagcttggcctggaatgccctgcttcccctctttcccctggggaacgcctgtccttcaggcctcagttcacacactgcctcccttgcaaagctctcctcccatccccggagtccctcttcccctttgttctttgggttctatgcttcttccctcataactcccaccaggttgtgttaaaatgagttgttcaaggtcctgtctgttccactagattctgagcaacttggagaacgaagatccaaacttcgctgcctttatttcctcctttgttcttttctcatccccaagtcccttccaacttggagttatgaagaaaggaaggaaggaagggtgggagggaagaacaggaggggatcccacaggagaatgtgtatagggagaggactcagactagctaaagcttttccctcataattaatagcaaataccatgttacctgaatttaattcacagtagcatacaaaagactcgctttgttctccccattgatgtcatcagagggctgtgggcaggcctaatcttggctcaggaggccctccagcctggatctaaagagcagcagatgggccaggctcggtggctcatgcctgtaatcccagcattttgggaggccgaggcgggtggatcacgaggtcaggagtttgagaccagcctggccaagatggtgaagcctcgtctctactaaaaatacaaaaattagccaggtgcggtggtgggcgcctgtatttccagctacccgggaggctgaggaggctgaggcaggagaatcgcttgaacccgggaggcggaggttgcagtgagccgaggtcacgccactgcactctagcctgggcaacagagcaagactccgtcaaaaaaaaaataaaaaaataaaaaaataaaaaaaataaagaggagcacacatctctgcccatcctaactcccactttgacattgaggtccccaggatggagggtctgcctccatctgccttgtcccctgcaatggtgggaaggtgatggagctcaagtctagaggccaccagcttcttagggaggtaggaggtggagggtggggtgcgggccctgcacacaactgccaagtgaggatgggggtggggtccacctgaggataagtaacagtgaggctggtgcagaggacccaggtggaggtagacagcagaatttgtggtggggtggatggcacattatataagcctctcttgctgccctgtttactgagattgtttcattatcttttttggcttttgtttttaagagatggggtcttgctgtgtcacacaggctggagtgcactgtgtgatcatacctcactgcagcctcgacatcctgggctcaggcaaacctcccaccttggcctcccaagtagctgggaccacaagcgtttgccaccacactcagctatttttatttttatttttattttttttagagatggggtcttgctgtgtcgcccaggctggtcttgaactcctgggctcaagcgatcctcctgccttggcctcccaaagccctgggattataggctgagccaccacacccagccacatttcatctgtgcagctccaggggctccacattctactcttctcatttcttctccagggtacccatggcaagggatgagggtagaagatggggcagccaggccttgattaaaggagaaggaaggcagcctgtggagagggcagcccagggagtgcagagagaagtgggccatgagggagacagcagagtgcaggctgcgtcccaaatgagcatacagcccactgtgagcccaccatcttcctagagacccctctcctctccaggagctgcttcagtagcactcagaggaaagaatgatgctgtatcaacatttcagcagctcatcttttaactctaagaaaatggcagctcctaaatgttcaaaactgctttggaaacttctggagagaggttttgcagctcaggcagacagctgatcgcggcctttcttccaccccaacccatgctctccccatgctctcctgccacagctgcagcgggcccctgggtcctacatttgcagccctttgtctctgagctcagacttccaattccaagcggcagctgggcaggctcaccagcatgtccagccagtactaggacatcagcaggagcccaaccacctctttccaaaatctctcctcatgtctctcctagtttccatctccatccttctagtcagccaggctgaaaacatttgctcctcagggtgcagaagggaaagctttgcctcccttcctggtgctcactgcccctgcgattccagcccaagccctccccggctcctcaccctggtgtcagctggaagccaccatctcctaaacccacctgtgttcttccacctctgccagggctgccctctcctccaccttcacaaactcaattcctacccattctcaggtcccttatcaaatgccatctcctccatgatgcctccctgattcccctgctggaaataatggtgataacagctaaggcattggggttggctacgtgccaggcaaggagttggcactttacatgctttatctcatttcagccacataacatcgacaggtggcattatgattcatatcatccccatctgatagccaggaaaactgagtcccagagaggttagccactttcctagggccctgtgctctgactcaagcatagctctgaggaactctagcattcatcagtttaagcaccatgactttctttgctgagtcacccaaggcatttcttcatttaaatgttcttccttggccaggcgcagtggctcaggcccaatgcggtggctcacgcctgtaatctcaacactttgggaggccgaggtgggcagataatctgaggtcaggagttcaagaccagcctggccaacatggtgaaaccccatctctactaaaaatacaaaaaaatgaggctgggcgtgatgactcacacctgtaatcccagcactttgggaggccaaggcaggtggattacatgaggtcaggagttcgagaccagcctggccaacatggtgaaatcctatctctattaaaaatacaaaaaattagccaggcatggtggcaggcacctgtaatcccagctacttgggaggctgaggcaggaaaatggcttgaacccgggaggtggaggttgcagtgagccaaggttgcaccattgcactccagcctgggcaaaaagagggaaacatcgtctaaaaaagaaaaaaaaaaaattagccaggctgggtggtgcatgcccgtaattccagctactcaggaggatgaagcaagagaattgcttgaacccaggaggcagagattacagtgagctgagatcacaacactgcactccagcctaggtaaagaacaagactccatctcaaaaataaataaataaaaataaatgttcttccttgcaatgaagttaaatatgtaaattctcaaaccagttgcttaagggcacagttttgttctttacctatatttttaacaaatattttatgtaagtagttgacaaaatcaaatactgtgtacactaccgaggcttccctgggaaagccatcagcctctgccccatcccttcccactcctgattccactttcctgtgtttccatatctttttcatgtctgtttctggcccacagtgggcgatcaatacatgttagccaccaaccatcaaacctatattgagtaattatggtatgtcaggcactatgctcaatgaaattgtattaggcttgtacaaaagtaattgtggtttttaagagtaatggcaaaaacggcagttactttcgcaccaactatttgctgccttgaattattcctcctctcctcatccctaaaccctgctcctcccagccattcttcctccccttcttgggccatggccaggccccacccaggtactaagactcaggtgaaccaaggaagacttaatgcccactcttttctgatgcccatgttggcatgtgttaagtcggttagcattaagtttggctgcatttagcagagacccaaaagaacagtgccttttaaaaggcagaggttatgtctctcacacacacccagcacaagtccaagaccagcatggcatctcagctccatcaacctcaggaaccgagctcctgcagctccctgccctgcagttgataaggtgaggtctttgtcctcctggttcaagatggtgctagaatgttggctaccatatctatagtccaggcatcagaatggagcaagggatgaaaaaggaagagatgaaggcacacgacaggttcctgagagctggcacaggacacttctgcttatatttcactggccagaacttagtcacatggtcacacctagttgggagactctgagaagtaaagtatttattctagatggccatatccctacctaagacttggagttttctatgactggggaagaacggaagacaagatattgggaaagactagcagcctctactaaaagggtgatctgtgttgatgtgcgtgtgtgtgtgatgtttgtatgagcatgtgtgttatgtgttgtgtgttggtggggcagattcttgcgagcactttggtctcagatggacctgctaccagttctctctgcagacccccataggtttctcctaaacctggcctctcctattaggcagccttactcagcggcagcttctcagctccatgttttcaaggaaccacaatttatttccagcatccactgaagcatattatcagtggtgatagagggggcttgtaaaactgtttttccacttaggtattagagggtggccattatttgagagtgactatgaccacagttaatctggtaataaattctcttgggtaggaggaaaggaaaggatgctttaaggaagcatcttgccaggagacacaaagctaacaagagtggagcctgcagctggagccgcagagcctaatcactacacccgcccatctctgctagggtttcatgacttcgtatcggggattagcagtatttaactctgttgcacaaacatttggtgtattattcaggtaacaagtagctaatagaggaagttttacttttttaagacataaatttgccttttcccaaattacttggtacatagtacttttcatgtttgaagttgagatgtgggtacaataccatagctttattccagagcagggtatttgtttccaaatgccatgttcccagcagctgcccttgactgggaattggggtgtgatttgggcttttccttaaatccttgaggagctggaggggtgggtggctcgcactcctgctttctggatctgaatcctgactctgtcatggacctgtttgactttgggcaagttgactcctattcctgagccccatatttttctcttctgtgaaattcagattaaaaaaacatggctttgatcaaacattataaataatatatagacagactgcttgtttttattgtattgccagaaatgaatcctactaatattgccatctatggacagaaaatgtattacctgtcttcatcaagacccagacgaggaagaacacgaaaagcggagattaattttactgccatctccagaaccgtcatcctaatatttacttacattttattattatttcaggctcatgcacatatacttagcatggatcattggccacagactcgcatacatttaactttattaccttttgcctcatgtatctcattaaaattttgctgcttaatcaaggatctgcatattattttaattttagaattcacagttccaagactttgaaagtttcaagcgttctgggtgaatgtgttatgctctctcccgccaccatgtctttataccccctgatttctcagccactatggc

SEQ ID NO: 2528 - DNA, 14254 bp, Homo sapiens
gcttggctaatggaagaagccaggggggctgtgtggaaagaatggaagagcccccagtgggcataacatacaccaaaaagagagggcaccgaccatctgtgttgacagagaaggacatccctcagtagccatcaccgaaaagcaggcacttcatgtctgccctgaaaccatcactatgaacaaagagctcatcaaagaaagggaatttttatagacaccctatagaggagtgattttgattcctaatctgtccattacggccccccgagaagtaggtataaaaagatgatatgcggccgggcgcggtgcctcctgcctgtaatcccagcactttgggaggctgaggcgggcggatcacaaggtcaggagattgagaccatcctggttaacacggtgaaaccccttctctactaaaaatacaaaaaattagccgggtgtggtgccaggtgcctgcagtcccagctactcgggaggctgaggcaggagcatggcatgaacctgggaggcagagattgcagtgagccaagatcgcaccactgcactccagcctgagcgacagagtgagactctgactcaaaaaaaaaaaaaaaaaaggtatgcagtgtggtccctgacagcaggtttgagctcccttgcaaggagaactccagcatttaatgcagaagaggcaagagtcaacttgggtgttcttccttcccagtcttagctctgagtgtagaaaatccaggtacattcctcccgaaatgctgttctggtgagtggatgcagagaggctgcccaccactgtgttatcacagatgccaccctggcatgagatgcaagggaagtagaggcagccatctggggatgggattactgggaagcccacaggcctcacaagccagaggcaccatggtttcttgacttggacgtggcctctcaaatgctggaggatgtccagcccacagcctttggtgatgctctcctggccttatttagaattcttaatgctggcaaacaacttttataaaattatccatttgtatttggatgcatacataaaaatatcctttatctgtatttggttaataaaactagtcttgctctgcctgtatttagcggtgccagctatcctggactctgtttgtgtgcctgtgtatgtgtgtgtgtgtttcattgtttctattccaatcatatcactaataaatgtctatgtataacaaactcatgcagaggagcagtgagcagattattatcctgcattctattgactccttatcacccctttccctgccctgctcaagcccctagatattgatgggtgtgactgagctaggccatcctctgctgttaggcaaaactgtgttcctgtgtgggcataccacgtcccaggagtcgacgactcacttttgccctgagggtccccagtgaggatgcacgtatgcctatggcaggcagggagagctgatgcctggttggcatgagcacctgaattagtgttggccacatatggatggccatgctggtgggcagaggcagaggtcagggggcacaagaagagtggaaaggagatcccagagaagaagcacatggagtgggaaaggcacgcttccaggttagggctggtctgcagacacacatgccccgtggttgggctggggagacgggttggggtggagagggaaatgggggtggggagtaacacgtgcaaaggtggaaatcatgaaccaggttttaagtcctttggctccgtgttatgtatacagaaggcacagagaaaagaatatgggaagttaagactgggctgtttgggtgggcaaggaaggagcttaccaaaaactgtcccaggagaccctctgagatggcccaagaccctcaaagaaagtggcccaccatcctcagctacctcttctctaactttcggtatcttacagctattcctgtatctccctaatctcaaatcacttcttgtgagagtttcctgccaatgatgtcagtaccgcttagatgtaggagcatatttctggacacagttccctgaataaagacttgggatagaaaattaatcctccccctaggagttcataaaactggggcaccgaggggactgatggctaaaaccaaagttgcagtgagcctggaagggaagcagccacttgggagggagccttaaactcgagtggggacggagacagtggccaaagatgttcacagccgtccttgaaagggatgaattaaagagaaggcatcaaggacagtaactcctttatcaaagcccatggctgggcctctctgatcagcccctgcctcctgacacacaaacacacacacatacacacactcacacacacagtctagaccacacctagccactgaagagtgctttaatccatgaaaacacactgagaaataactctggggaaacttgattgggaaggtaagcctgatgtgaaaaactgcaatcatgcatccaaagccaaaaagacatgatcttttgattatctgtgccactactctgattaatgattgttggccatcgcctctagattgacacctgcattatttttgtcccagcctggcttatctcctatcagtcaacgcatcacccacactcccaccagctgtactcaaggtggtcaggcacatgagaatgctttgggaaagatttacatcacgtgacctgtcatgtggcactacattagggctgcaggaccagctattgagcaaaggtatcaccccttccagcaatgagcttcaattttccaatccaaaagaagcagaaacaaatggctaaaaccaagtcagagatgataaccttgagtggctctgctgttttgatgtttacattttcccagaataaactgtataccattcagtatcaccacacagatcacacacgtggcgtggcctgggccctgtttactcaagcagtttcttcttcattgaaggagtccctcctgttcctttaggatttgtggatgacagtcctctgaaggaggtcaggtagatctatgcagatccttcctcccagtggcatcagctcagctactgcaccacagccttcaggcaggagtggaagcccccacaccaagcaacgtgtcctctctatcttcattacctccaaggtctgatgttactcaccctctcccacacctcacacactggaaaccagcatgatgcattagagagatgaagccttttagaatcaaacaaaatagaacaaaggttcaattctccagcacctagtagtgtctgacataaaataggtactgcataaacatcaatacaagatattctggctctgtcactcaccaacagtataattttgtgcaacatctggaagcctcaactttctcacctataaataaggaaagttgagaggcttaaagaagataatctttgtccgtgggttcagcagagggcctggcgtggagagcatggaagtgccttgaaaattggcatttctccagcatttattaacaaaaccataaaataatttaatgctatgccaactatataatgccaaacatttattacttactatgtgccaggcacttttctgagggcttaccatccattatcccttttaatcttcaaaatactatgtcgttggtaaatatcattattcccattttgcacgggcactaattccaagctttgagatggccagggcatgatgtggtcaggcagtagaagtaatgataaaaccagtagagcaggcaagacaagccctggctgcccatgagtctctagctgaacttcattgctaagttcacctttagccccagcaaccagggatgccaagtacacctttccccagaggactcagtcttgcaatgttctctccaaggtctggagaagtcaagaggaagggaaggaaaggaagaggcttccaggtcttagtgcctcatgccctaagattctatgattggtgccaggcctccgtagctctggatgtgcataggttagtgaaaccagcagagtggcagctggaaaggttcgattttgtgtgtctggccatcagctcctcctggactaagggctgtagatgtacacatttttctggcttgtcttattttccactggaaatccagatcccatcaatgctctaaagctggggagtctactgaagttactatgttcaaactttaaaacaaatacacttgaaacccctgggccttcactgtgaggaaacagctcttggatggtttggctactaatttttggctttttagcagtggctttaaataatgaggtgcccatggaaatgcaggggtggaggaggagcaatacagtgacaacaaaagagagaaatctgggaaaatgggaaactttcatgggagataagaaatcttaccgcccttattaggttttctgttctatcagggaggtctcctggctttaataaaatctcattttccctttaaactctcccatgtggtagggccttgtatttaatagggatatataagagaggattccaacctgaggctcaggtggccgggggctccccacactccagtccagcagctgggattgattgcagagctgccagtccagcaacacacaagttgctgcacatcagagagtaatcatgagccatttgatgctgacctgcacgaagtgaagatggcagcttggctcccgttcattcccatttggacagagaagctcatcctggtctttattaaaagtggaccaaaggagtaagtgatgagtcacaatatgtgattgattaggggcatctgcatttgaaagcctccgtggccttcatccatgcctaactccttaaggttcccattagcactgggagattgtgttcattaggagccgctgatgttgataaattcatctttcctgtcacatgcaattctatccagggtctggctctcagttctgaggggctgatccaccttgccttaataccacacgacaggctccttcacaaaacaagcagggtgtcaaaggctagctgttgggagatgccaggcctacaccagcaaaggctggagggaaggaaagggtgagcagctggtaattagaagctactggtgggtatcagaacgcatccatcagatgtctgcagagaggaacacacccagagtatctgtgggtcccaggagctggtgtaggttctgggctattctttcacgattgccaaagagtcaccacttgttgaaccctcgaatgctaacaacagtttctagctctaccaaactcctgttttgccagctttgcccccaagaaaacagaaaagtcatgactagcaaaatgaatcagtgtgaggcacttgcaccaacagagagcatataatttttatctagcaatttcactatcaactccaacaaattcactcttaaagccagaaaagcattccagctttctgcagggaaaatgtatgtgaggggtaagccacccagagtcagttacaactaccctgtctgctgtgggacaagctctctgtgtgttcttttcaaggtgtcagagaggtctgatggacaatgtgcacaagtctgtgtgtgagaagaccaagaaaggcgaggctgtccccgccctctgcattctcatcctggataacccaagctcatgttagtaaggcctctgaggctgatgtccccatttcatctatgtgcctttttccaagacagacactttagctgggattttgagtcctactagtagaggcttgggcaaggccagagtaggaaagaaacctggtggggcagagactgatcgggctttccaggcccacatggccagtgcttacacatcttccatgtcatcttggtccttccccttaactccatcccgcccccccccacgccccagccctcaaaacaatttgggacaacatcattaaattcacacaaacttcttccttaggatccagaaacccggttgtcccccaagaggtagaaaaggctcaagaataatgccacatggacttggctccccagccccagttccactcatcaaaagcaaataccatgtgcatgttctgtgtgtggcactggagacccaaagacaaactgttgatgttcctgccctaaagggtctcatgcagcactcagtaagaaagacaggcagttgattaaataaccacagcacagtgtgatccatgccaacatggacatgctagaggacccagtagcagtccaggaaagggagtgattctgtctacttggggaagaggaggacaggaaggacagatcaaaaaaggcttactgaaacaggtgacatctgatctgagaaagagctcctagagcagtcaaaatggtggggaagacactgtaggcagagctacatgtgttcagtcagcagggtgggaaacagcatggcatgtgggggaacaaagcacaagtggggactgccagcatgaagaactaagtgagggagagcttatgtggaatttagaaaggaaaaaggcaaataggagccaaggagagcaagaagcaatatttccttccactccagccagtcccttatgtgaacagaaaagagcagacagtagagtttgagtcccaacgccactggcatgaccttagaccaatgccttcacttcaagggtctcagcttccccatctgcaaatttggaacagccccacctgtagcatctgccccatggtgttgttgtgagaatcaaattttgataaggttcttgaagtgttgctactctgaagactgtggagagctttggcgatgtgaaaaggtctcatcaatcatcaccagggatcccagcattggccgagggactgtaccaactttgccgaaagtccttggagttcacatgctaaggggaaagcctctattgctccgcaaggcaaaggacccccagccgaggatacagggaagggaagaagaaatccatgtctctgctgctgctccatggaggagcaggatgctggggttcctgtgcccactgcatcccaattaagtatctgtttctcctcatttacacttggctcagctctccaaataccttcctttaaaggattgttttttaaaggcccttcaaactcagcaactataaacactgatgttaggcaaggcactttcagcaagaagcaaccataaggaaataaaattgctgctgttaaatctccactcccaggaagcgatttgctcagcaataaccatttctcaggagccctgatcaatcactgtttgggcaggagagaaggccttcccaggcctcctgatttctccaccctgcagtggaggcagcgcccaccacctttaattttatccagcaggccctgatggtggctttggcctggatttggaaccagaagaaattgtccctgtgactgtcctagaacggacacggggcagccatcactcctgcctggccccacctgcacccagtcctccttgatcctctctgtcttcccaggtcaaccttcggtgccaggcagggttaatcctctctctgcttttagcaggaggagccaaatcccacctatggcaatgtttgcttctggagaaacttatcttcctgcattgctctctcttcatcaaacatgaatgccagcaaaaactcctttcccaggctcacgaaatgtgtaaaaacaaagtacagaaaaagaaatcctacactagattccccagatgttttctatgaggcaattggatctctctttctctctgctagaaaaggctatttaggaaaagccagagaatacgagatgcttatgttatgaaatatcagcccagcagccttgtttactgggacccagttggaaaaaacccagattcccaagtaaataacttctctccttttcctagcaaaaattgctttaaatgatttcaatcctaaagataattttttccaagccaagtgacctttgcctcctttttatagcctcccctagaatggcctgtacagaatgtgtttccctgataagcccagagcttttccagacacagtcttctacaaactcaaatgaaaaagaaaaaaaaaaaaaaaagaaaacaaaacaaaacaaaagggagagctggaaggatcaactcctctgttcccctgtgcaggtaggaaaactgaggtgcaagatgtgacatcctctcccatctctgtggcacccacacatctgattgggcagcacagaagatggggtaccacagcctccccttctacaacatccctcatgggtccacaggagcccctctccccaccttgctgcttggagagaccatttgatttccttgtgcccctcagtggccaccagcaccaactcagtagataggttctgctgcctacttgcaaatccctttgctctccagaagatatctgtgagcaggaaggtatggccaggggtaacgagtgaaatgcagagacctggggctgaggagagaaaagagccaggatggatggcaggggagagtgctgtttctcacagcacagcctggcacaaaagaaaagaacagaaacacacacccacgttctactggaggccgcgagctgaaactgtggtatgggagaggcaatggatagggctttcaggagcaatcctccaacttctgctgacatagcactgttcccccaaatattggaagtgagggtaggaagagcaccctagaagttccatcacccaccccacccaaccatcacactctcctggtgaaaccatctatgctattccccaattatcttgtttctgtgagaaacacatatgttattctcaagagtcatgacggtacctggaagggagcactagctgtggcagcttggtgtttcatgctgcagaggtgattgttgctctgtgggccagaggtctagtgttctcaagtcgtggaaatagtgattcttcccgttgaaaacttaacacgtgctttagagaaaagagtaggagtatttaactcagagctccagcttctcaccacccctggcacatggctggcacatggtatgtcctgggtgattatttcttgagtcattggttgatgccaaagttctctactaggcaacaatccctagagattagaaaggcctaaagcaggctgtgtcctgggttgtcacctctcccctagcatgtcatagttctgaggattgtgcccatccctgaggtgttcttatgagctccttattccctaaaaactaccagacattccaagaagtttcatggatagcaggcatggcagatgattaacttcctcctgtcatttcacctaggtctgtgatctctcctgcgcaaaatgaggttcaaagaaagagaatgagaatgataatgattattgaaaagtccctcccacctctgatattctttgagctgctaagatttgaaatttcactcaatggtatcaggaggttctgctagttgagatttagtctacttcaaaccagtgacagccaagacaattctgaaatgggcactggatcttttttttttttttttttttgaaatggagtctcactctttgttgcccaggctggagtgcaatggcgcgatcttggctcactacaacctccgcctcccaggctcaagcattctcctgcctcagcctcctgagtagctgggattataggtgcacactaccacacccagctaatttttatattttttatggagatggggtttcaccatgttggccaaactggtctcgaactcctgacttcagatgatccgtccacctcagcctcccaaagtgctgggattacaggcatgagcaaccgtgctcggccagatcttttatttataacagatgccataacatttcatacaaaattccccatgattggagatattcaagtggaggcaggacaagtggctgggttgttgtgtgtgggcaagggtggctgtgtactatgggaatgggtacattagcatccaaagggtgattacaccaggcagtgtctcatgtccctcctcatgtgggagcctaccacgcaagggagaaccaggactaggttgatatgacctggcttttacaaaacccctggaggagggaaagaaatggaggcagcatgtcaaagccttgtctgagaagcattcctttctccaaagcatctgaggctctgccttacagatccccatggaccttgcattcctccatggaagcctttgttctctgtattgtgatctatttacaaataccttcctcctcagactgtgggctacttaagaacagggctgtgcttctactctttgattataatgtactctgagcaaccagcatagtggcaagagcatcatcaacatcagtcaaatgttgaaggaaagagtaaaagaatgaagaaataatcttgttcaaggttgcaaaccaccagggaagagccaatcttaaaacccaggattcccgaatctcacactatagctcttcacagtcactctgcaaatttcaaaaacaatgaaagataacatccaaactattaccctttttggtgtacacactgtctccagatttcaaggcttttgcagtagggaccagttatttaattatggtctggcctttactagtcaaaggtatgttcttgggcttcatatgttcttggacttgccaccaccgtcacccctcactgcccctgtacctcataatataacagtggcttaatataacagaggcagggctcaccacattttatatcagtgttggcttatttatggcttgagaattgcttgagatgctgaaactggccccatatgggattccaggagtagcagcagcccctccccttggggcttccgggaactacagataacttttttaatgaatcaaaataccaaagaactaaccctcccaacagttgttatccattgctcaactccctgtagagagcagcctgtggaatttgcagcattgtgatcgtgtgcaaagggcagcaccaggccctggtggtgataacaaggaggcatatttacccaacacttctcccccagggagactgtttttcctccactgcaatactgtggccctcttggctcaccctgcctggtccctgacatggctgtggaagcagatggatggaatcagagaacccgcccagacagaaggaccaaggcaccgagggagaagataatataatgtggcccttcatctcctggtgtgttcctaaagtatggatgattgccattctcaaagaatttcatgatcctgatttaaagaaacttgccaacattccaggaacccagaaaacagacagcagtcctccacagagaggcagaaaaagagacaggacgatttaaagtatcaggagcagggcctcacgggagtgagttcagattgtgcatggcaaagtcaaaacagatgatgctttagagcagtagtttccaaaccctatcacccaaagaacttgctaaagcaccgattgctggtccccaaaacagagcacctgcctcagtaactctgggtctatgtctatcaaattctcaggtgatactggtccaagagccacgccttagggggaaatggcattaatgccaactccagtaaattaggcaggataccaggaagaacttcccactgccaaggttaaacatgagaataagatcaggttactaaggacagttgtggaaatctcctgagctagagactcacgtttctgaaacggatctgaatctgttctgcttagctacaaggtaattttatctaccatggactataatcagtttcaatacaagattatggagtatctccaggattccaagcactctgctgggcactgttactggcaacaggtagcacttgcaaattgaggactggttggtttggttgtatccttgttatagatggggaaactgaggctcagagattcctgcaaggtctcacagctggcgtgaggcagagacaggactcaaactcacatctgcaatctgatcttgtcccttctagatatgaggtagggagcagaggtgcatagaacaatattttcctaaattgtacacttgagacagtgtcctacaagatataagataaaaaagaagtgattcaaaatgtcaaatggccaaataagtttgaagaaaacaaatgcaactgaagaatctgctagacttctcaggtattttaatatacttaagtgtgtagtgcatctctaagaggaggctatgtagtatttcttaaatttgaccagataatcttttatttaaaaacatctatttaaatttcaagtgacattccagttgcaaggaacacagtctggaaacatctggcatggatattaataaggcaaagaatttacacccctagcccgtgttctacttcacatacactcacacatttgggatgaatgcggagtgaatatcaggtgtgattcaaatcagattggaaaagaggattttccaagattctgcagcctttgcccagggctgaggctttaatggagagcgccaggagccccgagcagggtccagacaaagccaggtgccacagggcttggtgggcatcccctgcagcccacaatccctccagggcaggagccagaggcgtctggtcgtcatctgtgcacccccgcaggcttcctgatgtgagagacgattcccaccagaactgttagtcattccagtttctctcaatcaattattcacactcctgtttgcttgctttgagagagaggaggggggaaaacacagaaaaagccacagggcatgataaaatacaagggagaggggagaaaagaaagctggggacttttctgggctgagtatagggtagaccactagatgtgctttctaataggtcacctgcatttgtcctcttggacaaagcacacaggctgaggaggtctccttctttccctgaagcccagagaagaggaagcaggaagagggttaagagcacagccaattgcaggagtcagaaagacgcattccaggctccagcatgagcccttcatggttgtttgccttgcctgcttggataatatttgaccagctgaggggtgcagtgtagacacaaaaatcacagcccctgctgctgctgccttcaggctgtcatgcagcctactgaagtctcagtttctgccatggtaaaatgaggatggctgttcaagctcgcccggagggattcaagtgagatccaaatatgaggtccccgtggcagggacctcaaacctccaccagcctttcaccctaagcatgcacagtcaattttagtgaaaggatcaagatttttaaattgtcatgtgtagtattttgcaaatggctgctacatcatcagctcgttaataacagagagtactggcactggcatggtctgcaataattgttatcgctatcaaaatgatcagcaatgatacgctgccctttgtattcaaagacaatgctactaacacagtataacaagtgcttattttgcattgcacaattatatattgtctgagctaccaatatatttgagagagtatttgcagtatgtgtatgtgagtgcatatatatgtgtgggtgtgcatgtgtatatttatatatacatatataaacacacacaagtatatgcatacacaaatgtagttatatattatgttcatgaacttttttgcgtgtctatgtcttagtgtcttatccttatataggaatacaagttcttatgggcaacgattttcctttgtacttcttctgtatcatctttagttcaaagcagggtgcatcctttgtaggaaacccttaatacattcctgttggcagtcaggtttatcccagcagtggggaaaggctcatattgatccctccatccatgctccctctctctgaagcccactcatggcatgtgttgtgagatggccaagccaccaagcaaaccatacagcccacttgaaaaaagaccccctcgagaaaagaccccctcactgctgagttaattagctggctggctgcacacaccaggattggacatggatatttcaaagcatcttcaccctcagacttaaatgctacctaaagcattccctgggattctatttttcaaaatttattttttccaaagtaaaagtaataaatgctcattaaagaaaattaagaaaaaatgtaaataaatagaaaacaataaataaaccacacctcatcccattttccaagcacaactactgttagcattttgatggttctctttccagtttttattttattcattgtatcatgctttctaattgtctcatgctttttcactgaatgttatcacacaagaatcagttacaagattggcctttataaactaagttttcaatgactacataaatataccaaatctacctaaccattctcctataaatgagtgtatatatcaattccaatttttgatagactaaataaatgctgaaatgtgtatcttggtgattattacccttgaa

SEQ ID NO: 2529 - DNA, 15521 bp, Homo sapiens
acgttctcagtcactggaagtgctctttaactgggagcaaaatattagcaaagatgcccccagacttgctttcagctgcccctcatcccagctcctgcctaagaaaattctggaagactgaaagaagccatgcttgtcttccaagtctgagaaacccttggcagccttagcattggcctgtcctatgcctcagtttccccacttgtgatgtagttactccagcagaaaatccatcaacaagcaaataactgaaaatgaggacaggacatcccaaaacctcaggtgggaggctttgcctcatctcccatgcctttgcctccccatctcctatgggctgactacagagacttccctcctccactccctgcccaggtcctgaactaatcctgagacaggaagcttgtacgttggctcagtttctttctccccactataaagttttcttccttggttccaactcctaaatccaaaaatggatactaagcaggagtttcctggcctctgtcagtcctagagtttgcccacagccccacagtcagctaggctccactgtcttccacagcagtgcttcctgacagcttttgaccagggcccaggctgaagcctgggctctcatccacccctagggtctgtgctgccacaacggagcctccactcctagcgcacagcctcctccctacacagctgtgtgtgcaagagagactgtggtttggtttccccatatctgtccctctatcacgggcagctctcatgccaggcacagccctgtgcccatccctgcttaccccatgaggtcatgagcagatcaacacacatcatagcgggtttaggcctaggatggttggaagactaagtgagacaatctcagtaaaactcctatacaagaaaatgccagggccgggcatggtggctcacgcctgtaatcccagcactttgggaggctgaggcaggcagatcacttgaggtcaggagttcgagaccagcctggccaacatggtgaaaccccgtgtctactaaaaatacaaaaattaactgggcgtgatggtgtgtgcctgtaatcccagctactctggaggctaaggcaggagaatcacttgaacccgggtggcagagattgcagtgagctgagattgcaccactgcactccagcctgggtgacagagcaagactctgtctcaaaaaacagaaaaaagaaaaaaaaatgccgaccatttgtacccatggtttctggtctatcacatcttcactctcttttaccctttttaccctgatcacatgaaataaaaatatatatatatattaatggtaaggaagcatcttgagcttagagggagcaagacatgctctggtgtgtgtctagccagaatgtcttagcccgtggggacaaatgctcactgacattcaacgtacaaagagcaatgactctgagccccagcctgcttaatcacaggacatcttatcttttcaagtctccagatattcctaaggtcctcaggaattacacccacgtgtccagcacttcccagttccagtgggcacccctcgcatggtgctctaggggttggcatcccagagcagcaactctgcagcatctgggttatatcaaagttcaccatccaaggatggactgagaacacccatcacggtgctgagcttataacccaggccagtgggcccagaatagcttctctgtctgagattcagtgctgatccatcctccatatcctgggtgcccagatccagggcttctcatttaaaagggacagtgataactcttccagtccttaggcctttgtgctaatttttctatagcagggtagtctgtgcctcagtttccacttccagcccaaagggaagatcaaacctcatgctcttgcgtcctctgtttctattttcctgaaagcagctcccaacctccccaaactctcaccatcatgaccatgtatacactgacatcattgtgtgtataagaaaaagcaagaattcaggcaaagtaaaatataatatttgccactcagcttgtccctcattcactgaagccctgccaagaaccatgcgcccccacaatcaccagtagtaaaatgttcctaaaaagaacatttatctttccaggctttacctctgcgttgagtcaacactgccgcctcccacccctacctggttccccagcgtgggtggaactgaaggggccattcagggggtcttgcagaacaaaggattaatcttctccaaaataatgttaaagttttcatctatagctaggaaacaaatgcaagcaattttccaatgataaatttcctggcttctacactcaaattgtaaaagtcttaaagccatggcacccacttccatgtgacacttgtaaatttccagaccatgatgagagtcatgggtagaaagggcaccacagaggagactcaagctccagccccagccctttctctaactggcttcgggtaagaacactgtccaggttcctcatctgtgagtcgaggggattcagctagatttctaaggattgcagagctccaatattctagcgttgcgctatcattcatgataagtaattataactaagacaggatttggccttgacaccagcatctgaagcatacatgagatatctctgttattctttcccaaagcagaaatggtgctctgttcttgcagaggatcaggaagagatggcagtgagccaacagatgttcctggagtatctactgcatgccagaccacgtgctgggtgctggggtacacagtgaccagagaagacatgatcagcatagaactgacaaccaaagaagttatggctttcagggatctttcaattggtaggagaaacttacactaaataaatgcatatagccataggttacggaatgcatcgcatccccctcaaattaatttgttgaggccctaagcccaatgtgactgtatttggagatagggcctttggggaggtaattaaggttaaatgaggtcatatgactggtgtccttataagaataggaagaaagaccagagcttgctatctctgcatgtacaaagaaaaggggttatgagagcacacagagaaaaggcagccatctgcaagcaagaaagagagctgtcaccagaaaccacatatgctggcaccttgatcgtgaacttatggtttccaaaagtatgagaaaaatcaatgtttttcagttacccaatctgcagtattttgttatggcagcccaagctgaccaatacaccatgtttcatcaaatccaggacactattgaccttgtgacacaccattgtcttatgtctactgaaaaaaaaaaaaggggggggccctgccaattaaacacaattacttcttatcacttagaactcttacacttattgaaaaactcttttagaatcatttagttttgtgttgctcttatacaggcaaaaaggggaataaaagcaaaataaattaattacactgtccctaaaacttcttattcagtgtcaaaggcttctgaatcactttccaactcagacttgaaaatggcaccacggatggatgatggatgaggctgtattttctaaaagtttgctccactattgcttccaagactttcttccaagttcttgacattcatcatacaaacggatgttgatgcttccatgcttgcctgtgatacacaattcttgcacactaatgtaactgtaacatagcttgatctccttgtggactctttctttctttgtccttatattaatctgctcaggctgccataacaaaatgccacagcctgggtggcttaaacaacagagctttattttgtcacaattctggggaatgaagttcaagatcaaggtacaggcagctttggtttctcctgaggcctctctccttggcttgcaaatgaccaccttcctgctgcatccttacatggcctttcctctgtgctcacacatcccttgtgtctcttgttgcaaggacaccagtcatgttggatgagggctctatccatatgaccttatttaaccttaattacctccctcaaaggccctcttttcaaatacagtcacattgggggttagagctccaacatgtgactttaagggggacacaattcaggctacaacagtcttgtaaagcattttgttgtcactttgcaagagaatagtgatcttatctttcgaataataaaaaatttgctttgcttgctagcatcaaattgataccctgctattccgttttctttctatataaactttttgtttcggtaccaaattagagtgatattgttttttaagaggtattctaaatataaactaaaccccagatatgcaatgtcaatcatgcacctaactccactggagggacgacaacataagtacccatgaccaagtctgtgcatgctcagacaatgatcacagcagtcaatgtggctgtccagcccacagcatcataagatagcatttaaaagtgagacacatccccctttcagaaatgttaaatgtggggaaatgtgtgtgtgttttagatgaaatatggtaaaataaataaataaataaattaggatatccatgtaattcttgtgcagtttgagtttttaataaatttgcttctatataatatataagcaaattgcaaagtgtgacagaaaatgaatttactgaagatttcaatgacatttttaatgatttatttgttctaatttctttctttaattttctaggtaataaacccttctgtatacagaatggttctatccaaatatatctaaaatgatgctggatatgtcgaaagccaacatttctgtaattaaatatagtaaattatgattaaatttcctctattttccatctagcagtttgtattacagaaataaatgtattaaaattcctaacagcatacaaaccttagggtaaccctgtatagtattaagtgattgattacaagtctacagaatgctgggatgaacagggttgcccttaagaaagaatttctcaagctgagacccagaaggtgagttaggagtcagccagggagaagggatattccaaggagaaggaacagcatgcacaggggcctggagagagaaactagggaggaggcagacagacttgaagttgagggcgagggaggggggaacgacagggcacagagcagagatacaggcagaggccttcctgggcccacctcaccacttctaggcacatcccagagtgcaagaaggttgctcactgcttcagtttttataacagcaaaagattacaaacaatctcaacgtttcatccataaggggctggttaaagaaactacggttcacccaaacagaaatttttagaaagttccaaaaaaaaccaacatggaactctttattgctatgcagtgatctccaagacaaattaagtgctagatgcaaaaggtgctagatagaaagtgctggatgcaaaacagtgagtatgatacgatataatttgtgttaaaaaattaatttacacatgcttatatgtgctagactatttcttgaaggatacacaagaaattaaaagggctggttacctccagagaagggtattaggtggctggggatggggtgggagggagaatttcaatggtctgccattgaatcttttcagacctgcaggaggaggagggggaagaagaaagatgttttaagtggaagggcagctcatgtaagactgtggctctgtttgtgggaaggcttgcatgtggacaggtaatgatgaagctcctccatgttccttcagcttcctgcaggatcctgtctgtctggtattgtttttctgctgtttcacacagagatgctctttgagaaagatcataaactcctcaagggcaggaatcttcaagtgcaagttcagagcccccacagtgcctaacacacacgtgaaacacagcaaagttgtcttaattccagccgccaggtgtgctgactcacttgaccccccagcccccaccccacacgaagcagcctctagagtctgccccaaacccaaatgctgcataatcaagctggaggaattccctcctcctagaaattccagcccagtctcagaggccgcattagaactgctctttgtggttaaaatgactttcacaggcaccaaggggaagggtttccaaactgagggttcacaatccaccagtaagttgtgaaatcaatttggtgatccaacaagccttttttaaaaagaatgagggcctggcgaggtggatcacacctgtaattccaggactttgagaggccaaggtgaagattgtttgaggacaggagttcaagaccagtctcagcaacacagcaagaccccatctctataaaaaaattttaaaaaattacccaggtgtaatggcccatgcttatagttcctgatactggggaggctgaggcagaaggatcgcttgagcccaggagtttgaggctgcagtgatctaagatcgcaccactacactccagcctgggtgaaaggagaccctgtctcttaaaaaaaaagaatggaaattttcaaaagtcagaatatatcacacactagtaaaaataagtattattttgtgaaaatgtttaatttcaaatatgtgtgtggatagtgggtcatcggtaaaatatatttattaccgtgggttgcagccaaaagtgtttgaaaggcagtggcctagaggagtgagtgagcaaatggctccagagttgagcaaagcttagttcaaaccccacatctatgattttgtctccctggcaggtgacttaacctcctctcatggtacaatggagacagtagcaacgcccacctcatgggacggttgcaaggtgcttaggcttagcttgaaatcttggcttaacacttgataaatggttagcactcaagaaacattcattatcactatcacaaccaagaaatatgcccttcgtcttgctcaagaatctctggcaccaaagcaaacaatagacttggtcgtggcctgtgttcctggctgccccatggctcttctgcctggcagcttctgcccagtgtcctccttctcactccacagggagcaattggctccacagcttcctgcctcttcaccatcaaaggggctgggtgaccagaaaggcgcatttcaattcaggggagaacattactttactctaataggacatttgctatcccagccccctttcagcattggttccagggaaatagatggtcccagccactgtaattccttcgtgatatatttaaagaggaagatgatgaaggaaataatggcagtcgatctgtggttggaaagaatatatgatgtgcatgccccgtccaaaattaatgatgaatcaatatctgagaggcagagaaagtgctttattaggacctttgacaaaaaggacaattaggaccttgagacaaaaatctcaaggcccacctccctctctctctcatacttcccaaaccaactgccaaccctgtgtgcccagctcaggtacaggtcaagagagatgggcacagctgaaagcctgagggtattggagagaccaacagatgtttcccctcgggttaggaccacacccagtggctctgggtcaggaagcactgggatgccttctcaggtgtgtcagcttagtttgcagagctgagtgtgggccacaggggcgagccacctgttactaacgatgcccattaagaacctacaatgtaaccagatgtcaagtttcatgcagccgcttcctttgccctcatttcatggtcccagtctgatatggtttggctctgtgtccccacccaaatatcatcttgaattgtaatcctcataatcctcacatatcgagggaggagcctggtgggaggtgattggatcgtgggagcagttttccgcatgctgttctcatgacagtgagttcttatgagacttgatggttttacaagtgtttgacagctcctccttcacgtgcgctgtctctcctgctgccttgtgaagaaggtgccagcttccctttctgccatgattgtaagtttcctgaggcctccccagccatatggaactgtgagtcaattaaacctcttttcattataaattacccagtcttggttgtttctttatagcagtgtgaaaatggactaatatacagtttctgtaagaatactgggagaggatcttaggcagctgtggctgctatggcccactggtaggggctcatcttatgagtaaagaaattcagatgtagagttgttgaatgcataaaactagactggaactaggacccaattcccaagctgctgccggttccacagtctcacagacacaagttgggaagagcacaaagtgatgggcacacgtaaggtggcattaccatcaagggaagcgaaagcagtaagagctagaatgattggtcagagcagtgaggaagagaacaggactgtaaagagagaggagccagagacaggcttgattagaaactcaggactgaatttggtgcttgagccagtaccttaaattccaaggtcagaaggctttgtgtggatctgaggggtcatggacatttgcattcctgctgcttgccgccccagcagctggcctgatttccatttctaacagtggcacttgctgtggaggtacagtatattatggactaattaaggctgttaatgatagtggcaatccattaagtgatctacggtattattctgatctttctctgtcacctcctttcatcaggccattaaggtgacaagcttcatagaacacactaatctcccctctgtcagtcccttggtgtttttttccctggaagagctacggactctctcgggatgagtcatccgaggatacagctgaagggctggactcaccaagctcctcctccaccctcagtctcttccactcagaacacctgggctcatgggaagtctcttttgtattccctccctgttatggactgaatgtttctggctccctaaatttcctatgttgaatccctaatctccgatgtggtggtatttggagatggggcctttggtagctgtttaggtttagatacggtcatgacagcagggtcccagtgatggaattagtgtccttatgagaagaggaagagagaccagagtgctctctctgccctgtgaggacacagtgaggatggtggccatgtgcaagccagcaagagggccctcaccaggaaccaatcctactgataccttgctcttggccttcctagcccccagaactttgggaaatcaatgcctgttgtttaggccactcagtctgagccctactggtgggctcatcttatgaaagaggatatttgagatgtagagttgttgaatgcatgaaactaggctggaactaggacccaattcccaagccactgccagttccacagtctcacagacacacggccacacatacgaacacacactgtcatacactcacaaacacatgctatcatatacacacacatgcattcacacgtacaccaacatacacacacatgcagtcacacacatatacaaacacacgctgtcatacactcacaaatacccacatgctatcatatacacacatacactcacacatacaccaacatacacacatacacgcagtcacacacatatacattcacaaacacatgctgtcatacattcacaaacacccacatgctatcatatacacgcatatacactcacacatacactgacttacacacatgcagtcacacatatatatacattcacaaacccacagtcatacattcacaaacacccacatgctatcatatacacacatatacactcacacatacactgacatacacacagacatgcagtcacacatatatatacattcacaaacccacactgtcatacattcacaaacacccacatgctatcatatacacacatatacactcacacatacactgacatacacacacacatgcagtcatgcacatatacactctcaagcacacactgtcatacaatcacactatcatacacatatgcactcacacacttacatacacagtcacacatatactcacatgtatattcatgaacacacacttccatacactcaaaaacacatgctatcatatacacacgtacactcacatactcacacatatgcagtcacacacatgcatatacattcacaaacacatgctgttatccactcacaaacacccacatgctatcatacacacatacacactcatacactcacatacacacagtcacacatatactcacatacacactcacaaacacacacagtcacaatatactcacatacattcacacaagcaattacacacatacatatacactcacaaacactatcatatacacacatatacacacacagtcacacacatacacatacactcaaaatatacactcataaacacacactatcatatacacacatacactcacacacatccacattcttccatatatactcacgaacacacactgtcatacactcacactcatacacttacatacacattcacacacagtcacatatatactcacataaacactcatgaacacacagtcatatacccacaaacacacatatactcacacacacacagtcatatatatactcacatatacactcatgcacacacacaaactcacaaactcagtgtcatatacacatatacacacatatgcactcacacatacactcacgtacacacacacttatgcatacattcagtcacacatatactcatgtacactgtgtcacacacacatatgcatacacttacacactcacacatcgtgtatgtccttctaagcacagaaacgctttccatttccaacagtatcaataattcctgattactgagactagtgacttacagaaccttccctttttccaactcttaccaatttttcagtgacataaaatatagaatttggccatttcccatggggcttcagccaagggacatcactaagagctgtatctcagctttcctctgccttcacactctcaacagtaatgctgctcagtatccccagtgatccctaatgagggggctcctccgcccaatgctttttaccttttcggggtaattaaagcagaagcattcaaggtttcagtccccatgttccctcctcaatccagctccagaggggaaatactggtctgattgggctgtgtcccaaaacgctgggccacgctactagtgggcaagatctccatgcattaaggtctccatgtggtctgcatctcatgattagactggggttctggaatgcattgaaactcatctcacaattagactggggttctggaatgcataaccccagtctaatcatgagaatccaccagacagacccaaattgagggggattctacaaaatacacgacccgcactcttctaaggtgtcaaggtcatgaaaaacaagactggaaaaccaacacagactggaggagactaagaagacctgacaactaaatgccatgtgggaccctggaggggacccgggaacagtagtagaagagctggtgacatctgaatgaagtctgtaatttgggtaacagtactgtaccaatgttaatttccctgctctgccaatgcgatgaggggtatgtaaaaggttaacattaggggaggctggtgaagaatacataggaactgtctactgtcttgacaacttttctgtatatctaaagttccttccaactaaaacatttaactacaaaaaaaaaaaaaaaaaaaaaaaaaaaaaaaaaaagccaggcctagcctatattacaatgttcactgagaacatgctgctagcacagacctggtggtgagttgctcagggaacgtatgcactgtagtcatgcacttgctggtactgtttattaggtgcagacatcccagataagagctgagttacaagcatccaaatcaatgacattttaataaatagtttacatatatatatatgcacacatgcacacacacagatggcaataagagatttagtctaagatctgtgcaaaaacgagtttgcctagcaaaacaaattaacatgttgggttttaaactgttgatatttggcatataaaccattggagttttgttttttctattacaaccataaaaatagtttttggataaaattcgaatcacttctgcagagagaaaagacctgggtcccacagaacagttagagaatcactaatgcagtccttttattttatagatgggagtccagacaggcttaaccaaggtcacatagcaagttaggatgagaacctaggtctcctggtttctggttctgagctctctgaacctgatgagtgaaggacagctccagcaatggagcctgaatccccagacagcctggtacatcactgcaaaacaggcaaggccaggttggctggggcagccgagagcacacggtcccatagctcatgcagatagggctggtcaggaagaacacaatggcaactctgaagagcgagtgtcaggcagcagctctctaaggaggccaccacagtccgcaggagggattggatgggggatagggtgtgaggcagctggtgagtgaaagaccacctccaagagcatggaagaaaactccaggtctctgcaagagaagggaacagaagtgccaacacctgggtccagctgctctattgagctgcctttgttgaaggactgagttgaacagcagatcttgccgaggctgccgcttcctgccattcacactgtcccagagaaaccttccctgagcatcatgcagttttcctttctagataactgttattcataggtaagattatctggctcatttgtttagctgtttagtgtctgctttcccccattcaaacgtcagcaacttgtctgttttgttcaaggctgaatcccagcccatagaatagtgcttggcacatagtaggcactcaataaatagctattgtatagatgagtaaatggactcttcccatacccgatgtgtctctgaccttgtatttttctacatcagagctattcctagatgcatctcagagtctgtttgtcaagaagcagaggctttgatggaaaagcactttgctgagaacatctcaggcagcgtttttcttctgcttcattttctcttcctaatgtgtgacaggacggcaccactggctgcaagccatcctgagaccatgctgcttccctcccaggactgtcacatccaccgcatctggtttacaagccaaacactgatatcctgtccttgggtaaaccccaacattcctgtcagatggtttcactgtcttaggaattcagtacttagaaggatattgaaagtatagcccaaggctaaatgagacttggaatttccttaattgaattggggacttcagcaccacagacagatgtttttggcatagtctacttgatgcagccctcataaacaagcatcacacacaaactgtcagagttctaagtccctgctacttatgaccttggacacgagtactgccatctttcctccagattaagaatgaaagaaagacactcaagaataacgaactaagggacttgccttaccagatttcaagatttattaggtagacccatattcttgatacagaagtggcttttgggtcactggggataggattaatttaaataaatggtgccaagacaattgtctatccacacaaagatattccactggatatcccaatgggatatccagggaaatgtgtgaatcactattcttatctcacataaaaataaattccaggtgcactgaagacttaaatacaaaaagcaaaaaactttaaaacatttagaagataagaaaggagagtatttttacaaactcaaaatcaaaaagggacacaaaaagaaaagattgatacatgtcgactactctaaaatcaagaacttccattcaaaaagaaagaagaattttgaggtatcaaaagataccattaaataagtgaatagcaactggagaaaacattgaaaggatatttaatcacccaaggattattatctagaacacagaaataattcttaaaagtcaaagaaaagacaaaacccaaaagaaaaagagcaaaaggcatgagaaaggatgccactaaagagaggaaatatgaaaaacaaaattaaagagaggaaatatgaagagaagttcaatttcattaatagtcaagagaatataaattagaagcacaatatcatactcaccatattggcaaaaattaagaaactcgagaataacaagtggtggtgaggatgtggagacatgggaattcttatgtcagaagtataattattttgtcaggagtatattcaggcattttcgaaaataatatggaaacaccttgaaagttaaaattgcacctaccgtagggtgagtgattccactccaggtacacatcctacagaaattcttacacatgtgtacccagagacatatgcaagatatccacaaccataatgttcccattaaaagcctgaaacaacctacatgcccatcagtgaaagagtgcctactaagtctggtatcttcacataatggaaaattaggtagcagtgaaaagtaaatgtaaatatagacacaaggataatcttagaaacataatgttgaatagaaagcaagtttcaaaggactaccatcaatatgtcttttttaaactcaaaatcaagcagaatgaaacaacatattgcttaataattcacacagatgaggaggtgaaactatactttaaaagttcagggaatgataagcataaaattcaaaatagtggttatttttatggaagagcagggccgtggagtctgttggaggaggagaatgcagagagcatctatcttattggtaaaactctgatttttaatttgggtggtggcttcagcagtgtgtgtttcattagtatgctttatttgttaccttgttatatagactctacatatatttattaatacacttattaaatatatatactaaaatttaaaatactaagaaagaatgtgagggaaagccatctctggtcccaaatcttattatcttccctgaaatacacttgccctttgggggcatgttgagattgattaaggccagataaattcaaattgtaaaatcattgttattcattcatttaacaaaaattatggagcatctaccatgtgcctgccctgaggactggtcactgagcaggacaaacttggctcttgctctcacttcgacagagctaagactctaggagctaacctgagtcctggagaatgtctcctttcttcacttcctcttgggcaagcaatctccatttccttccccacagtgctgctgtcttctgaaaagaagcagtggacaagggataagaacctgtcttgggaggagccaatctcttctggggtctagaatctgcctctcaaacaaatctcactttgtaattagactttctttggccactagactgtcccccaatatggtttggctgtgtcccaacccaaatctcattctgaattgtagctcccacaattcccacatgtcatgggagggacccagtgggaggtaactcaatcttgggggcggatctttcc

SEQ ID NO: 2530 - DNA, 22703 bp, Homo sapiens
tgctctggaacatggaagagtcacttcaccttcagaaagctcatttgctcatctgtaaagtgggcaattccataggtggttgtgatgataaaatgaaaaaaaagttcttaacttatatgagtgacatgctgtatagtaagttacatgcctatataggaagcacacagaaatgattcactgttatgataatggaaggacagtggtttggcatgttaagcactaaacagaagccagaaagatatcttagagaagtagacaaagaaatctatagttcagaatgaacagtaccaagaatgacatgtcccccaaattgagcatgggtagctggatctgaacctatcctacacatctgagtctacagtatgaggtaacagtcttcacctatagctatctcctctgcctgtaaggtcattcctttttgaagaaagctgacctcagactatactgtgatcgcttaaggaagagcacaaaatactggagaaggctagtcttcaagctctagatacagaaaatcctcaattcttgggtgttacctttcagaaaaagagtccgagctacaagccctgatccaaaaatccctttttccaaaaaaattctccatcttctaccaaggttcacctccctgtttagtgtacactggtgtctatagttgctagagcaagagtctctccttatcctctaaggcaggagttctgtgaagaccccatgacaaggggacaaaatgaaataacatgttcagggacaacacagcaaaaccccatattatcaatgctctaaaacctagctacctcaggcttggccagttattcatgagcagagaggtgtgtcatctacatggcagtcatggcctggatgggtctggaactgtggcaaggtaaggctctgagaaaaggtgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacacttcacaatgctctccatggcttctgttggccttatggtcagctctgccaagatctgtattcttgggcaagacagaatccttctgaatctcagtctcttcctctataaatggaaataattttgctccacacaagtcaccattagcacgttggtgggaagttaaactgcgaaactcagcataaacaaagagcaatgtaccactgttgcttacgtgaaaactcccgtgaagcagtcaggcaccatgcaccatctaagcatagcagcgttaggtatcagcctattagtgattagagagggtaccggggagagagggggcctcagagcagtgggtctcctggctgtggggaagctgcctcagtggccatgccaggagctgaacctgaaggtactctgtgtgtcctctcaacaccatggaccctattttggtatttttttccagttacctctggtttccatttgcttcctccctctagccccctggccatgtccgatttctccagcaagtttctgagcttttctcattttgctcactgtctccagaacatccctgcttcttttacctttcaaagaattcaaacttgaactctgctcactcctgcccatcaccaacattagctcagagttgatgagaagggaaagcaccctcataaggaagcccctcctttccttacattattagacctgagcgcagacagcatctccatctccacactgctctggccaggttatgcctcagtcaattacacgactgtatcttagtacccttggtagggctcaaatcaggatattctctagaaagattcacttagtactgagccaagtataatctcactacatctaaaatagaaaattctagacccacccctccacatctttgttattgaacccaatatgtcacccatttaccatgtgctcaaatccctacctactgctgattctcagatcaaatcataacccagatttaccatggtccaaactctgacatgtgatcaggggcatgtcattctggttcaggctgtcagccccaagcaggtgggtcagtttcaatcaccctgagtgcaggttgcaagggcaaccatgaggctgcataaaaagaacctatgacaggatgcacatgagagacaaatgtcttcacattgaagaaggggaggagtgcgccattggttttccatcctccagatgcactgagtaagctcctacctaacctgtgccccctccttcttctcatccctatgccgtggtaggagggagagccatcttcaagcccagcatcctatggaatgctgagtctctcttctccttaccccttaatgttggaattctcattccccaaagccttggatttgactttcccactgagtgactggagagaagcatcttcatattcacaggaacaagccttagttagataagactttgctcctctcctgggagctccaggacactaaaaagccaagcttgctaccaacgcttgcccttccttaagtacattaaatataaccccaatagtaaaatatattcctaaacagccaggccattctccctccttctaaccctcatctcctcggcctaagaaagcccagctgtgtgatctggggcttggcttcccctgtctttcccatatcagcatccttccaggaaacagccggtctccctctctgctctcagaaggcaagtttccttatcacctgtgaatcacaaacccacagagtggccaaacatactgatgcaagaccataggaaggggaaagctgcaggtgtgtttgtgctgggaggagcagtgaccctcacctcacagacacctcctctccccatcctcgggaggtataaagacgggttctccaccagcaatcaggcacactctaccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctgaggaggctgaaaaattactcatgccagagactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcgatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttctcccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcactgtctgtgtctgtgcctcctccttcacactccttcacattggaaagcatcctccaacctcaggtcagacagggctctcccccttaaacataagcagagcctccagctcccaaatgtgttccatggtacactagattaacacatacaaagaggtggaatccaaaaataagaagcttgggagaaaggggggcactgttttctagagaaacgtgtgtttcagaaaggtggtcttcggcaggggctattgttttatttgggcttctcagagtggttagagctactctgccttcagaacaatcacagtacagaaaatgtgtcagcatcttcgaggtggcccaaaatatttgaccagctgaaacttcttgctaaaatacaacaataattacaaatgctgctggtgatgacgtgactctcccaggaatgtgttggcaccaaaccctcgaccaagccctcccttctcattcacctggaaaatcagactcaaataaatcttcctggccctccgactcttcccttaattccctagttccatctctgtgagcaggctagagagatgttccacctaccacagcgggagccagactgcgacttgggaatcaagcccagctcttcatgctgcatttttatcttctttgcctttggggtaggatgccacagtgaatcccacagctaacaccagctcctcactctgaccagggaaagaaactacagagggtcaggattcacccatttgatcaattaactgaggaaggattcattttcataaaacttgcttgactttgagacacttcaagtgagttatttgggattctttaaaaaaggtggaaggaaagatctgaggactgtgacacaaccagccactctgaccacacattgactggcttgcacccactggacacagcagagggaggcaggcttcatggcacttgcggcacctgccaaagcctccttctggcaattctgagagggcctaagttggggccgtagctcatccaagcttgtcacccaagatccaagcaagcttctctttgaaattccaccttcaccttctgtcccaagtggttgtggacatccctgggagctggcgctaagggccaggagcagccaagggagacagacaagttcagagcacatttccagttacagggaacagagcacaggcctccaagtgtccatggagcagcgtgcaaattgcagggatgagtagagtaaaacctctacatgcagcacagcattcctggcaaacacaggggaccacagtacacatgctgtggaatacacccaagtatgcatcagacacttgtttggtaaacagtaaatgtgtaagatcaattaccttgagagggccatctgtgctccagacatgtggtttgtgtgaggagacggctaccactcactatcttcagaggaaaacagggctcagggcttgcacacaatggacagatacacatgggtcacccaaaatgtcactgcatacaaacatcactttgttcaacatggattttgtttttatggagtccaaatgcagaccctagttcaccttacagccttgggtttgtctgctttgggagatatatatccagttgatagacagacaagacagatacatttttttccctttcttaccacaatgtcaatgcctcatctgaatatcatcattactcaagagtcaagagaagaaccaaacgcttcatataaacagggctgggctgggctagatggggagtgttagtttccagtgttttctgtctccattcagatcattcctatcaaagcccagctggtcacctcaagccaagacacagacataaggatcccaatggccttccagatggctgcttccacctcccattttggccacgtagactctttacacaggaaagtgagtcaccccagtgagaagggttgccagcggaaatagggcatgaaaatcacagataaccatgggatttcttccaagtggtcagtgtaaaataaaccaccaccaccaccaccgaaaacacaaaagaagcaaaaaaagtgcttattcaaaatccaagacaaaatactgtgtgagagtcaggccacggggttgccttttctcaggccacacagctttcccagtccgtttgctcgcatggaaccgtaagatgtgaaggcctgcagagcgtgtgcttgggatggaggctggtactgttcacctgtgggtccagaccaaagggcaaagaggcagaaaactgcaactctgtccaccggcacagcttaggcccttctgctcatagaggctctgaagaacccccacctcagccttcacacatatccttctggctgaactacagccaggctggagtgccatggcatgatctctgctcactacaacctccgcctccagggttcaagtgattcagcctcccaagtagctggaattacaggcacccaccactgtgcccagctaatttattttttattttatttatttatttatttatttatttatttatttatttatttatttattttgtatttttagcagagacagggtttcaccatgttggccagactggttttgaactcctgacctcaagtgatccaaagtgctgggattacaggcgtgagctaccgctcctggctcagaccccatttttaaaaaatattttcaacatttattttagattcatggggtacatgtgcagatttgttacatgggtatattgtgtgatgctgaggtctggggcacaaatgatctcctcactcaggcagtgaccatagtacccaataggtatttttttagctctatccaccctccttctctcttccctctagtagttgcagtgtctagtcttcccatctttatatccatgtgtacccaatgctcagctcccacttatacatgagaacgtgatatttggttttctgttcttatgttaatttgcttatgattatggtctccagctccatccatgttgctgtaaaggacatgatttcattcttttcatggctgcatagtattccatggtgtatatgtaccacatttccttcatccagtctaccgctgatggccacctaggttcattccatggctttgctactgtgaatagtgatgtgatggacatgtgagagcatgtgtctttttggcagaacaattattttcctttgggtaaatgcccagtaatggaattgctgggtgggaatcgtagttctgttttaaattatttcagaaatctccaaactgctttctgcattaatttttccatgaactcatttacactctgaccaacagtgtataggtgttccatttcctctgcagcctcaccagcatcttctgtttttgacattttaataatagccactctgcagccaagctctttcaaggccaatgtggagaagagccacaaacattccttttcccgaagagaattcttgcctgcccactggtagatttcttggtttcatctgtctttcattgtttgtttttcaaagaaaaaccaaaggtaaagtgataatgatcttccacacctgaaccagtttgtagccaccagagcctgctgggaaggggcccctcaagcatgcattgatcttgtgacctggaatttgagagatcaataagccccgtagcaacctaccatacaactgcccatcagcgctgatcctttcatgggattagctcaattctggctctgcagacactggcagccacagttgacaaaccctgggcctctgtgggcttcctttgtcacccagggccacagtgggctgcctgtcctaggcagagacgcagcaacattctcttaaactgaaattaagcataaatccacttcaccaataatcatctgagggctcagtccctgcctccttcctcggggattttaaaacacacatttctctgaccaaacaggtaggtgagatctgactttaaaaggagggaaaatcgggttgaattggggtatcaggaatgaatcccaagcatttttgtgtggcgagaggcatccacatcccaagctgtacctggagatggagaaaaatgcaggagagaagaagagaaaacaaagggggacaacgagccctggttgctttgccaaggtcttgggcacagacagggccagctctggctgggagctgctgctctaggggttgggagagttctgttcatccatggtgctcagcagcagggactgggggccgtggtaggtgcagatgcccagactctcaagcttgctccttgcatggctggcaggggcattgctccttgtcaccaggtgactgcacagggcagctgtcatggacatccagggggccatccagagcatcactgatgagcatgttgaatgctttggggccatcgtcatgttggccccagttgcacacatggtatcttctctttgcttggggcgaagggggcggggaggggcggggatagtctgccatgctcagagttgtaatcattcagcagctgctccatatattctaaatccttgcacaggaaggctcctcggcccaactcccccaggctggccacacagacactgggctccattcccaagtctttggtggctgctgtgtcagctggtgtcagaggccccagggtcagcaatgagtgggggtcttgtgctgcttctgctaggcccagccaaggggctgctctgtgcctcctgggagtcccagggtcactgccaccttaagggccacatgccatagctggaagtcactatatgtttggggaagagttggagatcgggaaaccattccctcataacaaggtagtaaatagtttggcaaaaaactgaagataaagtggcagtgctgagtaatcatgggcttcctacaggtgatcgggttgatttcttgttgccactgcctggcctgaagacagtgcttggctcagcggtggcagcagacgaagcagcagctcaagaggatgatgatggtggcccacaccagccagagccacagcagtgttttttgtcacaggtgtagcttggattgttggtaccacacaggcttatcccgtgggggttcaccctgggttgacaggggctgggcagcacctggaggaccaggaacaccacccacacccccacacacacaccacccagaccatctcctctgcaagcccctcctgctcctgctcctccatcacagcactgccctccttctgcttcctctcctcctctgccctccagaacagtggtcttaaagaggtttcttggccttggcacttctgtgggctcccaatgtgctgatgtgtgacacgctggcatgcttggcaagacctcactgctgcctttgactacacagggtcctctctgtacccagagcaaacatatgcaaggaaaccccagcactgaccgaatcagcttcctcggaggcccctctccacatgtgctcctgctaacccagtctgtacttcccacaagctgatgtcctgcttggagatgatcgtgctggccctcttgcccaacaactggctcctgtgtctggaggggagaagacaaatccctggtctccatccctcatgttcttgagaagtctgccttttattcctccacagaataataccaacatgtttacactattcctatgtatagacattttcccatttagttttctctcccctccggagtggttattaatccagcggtacagataagaaaacaggttcaaagaggcttattagtttacccacgtcccaagcccagcagatggtaggtctggggttgactcctcatttgcctggcttcaaagcccacgctctctgtgccccgcctcacatcccgctatgactgtggtctgaggtgatgacaagtccatcagcgctgacctctgatgtttctccagccccctgtcactatcacccattcccttcctccctgcatctcctgaggggcacctcccaattgtcccattccatgcggcaagacgactgctctcagagagctcctggttatggcattgctccctaccctcccacagtgatcaaactagaattcaagctccctggggaaatgtagggttctcctggcaccacccttgcccccactcccagtctcatgcctcttcactgctctcctcccctgtcccctcccctgctcagaagccctggtggcccatccaacaagccatgcgcctcctgcctctgtctctggacactatggcactctcagactggaagccgttcctaacctccccttcacccttttcagaaaagtcttcctgattcttccttgtccccacctcccttgggtctggctctgctggccctccctcgggtctgaggcagccatcctcctcctgtctccgcttgcctctgtcctagtcctgctcaggtgctcaggtgcaatagatgcgtccgtcctggcaatcaactgtgtgctcctcaagcgggtacatcttgtcttacatatcctgatatctccagtgattaagcaaagcctgggatgtaataagcacccagtgagtggaggaataaacatggagtggagggaaatgtgctgagaaaagaaagacccttccagaagaatgattctcaaagagtggtccctaagccagcaacaccaaaatctcctgggaatttaggagaaacacaaaagctaggccctaccccacacccaccgagtcagatctcctgggacagggcccaacaaacagcatatttttttatttgagatagggtcttgctctgttgcccaggctgaagtgcaatggcatgatcactgctcactgcagccttgacctcccaagctcaagtgatcctcccacctcagcctcccaagtagctaggaccacaggcgcacaccacaaacccagctaatattattattatttgtagagatggcaacctcatatgtcgctcaggctggtctcaaactcctaggctaaagtgatcgcctgcccctttgcctcccaaggtgctgggattacaggcgtgagccaccacacccagacagcaacctgcattttaacatatcttccaggtcttctgatgcccgctgaaaacttgagattggatacggtaatgacatccttaggccagtattgaaaccgccattgcaaaattgtaactgagacggtgaaacagatctgacccaaccaactctatcttgcggttttttttgtttttggttttgtttttttttttttttttttggagccggagtctcaatctgttgccaggctggagtgcagtggctcgatcttggctcactgctacctccacctcccaggttcaagtgattcccctgcctcagcctccccagtagctggaactacaggtgcacaccaccatgcctggctaattttttgtattttagtagaggcggggtttcaccatgttggccgggctggtctcaaactcctgacctcatgatccacctgcctctgcctaccaaagtactgggattatgggcgtgaacaaccgcgcctggcctccatcttgcttttaacctccaagctgtccttattccttccccagcataggctgaactaactttgggaagaacttagtttctagtttgaaacaaagacggtaacagttctttcccaaaacaaacctcctttttgcctggagactagactgtcttataggactaacaaatttgccaaaagattagaaattatggtttaggagtcacgtagctggagtctgcaagattccaaacctccccaaattgctcctggggataacgtcactattgtaaaacctaagatcagtgcttgagatattttaaagaccctgcacttgatgcatcagctggcacaacgcagatcgataaactagttcatctgatcttgtggcccccactcaggaaccgactcagcacaagaaagcagctggggtttcatctccaacccaacggatcagcactcccgactcactgctttcccctccgcccaccaaattatcctctaaaactcggatcctcgaattcccggggagacggcaagatttgatttgagtaatagtaaaactccagtctcccacacagtctgctctgggtgaattactctttctctatgtcaattcccctgtcttgataaatcggttctgtctatacagcaggcaaggtgaacctattgggcagttacgatatctctctgaaaacaagtcactattttttgtttgtttttgtttttgttttgtttttcagacagagtctctctctgtcgccaggctggagtgcaatggtgcgatctcggctcactgcaacctccgcctcccgggttcaagctattctcctgcctcagcctcccaagtagctgggattacaggcaagcgccaccacgcccggctaattttttgtatttttagtagagacagggtttcaccatgttagccaggctggtctcgaactcctgacctcaggtgatccacccgcgtccgcctcccaaagtgctgggattacagacgtgagccaccgcgcccggcttcagtcactaacatttttactgactcttctggcaccatgattaaccccgacacgcactatcgcatgcaattctcacaaccccatgaggtaggtattattattgctcctagcttacagataaagagacagagtttaagaggtttagccacgctacggggctgctgggagcccggcagtctggccacaggaggtcggtttcacggaagggcaggatgtggcggcatctcctgaatttaaggagtcttgggggcgcggtgcttctctgtcattgggcaactcattttagcctcttggggtttcagttcctcaactgagaacaaggaatttaggttgaaatgaacatgctggaaagctttcaagaattgcacacgtgaaatgctctttgcgtgtctcccggtctcccacccgcccccgacacagaggcgcaggagtaaccctgctcccttccgcgtcctcgccccaccacgagctgcgcattcttctcgccccctcaagtggccgagctcagattgcagttacttaggtctaaaaaaataaggaaaggctgccccctgctgcccacatggatgcatgaccccaacctgatacctgcctaactggtcttcctagcttttatggaaaaaacgctgcatatgagcttgggcataccgtccagagaggcaaaactgggacaaactccatcggaattctaaaaaaccatgatgccaagacagagtggcattattatttataaggccagtagggatgagggcccccactaggtgattaaaagacactaacttagaggatgaattattgataagtaaacgaggtgagtaaggcaggaaaacatgcagaaatagatcaaaataaactgaatatttcaattaggaaaggtactggcaagaggctttgacacaatccaatggatgaaagcaatcaactttttttttttttttttttttgacagagtctcactctgtcgcccaggctggagtgcagtgactcaatctcggctcactgcaacctccacctcatgggttcaagcgattctcctccctcagcctcccgagtagctgggactacaggcgcacaccaccatgcccggctaatttttttgtatttttagtagagacagggtttcaccgtgttagccaggatggtctcgaactcctgacctcatgattcgccctcctcggcctcccaaagtgctgagattacaggcgtgagccactgcacctggctgcaatcaactttttatgcaggcatttggtagcatgttgcgaggtccatcactattaatgccgtgaatataccaaatcctctttttctttcttccctaagttctaagggccatgccctggcaccaaacttatggcagtcctagactgccctctgatgttcaccatggcttacctctgccctgttctagttggggacaagctgtgggtcccaagcctggcattgtaacagaaacgcccagggtaattttctgtttgtttatttaaataaataaataagtaaactcagtcttggagattttaactcaataggtcatgaagactactcagaaatctacatttttcacagttgtccaagtgattaagtcctcactgagcaaattcaggacaaggaaacaacttcttacataaattctacataacttcatacataacttcacacataaacttctttggcaaaaaaaatgactttgtaaattaaacaagtaggtttttaaagtagcatattttatttaaagccaaattttcttgatttttaaaattaacttaagtttgactttcaatagacaatagagctatatgactctaaaatggaaacaacccagtaacgttgacactgggaaatgtaacttttacttccgctctgtttctgtctactccacccattctttcttttctttttttttttttttttttttttttttgttttgatagagtctcaccgtgtcgcccaggctggagtacagtggcgtgatcttggctcactggaacctccgcctcctgggttcaagtgattcttctacctcagcagcctctcaagtagctgggattatagtcacctgccaccacgcccagctaatttttttttttttttttttgtactttcagtgaagatggggttttgccgtgttggtcaggctggtctcgaactcctggcctcaggtgatccgcctgccttggccttccaaagtgctgagattacaggggtgagccaccgcacgtggcctactccactcattcttaataggtcatcactcttgtcagtttctgttgtatctttacagtgtttctgtatacaaaatgtatacaaaatcaagtaaatacaaaagtataattcttcttttcccccctctgttagacaaaggtgtcatctagttatgctattctgagactttctcttttctgggttaataatgtatcttagagaattttccatagcaatataaaatattttgattctttttttagcattgaatattactccattgtgtgaacatatcacagtttatccagtcccttactgatgggcatataattcaattttgtcagtcaaattagtgaaaagtgtattttgatgaagtttttttaattttatttttcttattgtgattttttttcccttatagttaggtaccatttggatttatttttctctgaacaatttactcttcacctatttttattgggctgctggattattttcctattgatttttaggagttcaccacatgttgaggagattagccctgatggtgagaactaggaatatttttcccagattgttatgtatattttgattctgtttatattttaccatgcgagtgtgtcatcattatgtcgttgtttgtcttttttttttttttttctggattttaagtcatagcttaaaaccctccgagtgacgcacagcctcggggcagggccagggtagtgatgggggctgtggcttctctataaggacatgccccaacgtgacaacagcttggagaggggtgggtactggagaagaccagccccttcgccaaacagccttacaaagacatccagctctaaggagctcaaaacatcctgaggacagtgcctggaggtgagaaggaagcccccggcctggtccataccccaccaccaacttgcataatggggggtgatgtcacccaccctccactcccctcaaaggagcagctgctctggtggtctctcccaggctctgggggcggacccatgggaggggctgtttttgtacaaagctgtaacattgtggggacagggggccacaatgattcaactctacgggaaacctttacaaaaacctctctggcggtcccaactcccagagtcctcttctttcctcctgggtcacaggtcttaatgcaatttggttcagaatgcctctgcctcactcctgatcacatgtcagaccaagactgtggacaaggacaggcccagatgagaactaaagcttcccaggcagagagaggtcagacataagaagactgcctcaggaacctcacaagtggaggactcagggagggtcccaatccccaaaaattgagacaaagtcaggtggaaggttcatcggaggtgaccagctctccagaggactcgggaagaagtcaggggtatctatagatggagtcacaggttctgggcccctgccatcctctgcaggccatgcactttccctttcgatggaccctcacagagggagcatctgaatggggcatcctttgaaaaaggaacctaggaccctgtggatggactctgtcattctccatggtcctaaaaagcaaaagtcaaagtgttcttctgtgtaatacccataaagcacaggaggagatttcttagctcactgtcctccatcctagccagggccctctcccctctctatgccttcaatgtgattttcaccttgacccctgtcactgtgtgaacactgaagctttctttggacaaggcaccagactcacagttgtaggtaagacatttttcaggttcttttgcagatccgtcacagggaaaagtgggtccacagtgtcccttttagagtggctatattcttatgtgctaactatggctacaccttcggttcggggaccaggttaaccgttgtaggtaaggctgggggtctctaggaggggtgcgatgagggaggactctgtcctgggaaatgtcaaagagaacagagatcccagctcccggagccagactgagggagacgtcatgtcatgtcccgggattgagttcaggggaggctccctgtgagggcgaatccacccaggcttcccagaggctctgagcagtcacagctgagcccagggtgatggggcagaagagggaaggggagggggcctctcctcatagttccctgagatagcccagagaaagcccggtgggtaatgaatgagccacaacacctctccatctatctgcttcactgacagaggttctctgtagattcttcgtatattcctgtgctggattttataggaggccactctgtgtctctttttgtcacctgcctgagtcttgggcaagctctggaagggaacacagagtactggaagcagagctgctgtccctgtgagggaagagttcccatgaactcccaacctctgcctgaatcccagctgtgctcagcagagactggggggttttgaagtggccctgggaggctgtgctctggaaacaccatatattttggagagggaagttggctcactgttgtaggtgagtaagtcaaggctggacagctgggaacttgcaaaaaggggctggaatccagacggagcctttgtctctagtgcttaggtgaaagtgtatttttgtcaggaaggcctatgaggcagatgaggaggggatagcctccctctcctctcgactattttgtagactgcctgtgccaagttaggttcccctactgagagatgggtagactcagcttggaaggggtcaccttgaacatctcctgtctccttgaagggtgccggtcacggccatgacagataaaagagcctctgaccttaccaccacggtcctaccgtttctctccctcacacagaaaggagaaggtcacagaagagggaacttgggggatcacacggggcctaattggtctgctgaccaccgcattttgggttgtaccattgtctacccctctacccaccagggttaaaattctactaaggaacaggagaggacctggcaggtggacttggggaggcaggagtggaaggcagcaggtcgcggttttccttccagtctttaatgttgtgcaactaatgaaaaactgttttttggcagtggaacccagctctctgtcttgggtatgtaaaagacttctttcgggatagtgtatcataaggtcggagttccaggaggaccccttgcgggagggcagaaactgagaacacagccaagaaaagctcataaaatgtgggtcagtggagtgtgtggtggggccccaagagttctgtgtgtaagcagcttctggaaggaagggcccacaccagctcctctggggtttgccacactcatgatgcactgtgtagcaatcagccccagcattttggtgatgggactcgactctccatcctaggtaagttgcagaatcagggtggtatggccattgtcccttgaaggcagagttctctgcttctcctcccggtgctggtgaggcagattgagtaaaatctcttaccccatggggtaagagctgtgcctgtgcctgcgttccctttggtgtgtcttggttgactcctctatttctcttctctaagtcttcagtccataatctgcctcctcactcccttcttggctcatcctccctcttatgtgcatggctctgcctctcctaagcctcttcctcttgcgccttatgctgcacagtatgcttaggcctttttcctaacagaatccctttggtccagagccatgaatccaggcagagaaaggcagccatcctgctgtcagggagctaagacttgccctctgactggagatcgccgggtgggttttatctaagcctctgcagctgtgctcctataattcacccctccactttgggaacgggaccaggctcactgtgacaggtatgggggctccactcttgactcgggggtgcctgggtttgactgcaatgatcagttgctgggaagggaattgagtgtaagaacggaggtcagggtcaccccttcttacctggagcactgtgccctctcctcccctccctggagctcttccagcttgttgctctgctgtgttgcctgcagttcctcagctgtagagctccttgcttagtcttcagggctgtgtgtttctttgctcttcttttcattgttttctgggactcttctcatctctactttcttagtggatgtattgttttactttcccttttttaaattgcatcttctccattttttccttcccattctaactccacttctgcattgttgactccttttggtgactagctctgtcttctatgttaagattctccccactgccagcctccagcacagaactctgctcatgtcttcatctccctccttctttctttctctaccagtcttagaagatgcatctatgtcttcctgaggtagtttgaaggttcatgagccaggcatgaccaggttggggagacaggtggtttcagggttgctcttgaggcctgagggcagaagtccctgtcacagcattgggcgagctgcagggagtctctgaggtgcctgtgtttggcaggtgtttgggagataggtctgaagagagtgttacaactggaaactgacattatcttagcaacagataaggtataaagaagacaaaatgggtaggagactctattttctttttttctgagacggtgtctagctctattgcccaggctggagtgcagtggcacgatctcggctcactgcaacctccgcctcctgggtttgagcgattctcctcccttggcctcccgagtagctgggattacaggtgcctgccaccaaacccagctactttttgcatttttagtagagatagggtttcactgtgttagccgggctgttctcaaactcctgacctcgtgatccgcctgccttggcctcccaaagtgctgggattacaaatgtgagccactgcacccagccaagactccattctcttaagcctcagaatctatgctagaacaatagggtaaaggccccaccaggaagccctagtacaaccttccccatgctggggaggaagcagacaggcggtggagcggggttgggatgggatgaggtctaggatggagacatagacaagggtggaggaatgggactcatagggtctaccaaagtttaggggcttgggcagacattagtgtaggtggggacacacaccaagacgttgagtggaaagtacaaatcaccagattcaaaggcctgggttcaaggggctgtggtgggggaggtgtgcaatttgaaaagcaacttaagctgcctcctctctaagacatagaaacagaagagactaacttatatgaaaatcctttgtaaaggattttgtaaaggactcaacttgtggtgacaatccttttcattcctgttgtttatgatcactaggtcacagggtttgcctttttccaaacctgcatctcaattttcccatcaaaaacatttcccaaatttggataaagaacccatatctagacttgccacatttctgcaccaaaagctcactctcatggttggaacagagccaagcaaagggcacagtaaattgtggtttcttccactcctcatgtgtcttcagatgaaatcattctttccaataatcccag

SEQ ID NO: 2531 - DNA, 30157 bp, Homo sapiens
tgctctggaacatggaagagtcacttcaccttcagaaagctcatttgctcatctgtaaagtgggcaattccataggtggttgtgatgataaaatgaaaaaaaagttcttaacttatatgagtgacatgctgtatagtaagttacatgcctatataggaagcacacagaaatgattcactgttatgataatggaaggacagtggtttggcatgttaagcactaaacagaagccagaaagatatcttagagaagtagacaaagaaatctatagttcagaatgaacagtaccaagaatgacatgtcccccaaattgagcatgggtagctggatctgaacctatcctacacatctgagtctacagtatgaggtaacagtcttcacctatagctatctcctctgcctgtaaggtcattcctttttgaagaaagctgacctcagactatactgtgatcgcttaaggaagagcacaaaatactggagaaggctagtcttcaagctctagatacagaaaatcctcaattcttgggtgttacctttcagaaaaagagtccgagctacaagccctgatccaaaaatccctttttccaaaaaaattctccatcttctaccaaggttcacctccctgtttagtgtacactggtgtctatagttgctagagcaagagtctctccttatcctctaaggcaggagttctgtgaagaccccatgacaaggggacaaaatgaaataacatgttcagggacaacacagcaaaaccccatattatcaatgctctaaaacctagctacctcaggcttggccagttattcatgagcagagaggtgtgtcatctacatggcagtcatggcctggatgggtctggaactgtggcaaggtaaggctctgagaaaaggtgccaggagaaagatgaattcaatcatctatttctgccaggaagaaaagcaccaggaaggaatcagatgtacagtttgtcctctggggacctctgccttgatcctcaataaatctccttttagatgccacgtgcagcaattcccacacttcacaatgctctccatggcttctgttggccttatggtcagctctgccaagatctgtattcttgggcaagacagaatccttctgaatctcagtctcttcctctataaatggaaataattttgctccacacaagtcaccattagcacgttggtgggaagttaaactgcgaaactcagcataaacaaagagcaatgtaccactgttgcttacgtgaaaactcccgtgaagcagtcaggcaccatgcaccatctaagcatagcagcgttaggtatcagcctattagtgattagagagggtaccggggagagagggggcctcagagcagtgggtctcctggctgtggggaagctgcctcagtggccatgccaggagctgaacctgaaggtactctgtgtgtcctctcaacaccatggaccctattttggtatttttttccagttacctctggtttccatttgcttcctccctctagccccctggccatgtccgatttctccagcaagtttctgagcttttctcattttgctcactgtctccagaacatccctgcttcttttacctttcaaagaattcaaacttgaactctgctcactcctgcccatcaccaacattagctcagagttgatgagaagggaaagcaccctcataaggaagcccctcctttccttacattattagacctgagcgcagacagcatctccatctccacactgctctggccaggttatgcctcagtcaattacacgactgtatcttagtacccttggtagggctcaaatcaggatattctctagaaagattcacttagtactgagccaagtataatctcactacatctaaaatagaaaattctagacccacccctccacatctttgttattgaacccaatatgtcacccatttaccatgtgctcaaatccctacctactgctgattctcagatcaaatcataacccagatttaccatggtccaaactctgacatgtgatcaggggcatgtcattctggttcaggctgtcagccccaagcaggtgggtcagtttcaatcaccctgagtgcaggttgcaagggcaaccatgaggctgcataaaaagaacctatgacaggatgcacatgagagacaaatgtcttcacattgaagaaggggaggagtgcgccattggttttccatcctccagatgcactgagtaagctcctacctaacctgtgccccctccttcttctcatccctatgccgtggtaggagggagagccatcttcaagcccagcatcctatggaatgctgagtctctcttctccttaccccttaatgttggaattctcattccccaaagccttggatttgactttcccactgagtgactggagagaagcatcttcatattcacaggaacaagccttagttagataagactttgctcctctcctgggagctccaggacactaaaaagccaagcttgctaccaacgcttgcccttccttaagtacattaaatataaccccaatagtaaaatatattcctaaacagccaggccattctccctccttctaaccctcatctcctcggcctaagaaagcccagctgtgtgatctggggcttggcttcccctgtctttcccatatcagcatccttccaggaaacagccggtctccctctctgctctcagaaggcaagtttccttatcacctgtgaatcacaaacccacagagtggccaaacatactgatgcaagaccataggaaggggaaagctgcaggtgtgtttgtgctgggaggagcagtgaccctcacctcacagacacctcctctccccatcctcgggaggtataaagacgggttctccaccagcaatcaggcacactctaccaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctgaggaggctgaaaaattactcatgccagagactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcgatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttctcccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcactgtctgtgtctgtgcctcctccttcacactccttcacattggaaagcatcctccaacctcaggtcagacagggctctcccccttaaacataagcagagcctccagctcccaaatgtgttccatggtacactagattaacacatacaaagaggtggaatccaaaaataagaagcttgggagaaaggggggcactgttttctagagaaacgtgtgtttcagaaaggtggtcttcggcaggggctattgttttatttgggcttctcagagtggttagagctactctgccttcagaacaatcacagtacagaaaatgtgtcagcatcttcgaggtggcccaaaatatttgaccagctgaaacttcttgctaaaatacaacaataattacaaatgctgctggtgatgacgtgactctcccaggaatgtgttggcaccaaaccctcgaccaagccctcccttctcattcacctggaaaatcagactcaaataaatcttcctggccctccgactcttcccttaattccctagttccatctctgtgagcaggctagagagatgttccacctaccacagcgggagccagactgcgacttgggaatcaagcccagctcttcatgctgcatttttatcttctttgcctttggggtaggatgccacagtgaatcccacagctaacaccagctcctcactctgaccagggaaagaaactacagagggtcaggattcacccatttgatcaattaactgaggaaggattcattttcataaaacttgcttgactttgagacacttcaagtgagttatttgggattctttaaaaaaggtggaaggaaagatctgaggactgtgacacaaccagccactctgaccacacattgactggcttgcacccactggacacagcagagggaggcaggcttcatggcacttgcggcacctgccaaagcctccttctggcaattctgagagggcctaagttggggccgtagctcatccaagcttgtcacccaagatccaagcaagcttctctttgaaattccaccttcaccttctgtcccaagtggttgtggacatccctgggagctggcgctaagggccaggagcagccaagggagacagacaagttcagagcacatttccagttacagggaacagagcacaggcctccaagtgtccatggagcagcgtgcaaattgcagggatgagtagagtaaaacctctacatgcagcacagcattcctggcaaacacaggggaccacagtacacatgctgtggaatacacccaagtatgcatcagacacttgtttggtaaacagtaaatgtgtaagatcaattaccttgagagggccatctgtgctccagacatgtggtttgtgtgaggagacggctaccactcactatcttcagaggaaaacagggctcagggcttgcacacaatggacagatacacatgggtcacccaaaatgtcactgcatacaaacatcactttgttcaacatggattttgtttttatggagtccaaatgcagaccctagttcaccttacagccttgggtttgtctgctttgggagatatatatccagttgatagacagacaagacagatacatttttttccctttcttaccacaatgtcaatgcctcatctgaatatcatcattactcaagagtcaagagaagaaccaaacgcttcatataaacagggctgggctgggctagatggggagtgttagtttccagtgttttctgtctccattcagatcattcctatcaaagcccagctggtcacctcaagccaagacacagacataaggatcccaatggccttccagatggctgcttccacctcccattttggccacgtagactctttacacaggaaagtgagtcaccccagtgagaagggttgccagcggaaatagggcatgaaaatcacagataaccatgggatttcttccaagtggtcagtgtaaaataaaccaccaccaccaccaccgaaaacacaaaagaagcaaaaaaagtgcttattcaaaatccaagacaaaatactgtgtgagagtcaggccacggggttgccttttctcaggccacacagctttcccagtccgtttgctcgcatggaaccgtaagatgtgaaggcctgcagagcgtgtgcttgggatggaggctggtactgttcacctgtgggtccagaccaaagggcaaagaggcagaaaactgcaactctgtccaccggcacagcttaggcccttctgctcatagaggctctgaagaacccccacctcagccttcacacatatccttctggctgaactacagccaggctggagtgccatggcatgatctctgctcactacaacctccgcctccagggttcaagtgattcagcctcccaagtagctggaattacaggcacccaccactgtgcccagctaatttattttttattttatttatttatttatttatttatttatttatttatttatttatttattttgtatttttagcagagacagggtttcaccatgttggccagactggttttgaactcctgacctcaagtgatccaaagtgctgggattacaggcgtgagctaccgctcctggctcagaccccatttttaaaaaatattttcaacatttattttagattcatggggtacatgtgcagatttgttacatgggtatattgtgtgatgctgaggtctggggcacaaatgatctcctcactcaggcagtgaccatagtacccaataggtatttttttagctctatccaccctccttctctcttccctctagtagttgcagtgtctagtcttcccatctttatatccatgtgtacccaatgctcagctcccacttatacatgagaacgtgatatttggttttctgttcttatgttaatttgcttatgattatggtctccagctccatccatgttgctgtaaaggacatgatttcattcttttcatggctgcatagtattccatggtgtatatgtaccacatttccttcatccagtctaccgctgatggccacctaggttcattccatggctttgctactgtgaatagtgatgtgatggacatgtgagagcatgtgtctttttggcagaacaattattttcctttgggtaaatgcccagtaatggaattgctgggtgggaatcgtagttctgttttaaattatttcagaaatctccaaactgctttctgcattaatttttccatgaactcatttacactctgaccaacagtgtataggtgttccatttcctctgcagcctcaccagcatcttctgtttttgacattttaataatagccactctgcagccaagctctttcaaggccaatgtggagaagagccacaaacattccttttcccgaagagaattcttgcctgcccactggtagatttcttggtttcatctgtctttcattgtttgtttttcaaagaaaaaccaaaggtaaagtgataatgatcttccacacctgaaccagtttgtagccaccagagcctgctgggaaggggcccctcaagcatgcattgatcttgtgacctggaatttgagagatcaataagccccgtagcaacctaccatacaactgcccatcagcgctgatcctttcatgggattagctcaattctggctctgcagacactggcagccacagttgacaaaccctgggcctctgtgggcttcctttgtcacccagggccacagtgggctgcctgtcctaggcagagacgcagcaacattctcttaaactgaaattaagcataaatccacttcaccaataatcatctgagggctcagtccctgcctccttcctcggggattttaaaacacacatttctctgaccaaacaggtaggtgagatctgactttaaaaggagggaaaatcgggttgaattggggtatcaggaatgaatcccaagcatttttgtgtggcgagaggcatccacatcccaagctgtacctggagatggagaaaaatgcaggagagaagaagagaaaacaaagggggacaacgagccctggttgctttgccaaggtcttgggcacagacagggccagctctggctgggagctgctgctctaggggttgggagagttctgttcatccatggtgctcagcagcagggactgggggccgtggtaggtgcagatgcccagactctcaagcttgctccttgcatggctggcaggggcattgctccttgtcaccaggtgactgcacagggcagctgtcatggacatccagggggccatccagagcatcactgatgagcatgttgaatgctttggggccatcgtcatgttggccccagttgcacacatggtatcttctctttgcttggggcgaagggggcggggaggggcggggatagtctgccatgctcagagttgtaatcattcagcagctgctccatatattctaaatccttgcacaggaaggctcctcggcccaactcccccaggctggccacacagacactgggctccattcccaagtctttggtggctgctgtgtcagctggtgtcagaggccccagggtcagcaatgagtgggggtcttgtgctgcttctgctaggcccagccaaggggctgctctgtgcctcctgggagtcccagggtcactgccaccttaagggccacatgccatagctggaagtcactatatgtttggggaagagttggagatcgggaaaccattccctcataacaaggtagtaaatagtttggcaaaaaactgaagataaagtggcagtgctgagtaatcatgggcttcctacaggtgatcgggttgatttcttgttgccactgcctggcctgaagacagtgcttggctcagcggtggcagcagacgaagcagcagctcaagaggatgatgatggtggcccacaccagccagagccacagcagtgttttttgtcacaggtgtagcttggattgttggtaccacacaggcttatcccgtgggggttcaccctgggttgacaggggctgggcagcacctggaggaccaggaacaccacccacacccccacacacacaccacccagaccatctcctctgcaagcccctcctgctcctgctcctccatcacagcactgccctccttctgcttcctctcctcctctgccctccagaacagtggtcttaaagaggtttcttggccttggcacttctgtgggctcccaatgtgctgatgtgtgacacgctggcatgcttggcaagacctcactgctgcctttgactacacagggtcctctctgtacccagagcaaacatatgcaaggaaaccccagcactgaccgaatcagcttcctcggaggcccctctccacatgtgctcctgctaacccagtctgtacttcccacaagctgatgtcctgcttggagatgatcgtgctggccctcttgcccaacaactggctcctgtgtctggaggggagaagacaaatccctggtctccatccctcatgttcttgagaagtctgccttttattcctccacagaataataccaacatgtttacactattcctatgtatagacattttcccatttagttttctctcccctccggagtggttattaatccagcggtacagataagaaaacaggttcaaagaggcttattagtttacccacgtcccaagcccagcagatggtaggtctggggttgactcctcatttgcctggcttcaaagcccacgctctctgtgccccgcctcacatcccgctatgactgtggtctgaggtgatgacaagtccatcagcgctgacctctgatgtttctccagccccctgtcactatcacccattcccttcctccctgcatctcctgaggggcacctcccaattgtcccattccatgcggcaagacgactgctctcagagagctcctggttatggcattgctccctaccctcccacagtgatcaaactagaattcaagctccctggggaaatgtagggttctcctggcaccacccttgcccccactcccagtctcatgcctcttcactgctctcctcccctgtcccctcccctgctcagaagccctggtggcccatccaacaagccatgcgcctcctgcctctgtctctggacactatggcactctcagactggaagccgttcctaacctccccttcacccttttcagaaaagtcttcctgattcttccttgtccccacctcccttgggtctggctctgctggccctccctcgggtctgaggcagccatcctcctcctgtctccgcttgcctctgtcctagtcctgctcaggtgctcaggtgcaatagatgcgtccgtcctggcaatcaactgtgtgctcctcaagcgggtacatcttgtcttacatatcctgatatctccagtgattaagcaaagcctgggatgtaataagcacccagtgagtggaggaataaacatggagtggagggaaatgtgctgagaaaagaaagacccttccagaagaatgattctcaaagagtggtccctaagccagcaacaccaaaatctcctgggaatttaggagaaacacaaaagctaggccctaccccacacccaccgagtcagatctcctgggacagggcccaacaaacagcatatttttttatttgagatagggtcttgctctgttgcccaggctgaagtgcaatggcatgatcactgctcactgcagccttgacctcccaagctcaagtgatcctcccacctcagcctcccaagtagctaggaccacaggcgcacaccacaaacccagctaatattattattatttgtagagatggcaacctcatatgtcgctcaggctggtctcaaactcctaggctaaagtgatcgcctgcccctttgcctcccaaggtgctgggattacaggcgtgagccaccacacccagacagcaacctgcattttaacatatcttccaggtcttctgatgcccgctgaaaacttgagattggatacggtaatgacatccttaggccagtattgaaaccgccattgcaaaattgtaactgagacggtgaaacagatctgacccaaccaactctatcttgcggttttttttgtttttggttttgtttttttttttttttttttggagccggagtctcaatctgttgccaggctggagtgcagtggctcgatcttggctcactgctacctccacctcccaggttcaagtgattcccctgcctcagcctccccagtagctggaactacaggtgcacaccaccatgcctggctaattttttgtattttagtagaggcggggtttcaccatgttggccgggctggtctcaaactcctgacctcatgatccacctgcctctgcctaccaaagtactgggattatgggcgtgaacaaccgcgcctggcctccatcttgcttttaacctccaagctgtccttattccttccccagcataggctgaactaactttgggaagaacttagtttctagtttgaaacaaagacggtaacagttctttcccaaaacaaacctcctttttgcctggagactagactgtcttataggactaacaaatttgccaaaagattagaaattatggtttaggagtcacgtagctggagtctgcaagattccaaacctccccaaattgctcctggggataacgtcactattgtaaaacctaagatcagtgcttgagatattttaaagaccctgcacttgatgcatcagctggcacaacgcagatcgataaactagttcatctgatcttgtggcccccactcaggaaccgactcagcacaagaaagcagctggggtttcatctccaacccaacggatcagcactcccgactcactgctttcccctccgcccaccaaattatcctctaaaactcggatcctcgaattcccggggagacggcaagatttgatttgagtaatagtaaaactccagtctcccacacagtctgctctgggtgaattactctttctctatgtcaattcccctgtcttgataaatcggttctgtctatacagcaggcaaggtgaacctattgggcagttacgatatctctctgaaaacaagtcactattttttgtttgtttttgtttttgttttgtttttcagacagagtctctctctgtcgccaggctggagtgcaatggtgcgatctcggctcactgcaacctccgcctcccgggttcaagctattctcctgcctcagcctcccaagtagctgggattacaggcaagcgccaccacgcccggctaattttttgtatttttagtagagacagggtttcaccatgttagccaggctggtctcgaactcctgacctcaggtgatccacccgcgtccgcctcccaaagtgctgggattacagacgtgagccaccgcgcccggcttcagtcactaacatttttactgactcttctggcaccatgattaaccccgacacgcactatcgcatgcaattctcacaaccccatgaggtaggtattattattgctcctagcttacagataaagagacagagtttaagaggtttagccacgctacggggctgctgggagcccggcagtctggccacaggaggtcggtttcacggaagggcaggatgtggcggcatctcctgaatttaaggagtcttgggggcgcggtgcttctctgtcattgggcaactcattttagcctcttggggtttcagttcctcaactgagaacaaggaatttaggttgaaatgaacatgctggaaagctttcaagaattgcacacgtgaaatgctctttgcgtgtctcccggtctcccacccgcccccgacacagaggcgcaggagtaaccctgctcccttccgcgtcctcgccccaccacgagctgcgcattcttctcgccccctcaagtggccgagctcagattgcagttacttaggtctaaaaaaataaggaaaggctgccccctgctgcccacatggatgcatgaccccaacctgatacctgcctaactggtcttcctagcttttatggaaaaaacgctgcatatgagcttgggcataccgtccagagaggcaaaactgggacaaactccatcggaattctaaaaaaccatgatgccaagacagagtggcattattatttataaggccagtagggatgagggcccccactaggtgattaaaagacactaacttagaggatgaattattgataagtaaacgaggtgagtaaggcaggaaaacatgcagaaatagatcaaaataaactgaatatttcaattaggaaaggtactggcaagaggctttgacacaatccaatggatgaaagcaatcaactttttttttttttttttttttgacagagtctcactctgtcgcccaggctggagtgcagtgactcaatctcggctcactgcaacctccacctcatgggttcaagcgattctcctccctcagcctcccgagtagctgggactacaggcgcacaccaccatgcccggctaatttttttgtatttttagtagagacagggtttcaccgtgttagccaggatggtctcgaactcctgacctcatgattcgccctcctcggcctcccaaagtgctgagattacaggcgtgagccactgcacctggctgcaatcaactttttatgcaggcatttggtagcatgttgcgaggtccatcactattaatgccgtgaatataccaaatcctctttttctttcttccctaagttctaagggccatgccctggcaccaaacttatggcagtcctagactgccctctgatgttcaccatggcttacctctgccctgttctagttggggacaagctgtgggtcccaagcctggcattgtaacagaaacgcccagggtaattttctgtttgtttatttaaataaataaataagtaaactcagtcttggagattttaactcaataggtcatgaagactactcagaaatctacatttttcacagttgtccaagtgattaagtcctcactgagcaaattcaggacaaggaaacaacttcttacataaattctacataacttcatacataacttcacacataaacttctttggcaaaaaaaatgactttgtaaattaaacaagtaggtttttaaagtagcatattttatttaaagccaaattttcttgatttttaaaattaacttaagtttgactttcaatagacaatagagctatatgactctaaaatggaaacaacccagtaacgttgacactgggaaatgtaacttttacttccgctctgtttctgtctactccacccattctttcttttctttttttttttttttttttttttttttgttttgatagagtctcaccgtgtcgcccaggctggagtacagtggcgtgatcttggctcactggaacctccgcctcctgggttcaagtgattcttctacctcagcagcctctcaagtagctgggattatagtcacctgccaccacgcccagctaatttttttttttttttttttgtactttcagtgaagatggggttttgccgtgttggtcaggctggtctcgaactcctggcctcaggtgatccgcctgccttggccttccaaagtgctgagattacaggggtgagccaccgcacgtggcctactccactcattcttaataggtcatcactcttgtcagtttctgttgtatctttacagtgtttctgtatacaaaatgtatacaaaatcaagtaaatacaaaagtataattcttcttttcccccctctgttagacaaaggtgtcatctagttatgctattctgagactttctcttttctgggttaataatgtatcttagagaattttccatagcaatataaaatattttgattctttttttagcattgaatattactccattgtgtgaacatatcacagtttatccagtcccttactgatgggcatataattcaattttgtcagtcaaattagtgaaaagtgtattttgatgaagtttttttaattttatttttcttattgtgattttttttcccttatagttaggtaccatttggatttatttttctctgaacaatttactcttcacctatttttattgggctgctggattattttcctattgatttttaggagttcaccacatgttgaggagattagccctgatggtgagaactaggaatatttttcccagattgttatgtatattttgattctgtttatattttaccatgcgagtgtgtcatcattatgtcgttgtttgtcttttttttttttttttctggattttaagtcatagcttaaaaccctccgagtgacgcacagcctcggggcagggccagggtagtgatgggggctgtggcttctctataaggacatgccccaacgtgacaacagcttggagaggggtgggtactggagaagaccagccccttcgccaaacagccttacaaagacatccagctctaaggagctcaaaacatcctgaggacagtgcctggaggtgagaaggaagcccccggcctggtccataccccaccaccaacttgcataatggggggtgatgtcacccaccctccactcccctcaaaggagcagctgctctggtggtctctcccaggctctgggggcggacccatgggaggggctgtttttgtacaaagctgtaacattgtggggacagggggccacaatgattcaactctacgggaaacctttacaaaaacctctctggcggtcccaactcccagagtcctcttctttcctcctgggtcacaggtcttaatgcaatttggttcagaatgcctctgcctcactcctgatcacatgtcagaccaagactgtggacaaggacaggcccagatgagaactaaagcttcccaggcagagagaggtcagacataagaagactgcctcaggaacctcacaagtggaggactcagggagggtcccaatccccaaaaattgagacaaagtcaggtggaaggttcatcggaggtgaccagctctccagaggactcgggaagaagtcaggggtatctatagatggagtcacaggttctgggcccctgccatcctctgcaggccatgcactttccctttcgatggaccctcacagagggagcatctgaatggggcatcctttgaaaaaggaacctaggaccctgtggatggactctgtcattctccatggtcctaaaaagcaaaagtcaaagtgttcttctgtgtaatacccataaagcacaggaggagatttcttagctcactgtcctccatcctagccagggccctctcccctctctatgccttcaatgtgattttcaccttgacccctgtcactgtgtgaacactgaagctttctttggacaaggcaccagactcacagttgtaggtaagacatttttcaggttcttttgcagatccgtcacagggaaaagtgggtccacagtgtcccttttagagtggctatattcttatgtgctaactatggctacaccttcggttcggggaccaggttaaccgttgtaggtaaggctgggggtctctaggaggggtgcgatgagggaggactctgtcctgggaaatgtcaaagagaacagagatcccagctcccggagccagactgagggagacgtcatgtcatgtcccgggattgagttcaggggaggctccctgtgagggcgaatccacccaggcttcccagaggctctgagcagtcacagctgagcccagggtgatggggcagaagagggaaggggagggggcctctcctcatagttccctgagatagcccagagaaagcccggtgggtaatgaatgagccacaacacctctccatctatctgcttcactgacagaggttctctgtagattcttcgtatattcctgtgctggattttataggaggccactctgtgtctctttttgtcacctgcctgagtcttgggcaagctctggaagggaacacagagtactggaagcagagctgctgtccctgtgagggaagagttcccatgaactcccaacctctgcctgaatcccagctgtgctcagcagagactggggggttttgaagtggccctgggaggctgtgctctggaaacaccatatattttggagagggaagttggctcactgttgtaggtgagtaagtcaaggctggacagctgggaacttgcaaaaaggggctggaatccagacggagcctttgtctctagtgcttaggtgaaagtgtatttttgtcaggaaggcctatgaggcagatgaggaggggatagcctccctctcctctcgactattttgtagactgcctgtgccaagttaggttcccctactgagagatgggtagactcagcttggaaggggtcaccttgaacatctcctgtctccttgaagggtgccggtcacggccatgacagataaaagagcctctgaccttaccaccacggtcctaccgtttctctccctcacacagaaaggagaaggtcacagaagagggaacttgggggatcacacggggcctaattggtctgctgaccaccgcattttgggttgtaccattgtctacccctctacccaccagggttaaaattctactaaggaacaggagaggacctggcaggtggacttggggaggcaggagtggaaggcagcaggtcgcggttttccttccagtctttaatgttgtgcaactaatgaaaaactgttttttggcagtggaacccagctctctgtcttgggtatgtaaaagacttctttcgggatagtgtatcataaggtcggagttccaggaggaccccttgcgggagggcagaaactgagaacacagccaagaaaagctcataaaatgtgggtcagtggagtgtgtggtggggccccaagagttctgtgtgtaagcagcttctggaaggaagggcccacaccagctcctctggggtttgccacactcatgatgcactgtgtagcaatcagccccagcattttggtgatgggactcgactctccatcctaggtaagttgcagaatcagggtggtatggccattgtcccttgaaggcagagttctctgcttctcctcccggtgctggtgaggcagattgagtaaaatctcttaccccatggggtaagagctgtgcctgtgcctgcgttccctttggtgtgtcttggttgactcctctatttctcttctctaagtcttcagtccataatctgcctcctcactcccttcttggctcatcctccctcttatgtgcatggctctgcctctcctaagcctcttcctcttgcgccttatgctgcacagtatgcttaggcctttttcctaacagaatccctttggtccagagccatgaatccaggcagagaaaggcagccatcctgctgtcagggagctaagacttgccctctgactggagatcgccgggtgggttttatctaagcctctgcagctgtgctcctataattcacccctccactttgggaacgggaccaggctcactgtgacaggtatgggggctccactcttgactcgggggtgcctgggtttgactgcaatgatcagttgctgggaagggaattgagtgtaagaacggaggtcagggtcaccccttcttacctggagcactgtgccctctcctcccctccctggagctcttccagcttgttgctctgctgtgttgcctgcagttcctcagctgtagagctccttgcttagtcttcagggctgtgtgtttctttgctcttcttttcattgttttctgggactcttctcatctctactttcttagtggatgtattgttttactttcccttttttaaattgcatcttctccattttttccttcccattctaactccacttctgcattgttgactccttttggtgactagctctgtcttctatgttaagattctccccactgccagcctccagcacagaactctgctcatgtcttcatctccctccttctttctttctctaccagtcttagaagatgcatctatgtcttcctgaggtagtttgaaggttcatgagccaggcatgaccaggttggggagacaggtggtttcagggttgctcttgaggcctgagggcagaagtccctgtcacagcattgggcgagctgcagggagtctctgaggtgcctgtgtttggcaggtgtttgggagataggtctgaagagagtgttacaactggaaactgacattatcttagcaacagataaggtataaagaagacaaaatgggtaggagactctattttctttttttctgagacggtgtctagctctattgcccaggctggagtgcagtggcacgatctcggctcactgcaacctccgcctcctgggtttgagcgattctcctcccttggcctcccgagtagctgggattacaggtgcctgccaccaaacccagctactttttgcatttttagtagagatagggtttcactgtgttagccgggctgttctcaaactcctgacctcgtgatccgcctgccttggcctcccaaagtgctgggattacaaatgtgagccactgcacccagccaagactccattctcttaagcctcagaatctatgctagaacaatagggtaaaggccccaccaggaagccctagtacaaccttccccatgctggggaggaagcagacaggcggtggagcggggttgggatgggatgaggtctaggatggagacatagacaagggtggaggaatgggactcatagggtctaccaaagtttaggggcttgggcagacattagtgtaggtggggacacacaccaagacgttgagtggaaagtacaaatcaccagattcaaaggcctgggttcaaggggctgtggtgggggaggtgtgcaatttgaaaagcaacttaagctgcctcctctctaagacatagaaacagaagagactaacttatatgaaaatcctttgtaaaggattttgtaaaggactcaacttgtggtgacaatccttttcattcctgttgtttatgatcactaggtcacagggtttgcctttttccaaacctgcatctcaattttcccatcaaaaacatttcccaaatttggataaagaacccatatctagacttgccacatttctgcaccaaaagctcactctcatggttggaacagagccaagcaaagggcacagtaaattgtggtttcttccactcctcatgtgtcttcagatgaaatcattctttccaataatcccagaaattctttctctcctctctcaagcatgtgaaaaggtccagagctctgcagtgtgagctttctactgaaatggcccttggactttgtggttcattcatactcagtggtctagcttgtactacttttgagaatgcaaagcttaactgtggacggattccaatcctggccaggcagggttgctggacactctgagagaagaaagggttaatcccatgaccatcaacttccatgggatttcagccatcctggacaagctaccacaccctcctgccccaggggaggaggaaatgtggaccatcccatcagatattgaccaggtttggctctttaaagagggttacatgcaagaaaataaaattttttaaaaaggtgctgggcaggtgggggactcagatgtaatggaaaagtgtcttttctagaaaagaaaagctaattctaatatgtgtcactaccccacgagacaaatatatacatcttgatttaaaaaaggaaaattataattagaaaaagtcaatttagttattgtaattataccactaatgagagtttcctacctcgagtttcaggattacatagccatgcaccaagcaaggctttgaaaaataaagatacacagataaattatttggatagatgatcagacaagcctcagtaaaaacagccaagacaatcaggatataatgtgaccataggaagctggggagacagtaggcaatgtgcatccatgggacagcatagaaaggaggggcaaagtggagagagagcaacagacactgggatggtgaccccaaaacaatgagggcctagaatgacatagttgtgcttcattacggcccattcccagggctctctctcacacacacagagcccctaccagaaccagacagctctcagagcaaccctggctccaacccctcttccctttccagaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcaggtgagtggggcctggggagatgcctggaggagattaggtgagaccagctaccagggaaaatggaaagatccaggtagcagacaagactagatccaaaaagaaaggaaccagcgcacaccatgaaggagaattgggcacctgtggttcattcttctcccagattctcagcccaacagagccaagcagctgggtcccctttctatgtggcctgtgtaactctcatctgggtggtgccccccatccccctcagtgctgccacatgccatggattgcaaggacaatgtggctgacatctgcatggcagaagaaaggaggtgctgggctgtcagaggaagctggtctgggcctgggagtctgtgccaactgcaaatctgactttacttttaattgcctatgaaaataaggtctctcatttattttcctctccctgctttctttcagactgtggctttacctcgggtaagtaagcccttccttttcctctccctctctcatggttcttgacctagaaccaaggcatgaagaactcacagacactggagggtggagggtgggagagaccagagctacctgtgcacaggtacccacctgtccttcctccgtgccaacagtgtcctaccagcaaggggtcctgtctgccaccatcctctatgagatcctgctagggaaggccaccctgtatgctgtgctggtcagcgcccttgtgttgatggccatggtaagcaggagggcaggatggggccagcaggctggaggtgacacactgacaccaagcacccagaagtatagagtccctgccaggattggagctgggcagtagggagggaagagatttcattcaggtgcctcagaagataacttgcacctctgtaggatcacagtggaagggtcatgctgggaaggagaagctggagtcaccagaaaacccaatggatgttgtgatgagccttactatttgtgtggtcaatgggccctactactttctctcaatcctcacaactcctggctcttaataacccccaaaactttctcttctgcaggtcaagagaaaggatttctgaaggcagccctggaagtggagttaggagcttctaacccgtcatggtttcaatacacattcttcttttgccagcgcttctgaagagctgctctcacctctctgcatcccaatagatatccccctatgtgcatgcacacctgcacactcacggctgaaatctccctaacccagggggaccttagcatgcctaagtgactaaaccaataaaaatgttctggtctggcctgactctgacttgtgaatgtctggatagctccttggctgtctctgaactccctgtgactctccccattcagtcaggatagaaacaagaggtattcaaggaaaatgcagactcttcacgtaagagggatgaggggcccaccttgagatcaatagcagaggttaattcagcgtgaaaggcagtgatgggagctgaagaggttacttctagaacagtctaggaagacacagatgttgagtataggaattttctatatccaactatactgttctgcccaggaaagacgtgctcagaggaagagccaacctatacaggtgtgttcaccctccagctggccatgtccccgtgactaacaaagctggattccataagcatcacccaccttccttgcagctttcttattgagcactccattcatcttcattggttcaccaagttgatttcccagctccaaagaagagaggctctgacttgcaaacttattttcaatggaagatgtgtcttccggtttaagttacccatctgtttataaatctctctctagtgaattaaaccagaatgaaaatgtcccctaatcattcctggaaggttagaaaataaaggtatctaaaactgagaatcagccccattcctacttctagaattccttcaaaagctccttctgttgtctcactgtcaccatggtgatggagtcccaaatcccaaaggtggcacagaagaccggatgattatccttgtctccttccacactctcctcacttctctcatccctgaagcccctgagctgcttctttcaggccgctttgcacatgctcttcctcctggggtgacaaagtactcttctccccatgataactcctgcttagacttaaagatttagctccaatgtcttcccctccaaaaagctttctctggccctttcttgcctcttccttacctcttcctcccttgaggctggattaaatacacctttattttgctatcacagtgccttgtgcataaccttctttgtgatacatcacacttgctggaaactacctctttatttgtctgacacccccagggactatgaactccttgttaacaaggatacattttaagatagtatcccagggctatagtatagtaacctcagtttagtgtagacaccacataggtatgtatgaataaataaatgaataaatgagtgaacccaaactgacccaatccaggagcaatcatcaccgtaagtcctgcctgaaatagccattacccttccatttataggactacaccacacagtcttccctctttattgcaacacatacatgcattcaaagatgcgtgtgtgcatgtatgcacacgcgtgtatatgtttatatttacacacatgtacacacatccactcattaaacacatatccctgtgatgtgttgttatcaacttccaagaaaattaagatacccaaattacagtccccaagaagcgtatctgttcacagagcaactcaatcatgaacagaaagagccaaacgcaagtccatgctttgaaagagcaacatgaactgcttactaaaatgcagtcagagagtggccctcaatttctcactgggataatcagtaaagagtctgagaaggtggcaatctcttcaaaggaagaattggtctcagttgttcactctagagaatggccatgctggtcagaggcatgaacaaaagccctaatgacatggctaggtacctctgggtaggcccgtttagctggttgcaaggttcagaaatgggagtgctcaaaattagcgctggaaaggcaggttggtgcatgccactctgggaataaacttacctccatgcaaccagcatggagcctgcacatggtggatgttcactaaacacctgtggagtaaatgaagaatatggagttcagacatcgttcaggaagcaactgaacaaagggaaattatagaggtttctggattgtttgtcctcctgtcataaggtgccatcaactgctctgtggattttcctatgagctgcctgccacccctcgctcctcccacccacttcactataaatgccagtctgagcaggtgggcacagtgagccccaccagggagacccagtgacatagatggtctgctcagggtgatgcatgttccaaggagggacctctctgccccccaccattaccatcactgtgactttccccaagcccttcccattttaattcactgcctttgtcttttccaagccccacacagtcagactaacctctgccacctgcgcttcctgccgctgcccagtggttgggggagggggactagcagggaggaaacatttttgtatcatggtgtaacattgtggggactagcgggagggcacgatgattcaggtagaggaggtgcttttacaaaaaaccctgatgcagtaagcatccccacccagctcagggaatgcagctaccaggtgggaagagttctctggggctggtcccagctgtggtcttgcagggtcccccaacccagcgagcacctgtccatctccctgtccagactcggcttccaaggaataagaaggccaagacagcaaagtgggattatcactcagcacttttaataaaacttgttcttgacaaagtacttgcacatgcattatttattaagaactgatgaaaaccctgagggaaagatattgtcccatctttccaatgaggaaactgagatcagaggttacaggtcatataactaggaaacggcaaggtctagcctgcaatatcgcccagctccagccgttccagtaccaccaatgccccttcagatttcaaatccactgtgttgtcccccagccaagtggattctcctctgcaaattggtggtggcctcatgcaagatccaggttaccgtgtccagctaactcgagacaggaaaagataggctcaggaaagagaggaagggtgtgccctctgtctgtgctaagggaggtggggaaggagaaggaattctgggcagccccttcccactgtgctcctacaatgagcagttcttcgggccagggacacggctcaccgtgctaggtaagaagggggctccaggtgggagagagggtgagcagcccagcctgcacgaccccagaaccctgttcttaggggagtggacactgggcaatccagggccctcctcgagggaagcggggtttgcgccagggtccccagggctgtgcgaacaccggggagctgttttttggagaaggctctaggctgaccgtactgggtaaggaggcggttggggctccggagagctccgagagggcgggatgggcagaggtaagcagctgccccactctgagaggggctgtgctgagaggcgctgctgggcgtctgggcggaggactcctggttctgggtgctgggagagcgatggggctctcagcggtgggaaggacccgagctgagtctgggacagcagagcgggcagcaccggtttttgtcctgggcctccaggctgtgagcacagatacgcagtattttggcccaggcacccggctgacagtgctcggtaagcgggggctcccgctgaagccccggaactggggagggggcgccccgggacgccgggggcgtcgcagggccagtttctgtgccgcgtctcggggctgtgagccaaaaacattcagtacttcggcgccgggacccggctctcagtgctgggtaagctggggccgccgggggaccggggacgagactgcgctcgggtttttgtgcggggctcgggggccgtgaccaagagacccagtacttcgggccaggcacgcggctcctggtgctcggtgagcgcgggctgctggggcgcgggcgcgggcggcttgggtctggtttttgcggggagtccccgggctgtgctctggggccaacgtcctgactttcggggccggcagcaggctgaccgtgctgggtgagttttcgcgggaccacccgggcggcgggattcaggtggaaggcggcggctgcttcgcggcacccggtccggccctgtgctgggagacctgggctgggtccccagggtgggcaggagctcggggagccttagaggtttgcatgcgggggtgcacctccgtgctcctacgagcagtacttcgggccgggcaccaggctcacggtcacaggtgagattcgggcgtctccccaccttccagcccctcggtccccggagtcggagggtggaccggagctggaggagctgggtgtccggggtcagctctgcaaggtcacctccccgctcctggggaaagactggggaagagggagggggtggggaggtgctcagagtccggaaagctgagcagagggcgaggccacttttaatcttttttctggggtgtttagagagaaggtgaacgatggaggagaggatttgttaggactctgggagaggcgagactggagaggacgaagggaaatcctggtttggggaatgggtaggagtgggggtaactgctattcgtaggcaaaaagagctgagcaggctgggaacagcgcgggtgggcaagggtcagcactgcgggcaggcgggtgggtgttagggggcagaaatcctgcagccgagggtgcagtagaacacagaagaaaaagcctgccaaacaaaagtggaacagagaagccaaaaagggagatgaacatgagtcagtgaagaaaagaatgaaagtttactgtttagcagtgtggatctctaatccgacttaaaactccttgttcccgattcctattcctcctaagccagagatccctgggtccagggtgagggcacggcattcatgcttacccacgggctggtcaacaaagaggtgctgacctgagagtagggcacataacctcagccact

SEQ ID NO: 2532 - DNA, 7845 bp, Homo sapiens
ccattccaggaagattgcgttattgtccactctcctgcatcatcgtcttcaccaaaaaagctgaaagcgacgaaacgcctacccagagggcaaatccagcttccgctctcctcagaggtactcagtccagttatacatcaatgtgagaatagtcccagcacttatcacttgtaaactcttttaattgattagctattaaatggcataagatcaatccaagtttaaacctgtatatcaaatccacattccacaaactctgtagtgaattatgtattttaaaacatgtagctttactggctaatgtaatcgtctgcgaatcttcccatctgttcttcaagtcactgtacctggaggcgcacactagcacagacccagacactcaattctggggctgcattattatcctgtacattaaaaaatcttgaaagggtgcttgttcacacctgccacctttctagtgagtctcttgtacttgctaatagagaaataacatacccaggttccatcctttttttttgagatgaagttttgatttcggctcaccgcaacgtctgcctcccaggttcaagcaattttcctgcctcagcctcccgagtagctgggatgacacgtgcacgccaccacacctggctaatttttgtatttttaatagagacggggtttcgccatgttggccaggctggtctcaaattcctgacctcaggtgatctgcctgcctcggcctcccaaagtgctgggattacaggtgagcccctgtgccagtcccaagatttcattcttaaccatcagtaattctcccaaagcagaaaagccacggagacgttacattttgagcaacaaagtttcagaacagctggctggatgaagaagggagcactattctgcagcccccatggaacaggaaaagccgctgttcagacacctgcagaaatgcctgactctgcccacctcacgtccacataaacctgaaaaaatgggagaggagtagctagctgtctgcccctggaagcccctccatttcccttgtgcatcctggcccctctctctctgagctcaggcccttccatgctcctctcccgccccacagaggccccctctgtcctggcccctctctctctgagctcaggcccttccatgctcctctcccgccccacagaggccccctctgccgttgcctttttcttcctctcccacgttctgttctcacgtactctgaaccccacgcggcacccagggctccccgcgttctctgagccccatgcccgccccacccggcacccagggctcccctagggtcacagtgttgtctgtttccgggttcacactggggagtccttcacaaaggcagactgggccgactctgatgtaagatcaagttctctgctgtccccgttgttccagaatatgggattctacccttagaagcgataagctttctgagaaaacgccttctgggtcagctccaagttcagctatcccgaggttccaaggctgtctgcccacccagacccaaggtgtccaatccttaggggtgaccctcgggccaacaccaatcacagctctggggacccccacgtgtcagccatggcaaaatgaacccccaacacagcaggggagggaaggaggaggcggggctcacagagcagagagccatggagagctccgggccgaaggggacttgggcctgggagagaagagacagccaggcggcgagggacttgtcctgtggaggcctccccaggaggcgagggtggggggactcctgctggaggcggccggcagatcagccttccttatccacgtcctcgaagtgatccccgtttgacatttggaaatgactttcatctgctgggtcctcctcggtttgacgtgcaattgcttttcccgaagctttctcctcttgtaacacccagctcctgcatgccgtggcggctccagccatcattcctcatcccaccaccccgcgcagcgtcttgcctccttttatgccggtgtacgtgttgtgttaagagctgggctttgccatttttgacaggctaatgcatttcaccacagataatgccattcaccacagaggcgcattctctctcgtgcccatcaaggcagaggctgagaagaaggtctgctttacagcaacggcctgaggaccctcggccccaaggtgaggccccgcgcaggtacctctgtacacgcctgtggagtcccaccctgtcgtgtgcacgaggctgtcacctggagattccggccctgccgggcgtctcctcccacgccgagctcctcctgccgggggggtctgcacagttctgggtgggggaggctccaggagctacccgaggcttcttctccttgccaacaacgatgccctcctcccgagggacggtggccccaaggggagccgggagagcagaggctacaggcagggagtggggagacccagccttcaagcacagcgccccttgggtgggacttgcctcttgctcacacccactcctacctcctggtacccgcctgctggaatctcctccccaccgcctactgtttcttttgaaatcccagtttaatccacttttttacacttccctttactccctcaagtgtctcctcccaacacccactttatttcacagcggctcgcgtccttcggagagcctgcctcccgccatgggcagcagggttcccgctgagctgggcccacctgaccagggcttccctcctgccgagccctcacctcgatgtgagccctgaagccccttgggctgggaggtgaggtgttcagagcacagatgcccgaggctgcacctgcaccaagacctgaccttaccccccagggccccggaccacacaggggctcacccgggtgttggctcacccgggcgccttctccgaacaccttccatcaagtgtcttgaattctgcagagcagcccaggtttcagggctttgcttctgttttcttctctggaagtgcatgctttgcagacaccaatgtcctcagttttagttcagaaaatgtgtcccgcctctctaatcaggtctaagggaggggagcagctcatgccgaggaggaagtgtgcggaaacgggtaccctggaaacgggaggagcaggcaggaatccaacacccatcccagccccgcgggcactgacagtcgctgcagaccgggcaagtcaccctcgggcagcgcttcagagctgacgtggcacccgcacccacagggctgccctcatccgcatggcggcccaagaggaggccccagttcatagatgaggaaggcggccttcgggagggaggggctgggcctcgcaccccagggaatggaagggcaatggcacctttcttccatgaatttcaccattggagaaaaagttaaaagatgaaaagtgtggcaagaggggaataagataagaaggaagaaacggaggggggtgaaagcaggcagaatgtgcctcttctgatcctcttggggtcactcagccacaccgagccatggaccgtcccttggagcgccacagactgcagggtttgtccttgtcacgaactcaaagagctgacctctctgggccggcacacaacttgcagccgagtcctttccacgacaccccagctccctgtctaaactcttggcctgactgggaggacctcttccctctagcccagttcctcctggcagccctgcaaatgcccaccctcttgggtctgtccctaccctgcagatggctccagcacctgccccagccacgcctccatctcccgccagccgccaagagctccacccaccacctggcccagcccctcctctgtcatctccaaggatttgatttcagtttcacacgaatcacctcctagtgatgcgtggactaatgctgtttaccgccggttcactttcattgcaaactcctcatctccaagaaatcatcaaccgagaaaagaaaggatgtcaccttttcccaaatctcccacagtgcctcacactacgagggaagatggtggaggagctgtccagacccacgggacagaaaagcccgggccagcccctcaacaccctgcagtggggacagcgcagctggggaccgcccagtgcagctctgccactggccctgtgggctggggcgcctctcagtttatctgctgctgactttgcccccttgtaaaacagggttgggagataatgagatgcctggggaaggtgtcctgggtccctttccacagggtccctttccacggggtgggtgactgatgaggacagggggtgcctaggaacaggggctcggaaggacctgctgtgcatgcaggggtcaccccaggagcgaccctggctttgacgagaaggaagtgttctctggttctggcagagaaatgtgtgaggcggactggtacacaacacaagcctaagggaagcagcacccgctccacagacaccacgcacaccgcccctcccctggtgctgtgtgagcacccatcctcctcccggggcccagccctcttccttggctgctggagtgcagggtgagcacgtctggaagaagcctgcagcccccacctcctttcctgcgcccctccttgtgtgtagcaggaagtggcttccttaggaagcagttattcgagtcatacccaggtgtgaaaagctaccaaggtcaaggcaaacataggaatggcctagtgccaaaatgaagccacagaattcagccctccacattttatgtctcagactttccaattttttttttatttccaaatatctcactgcgtggtctctgtgattttaattaagtctgatctaatgactactgtctgatggggggagtggcttgctgtaccccaacgagcagcatgcttctgttttatgtttagaggtttctctggccacctttcgagacttcattgttctctgaagatcgagctctatctctcaggagctgtatctgaggaagcattttgggcaaaacggcaggatgtacactgcttttggaaactgcatctgtgaacacttcagatttatgagaaaaatgcacttcaaaggggcactttccagaaaaacgttcagactcatggtgaaaaggtatctagaagattccatggagcctgcagaaaccaagccggctgaccccacatactgatgatctatactgaacacacaggcaaacaaaaacaggttcttcccacactggggacgacacgtaccctttaccctcatcatcctggctaaattctgcaggtttccttccgatttccttcacatcagaaaccatgggatttggcaccagcgtgacaaccatttagcatttgctgattcctagttagtccagggaagttctgtgccgccatggagtatgggaggagggaggcacggccttgccctcccggggcctggagtctgttcccggacaatctgcaaaaccgaatccacgtctcgaaagtttcaagagaattctactgtagacatctgtactatcagctacatttggaaaggattataaaattagaaaaatttccattttcaggcttgactttacaataaaatgttctctaatcataattatttcataacaaatgatctttaatgttgtatttttatacttgtaaactatttggcacagttttcacagggtgcccttcatttttgaagcagcataggttttgcttatttgagttttgcaaaaaatatattattttgacctggaaatttaaatatatagtgaggaaagccattctaagatacagagctgattgaaaaggctttgttaaaaacttctggtggggtcaagtaaacctcagtaaaagtcactgttttccaatttaattgtgaacatcctacttctattactcgtgattacaccaatgcctgaagattaaactcacctagagaaagaacggtctcttaaagccccagagaatgaaccaaggcgtgacctgtgctctttgtcagaactcagctttctgcaccgggggtaagaagtcagggtgcatttgggacttgcagacacgccagccccagtcaactgagcaccctcagatcgcagcaattgccaccacactgtcactgcctttgtaatcacttgctaatgggagcagcagcagcgaccgagacgtgcacttagccgctgtgtttacaggaggtccccgtggcccggatgcatgctttcctctgggtttggttccaaaggcctccaagtacacaaggaaacctgctgggtattgtgaaataaaccatcaaaagagaacttgctgaaaattctgcaggagtctctgccctcatgtcggggaagggagagtgggctggcagaatactaaacttgctgctcaaagatgatcaaagcctcaaggaaatggatgcaacattcaaagagactccgagagaaaaggaggagaatgtcttctaatcatctaacaacttatttttggcacagtttttacccaatcaccttccatagaaataggacacctacatgaaaaaagaatgcataaagtatactggtaccaaaaatcacaattcttccatgtcttcacattatccttagtgtgtgtgtgtgtacatgtgtgtataaatatatatatacacacatatatgcatatatgacaggctatgccaatttgaaaaaaaagaataaaagtcaataaaattggatttttacatcatgaagtacagaattaatccaaatatatcatgttttatctatttagaagaaaaaacaacatttactaaaacaatggggagaagtttggtgcgagtagtctgttaaacaaatgacctttaagaatatatttcagttattctgaaagttaatacacccaatttttgctccagtctgagcaaattaaacttggctggattatctgatggggttgatatcctggtaagtgtcaaaaatatgagagtctgtcaaaaaagatttgcttttccaataggtaaggcaaacaaaaatatcacactcatgtaaatgaagaaagctctaacatcctgaccctgtccatgaaatagttctattttgaggaaaaacaggtaaacatgtttgaaggtgtttgcattagaagctagtaattcaatctccttactgcttcaaaactattttaagaaaagctctcttactccccaggagcacaacgtgggccccctgtggtcccaagcccaggctctgactcacacacacaggggtcggggctggggggttctgtacaagcactaatgatgtgcgtgcattatcagggctgaggcggacaaatgctttagcagaggttggcaacatgagggccccccaggtcacgcgggaagtgccttgccaggacactaacccagctgctgtttaacagaggacatgaggattcaccttttggaaccccagggaggacgcagctctacaccctgaggccaccagtgccccccaggataccacctccacgcacccgtctcctccactccatcagaacacctctgctcctgaccttcctttccccaggtaagaacacaagttcttttgtttaaagtgtaacttcatattctgatattaataaaacttatgatattgccacctaccattctctctctccgaggttacctacctctcacctaccttgcacaataatctttttatttttcagaagctttaagacaatgaattgagtagttccagcatgtccccatgaaataaagcataagatcaaattgttccattttccttgtaacccagtgatgagagttatcatccacaacctcactgtgattatagaatcagcaaagtacacaggttcagtgagccagaaataaatacattaatgcgagaagacacctttcctgaaatttgttttatgtttgcaatattttaaaaaacttttcaaacagatttttaca

SEQ ID NO: 2533 - DNA, 73260 bp, Homo sapiens
aaaaaatgttaaagtgccagcaagaaattgagggtagtatcttggagtgttgtgagaagagccgtcctgagttctgacggtcaccatacaggcagagtgacacctgtgccttcagctgccccgaggtcaactcaatgccaactgccatctgggactcttggagagctctttctccccaggtgtgaccagacaaggttgttatggaatcaaataccaaattatggcagatgctaatttcagtcatcttgcacacagatcagccctggggtcaccatactgtgtttttgggacactccaagatggatgtgctttggttctgacggcagagaacaggacacctcccaaggtgaccgcaaggaggcctgagctcctgggccgctcattccaccccctctgcgtgctcacgcatggctccccagcaagacagagcagctttcctctgacctcttcctcttccagaagccagagccagccagggttcagggagagcggaatcactgggactgtatggagtttccacttttagcacagctggatcttttcattaatttttttatatctacatgggtttaactgtacattatattgtgcttttttattgctgattcggccagcaggaccccttcctccatatgccttttatcactttatttaaccgtgttgtacacatacacccactttgctttgtatatggtgagctaccttaatgccattgcccagatgcagatttgttattatgtatacattgttaaatttaacactttccttggtggatcaggttcctgtagggcacagaacactaacctatcaatgacccagactcagaaaagccaccagagaaccagcaaggtcaaattgcttcggcttcagctccggaacatcgtctccctccgtccacggcaacgcgggagcctgaccagctccggaacatcgtctccctccatccacggcaaggcagggggagcctcaccagctccggaaccccgtctccctccgtccacggcaacgcgggagcctgaccagctccggaaccctgtctccctctgtccacggggtgacttcatgctgccatggccatcacctgggttgggggtgggtagtgcccagggcaggggaaacacacagagcaactgaaatattgtcgtctttccccagagagggctccaaggagtggcgggagcttctcagaggctcctaatcaatgctttttcttttaaacaatccacgagctaatgagagggtggagaatcccatcccgatgggcactggcttctttccagcaagcctcggaatcacctcagtgcccctggcccacgggatcccaggaatcaagttctgatggatttgtaagcagattcgttcttcagattataattagagccgctctctctccccgcctttttgaaagttcccattagcctgagcaagggccaaaatattattggaaaacccatgggccactttgttccctctgtaccacaggttaaaaccctatttactttgtcagagaggaaaaaataatcaaataaactctccatttcagatgctactgaaacgagcaacaagggaaggggggagatgatgctcatgtgatttggaggccaaaggtgcttctaactcacagtcggagccaccccacgcctccttccacaggctccatgacggcaaaggccctgtccaccagccctatggaaaagagcctggctccagcacctttcctgggacttgatttcctcactttttaaaatgacttgccaatcaattatcaattgataatgactactgattgcaacatatctttagtaagtaaaatgaaaggtgtgtcttactactgctggctgtttccggccaacaagcccaagactgagaattggtgaaggaaggcattgcctgtggacctccctcccatgggtgcccggcctgctcttagtcccccactgaaggctcttcggcacctagagccccatcatcccttccccgtgtgtttgctaacgctgttcatcttgtctaggatgcttctcctccatcaaaaccacttcaagaatcagtccctcctggaaccctccccggagacgctctcttcctcacctctctctggacatttgcaggaagaagcaagacccgtccacatgacccatgcacgattcagtggctctcctccctctgggaggtcagttttactggttgtacgtggagtcctctaagctatgagggaagaaggggacaactgtttggccaaaccatagtctctgtggcccttgggaagaaggatgttgtggacactgcacctggcatctcctgggcttctgtcctctctcagctttgctcttcatgtccccggcatttttaactcctagctcagttacttctctgctcatctttcctcttagacttggggtccttgagggccagctctatgtctggttcatctttgcattctccatcagattgcagaagttgtgtcaacgacgaaccaataaatgaatgtgtgcagtcgggtgtggcagggaccaacaatctgaccagcgctctttctgtgtggatggtctggccctgtgttgacaaacacctaaataatccagcacgattcccttctagatgtatctctctacggtgactgagtgtgctcaatgcttacaactaggctttttccaatcacctgtaactcatgtgaatgtggtcactgatttgagcatcaaaagggccaaagttatcgagggcttttgcatatgtagatggagaacaggtgactggggtaacgcgttatttacctgtatttagatgggcagtctccagatgtttttaaacaggtgactggggtaaccagctacttaactgtatttagacggggcagtctccagagatttttgaaaaggaagaaggaagtaaattcagttacttggatacaagtaggacagaaaatattcctttgagattgtgagggtatttattcattgaacagttttagaggtacagagagactacttgatgagctgacttctgtttttttttttttttccagaagtgggtatctaggtttgctgattgctggagtaaacgatgaatgtggatggcagggcagcattttggaggtgaagccatctgcagatgcgtgtaccccacgagggtgagaagctccaagcacacccagaatctagggtgggggactgttcgcctgagcagcaccaactccatctcaagatgtgtgtctgctgtctgttgctgttctttgtttgagctttgaactcctcacataaccccttaactgtcctcttgatcttttattcatgagcttgacacattgggcagaaagacacagtctcagtgagatgataccaacttggagcttagtttcttcttcctaataccttttgcttgtaattccaaagtattgatattaaatactcataagtagccaaggaagaggaccatcccactactcagtttaatctgtcttgaaaatgcttcggtattgcatgaacgtgatgcatgatccaacccaatgctctgtgctaaggctgtgcttgtgttatctgtggtgaagagaaccttgtaatgaatggaccactcactgagccaggctgtgcttgtgttatctgtggtggagagaaccttgtaatgaacggaccactcactgagcctgggcagctccctgcatctgacttctggagagttctagagatactcacaggtcaggaggtctcttggggtgagggcaggggaggcagctctgggaaccgaccatcagcaaaggtcagagacttagatgcccatccagtgggttcgaatgtcagccgccttccacagcgaggtctggtaatgggcttggacctgcctgaatcctcctggctaagctgtggagtggagccaggagtgctgtctgctcacggtgggaccagcctgcaatcggtgcggcgggctatgcttagggcctaagaattaggcttcccacctgccagcgatacaggcacgggataggccacattaccctgcttttgtgactcatccttcctccatttaagtgggacccacacttgtggctgggataacaatttccaggttggctgagttgggctcctggcaagccatggctgggatagctatctccaggttggctgagttgggctcctggcaagccatggctgggatagctatctccgggttggctgagttaggttcctggcaaggccatggctggggtaacgatctccaggttggctgagctgggcttctggcaagtccgtggctgggatagctatctctgggttggctgagttgggctctcggcaaggctgtggctgggataacaatctccaggttggctgagctgggcttctggcaaggccgtggctgggatagttatttccaggttggctgaattaggttcctggcatggctgtgaaagtgctgccccatttctttgccaccagccacggaagtcgcagctccctgtgtcctctttgcacgttgcatgtgtcgtggtgggagctgtgaggcggtgccgtgacggggcgatgctgctgcaggagacgtgctccggggcacgactctgacgcagcttagaagagctaatgcttgacaccatctggatccccttcatgctttctgtttttatgggaagtcctaattcaacacatgtttcctgaggtgctactacgtgctaggttactgggtacagcaagaccatggaggaatcagagcgtaaacaagcgggcgcgaggtggtccaggcatggagggcacagaagccgtgatgctggggtgggctgggggtcagctggcctcaacggggtgaacacagcagctctcccagacatcgaaggagattcaaggagcctgaaactcaaacaagtggaagaggctggaacgtcacctaaggtgataggaactggggacccgacctggcgcccgttcaacagacccaagcctcccatcccagcatcgggccgtgatgtgccgtccattacacaacgatggaatctgctctgggaagaataaatggctctggtgagcatgctcagaattccattttaatattaaaaaatttaaaataattcttggtttaaaacacaaatagaggtataatatagtagccatctagaacctcaatttaagatatgagattgggtctgcttttgaattttagaaagtagtaagagtctgctgttttcatgtttaaatgtgtgaggcacttcagtaccatcagaacgtgtgcagaagacggaggatgtggaagggcccccaaggacaggtctgtctgcctggtggacactgagtgaggtggaggggaagccacagatccccactgtcctcatcactcaggcacatccaggctgatgaaaaagcaacagaatgggttcaaaggcctcttaccaaacgactcggggcttccctcagcccctgggtgttcacttcagccgcaccccagtcccccggcatctctgaggggccctgaggcgtgtcacctcactccccaccacccctcacttctgcctccatgaaatgtgggtccccttccaggcggcaccttccttacgaggactacgggtgtctgagaggcgcctctgagtccctatgccaccgcatctgggttgggtcacgatgctccccttgcacggagctaagatttatagaccgagacagctccaggagtggccaccccagcatttctcaggggaagaaatgaggatgaaagaggtggagctcgtacagtcagcaacggtggcccctgggcagaccctagagctcctggggccctgcccaggtccttctgtgtatgtctcagcccaggtcatcacagatccagccagtgatctgctggatgagaagcttctgcacggactcgtccaccctctcactgtaaacattgctccagacgaacgcaaggctgagagccgggggtggtctgcgggaggcaggcatgggggagaggacaggctgcgggaggcaggttgggggagaggacaggctgtgggaggcaggctcagggacagggcaggctcagggaggcaggctgggggagagggcaggctgcacaatgctgggctcctccgacaatgctcacctctcttctcccctccatttgcacctcagtcctgatatttatctccccaaaacgtctgggacactgggcagaggctgagtgagggtgccagcatctgcagggcaggctggaggccgctgctttgctctcaaatgtcagcatcttttgtaggctccagaaccgtgtggataaagcaaaacgctcacccaagaggaagctgatacagcagcaaagaccacccaacgatctggttcctacccatttccaggcagtcggtaaatgaaacctaacatgtttgacgcacgccctgatttgaccatcacaaagctccttctctggctgcaggatgcactcagcacgcacgccacaaacatggagatcacaggactccctacacaccatagtccatacagggccttgagtgtggagatcacaggcctcccctgcaccccacagtcctcacagggccctgagtgtggagatcacaggactccctgcaccccacagtcctcacagggccctgagtgtggagatcacaggactccctacaccccacagtcctccctacaccccacagtcctcacagggccaagagcatggagatcatgggcctccctacaccccacagtcctcatgggaccctgagcatgaagatcacgggcctcccctagaccccacagtcctcatgggaccctgagcatggagatcatgggcctccctacactccacagtccacatggggccaagagcatggagatcatgggcctcccctagaccctacagtcctcacggggccctgagcaaggagatcatgggattccctacaacccacagtcctcacggggccctgagcaaggagatcacgggactccccgcaccccacagtccacacggagccctgagtgtggagatcacgggactccctacaccctacagtactcacggggccctgagcaaggagatcacgggactccctgcaccccacagtccacacggggccctgagtgtgatcacgggactccctacaccccacagtcctcacggggccaagggcgtggagatcacgggcctccatacaccccacagtcctcacggtgccaacagcatagagatcacgggcctctatacaccccacagtcttcacggggccctgagtatggagatcacgggactgccctgcacccacagtcctcagcagtttctagagcagaagatgcccattaaaggcagatctcttccgttcagctgcctggtctgctgagcagttgagggggatggtgaggcagtgtgggaatccgcatgtgttgaggcctgcatccctgagctgcgggcagttgaggtgattctgaggcctgtgtccctgagctgtgggctgttgaggtgattctgaggcctgcgtccctgagctctgggctgtccgggtgattctgaggcctgcgtctctcagctgtgggctgttgaggcgattctgaggcctgtgtccctgagctgtgggctgttgaggtgattctgaggcctgcgtccctgagctgtggggtgtccgggtgattctgaggcctgcatctctgagctgtgggctgttgaggcgattctgaggcctgtgtccctgagctgtgggctgttgaggtgattctgaggcctgcgtccctgagctgtggggtgtgcgggtgattctgaggcctgcgtccctgagctgtgggctgttgaggtgattctgaggcctgcgtctctgagctgtggggtgtccgggtgattctgaggcctgcgtctctgagctgtggggtgtccgggtgattctgaggcctgcgtccctgagctgtggggtgtccgggtgattctgaggcctgcgtccctgagctgtgggctgttgaggtgattctgaggcctgcgtccctgagctttgggctgtccgggtgattctgaggcctgcgtccctgagctgtggggtgtccgcgtgattctgaggcctgcgtccctgagctgtggggtgtgcgggtgattctgaggcctgcgtccctgagctgtgggctgttgaggtgattctgaggcctgcgtctctgagctgtggggtgtccgggtgattctgaggcctgcgtctctgagctgtggggtgtgcgggtgattctgaggcctgcgtccctgagctgtgggctgttgaggtgattctgaggcctgcgtctctcagctgtgggctgttgaggtgattctgaggcctgcatctctgagctctgggctgtccgggtgattctgaggcctgcgtccctgagctgtgggctgttgaggtgattctgaggcctgcgtccctgagctttgggctgtccgggtgattctgaggcctgcgtccctgagctgtggggtgtccgggtgattctgaggcctgcgtccctgaggtgtggggtgtccgggcgattgtgaggcctgtgtccctgagctgcaggctgttgaggtgattctgaggcctgcgtctctgagctgtggggtgtccgggtgattctgaggcctgcgtccctgagctctgggctgtccgggtgattctgaggcctgcgtctctcagctgtgggctgttgaggtgattctgaggcctgcgtccctgagctgtctggtgtctgggtgattctgacccctgcgtctctgagctgtagggtgtctgggagattctgaggcctgcgtccctgagctgtgagctgttgaggtaattctgaggcctgcgtccctgaggtaggagctgcccgggtgattctgaggcctgcgtccctgagctgtggggtgtctgggggattctgaggcctgcatctctgagcagaggggtgtccgggcaattctgaggcctgcgtccctgagctgtgagctgcctgggtgattttgaggcctgcgtccctgagctgcggggtttctcggtaattctgaggcctgtgtccctgagctgtggggtgtctgggtgattctgaggcctgcgtccctgagctgcggagtgtctgggtgattcttaggtctgcgtctctgagctgtggggtgtccgggtgattctgaggcctgcgtccctgagctctggggtgtctgggtgattctgaggtctgcgtccctgagctgtgggctgttgacgtgattctgatgcctgcgtccctgagctgtgggctgttcaggtgattgtgaggcctgcgtctatgagctgtgggctgttgaggtgattctgaggcctgcgtccctgagctgtgggctgtccgggtgattctgaggcctgcgtccctgagctgtgggctgttgaggtgattctgaggcctgcgtccctgagctgtgggctgttgaggtgattctgaggcctgtgtccctgagctgtgggctgtccgggtgattctgaggcctgcgtccctgagctgtgggctgttgaggtgattctgaggcctgcgtccctgagctgtgggctgttgaggtgattctgaggcctgtgtccctgagctctgggctgtccgggtgattctgaggcctgcgtccctgagctgtgggctgttgaggtgattctgaggcctgcgtccctgagctgtgggctgtccgggtgattctgaggcctgcgtccctgagctgtgggctgttgaggtgattctgaggcctgcgtccctgagctgtgggctgttgaggtgattctgaggcctgtgtccctgagctctgggctgtccgggtgattctgaggcctgcgtccctgagctgtgggctgttgaggtgattctgaggcgtgcgtccctgagctgtgaactgcccgggtgattctgaggcctgcgtccctgaggtgcggggtgtctgggtgattctgaggcctgcgtccctgagctacaggctgttgaggtgattctgtggcctgtgtccctgagctgtggggtgtccgggtgattctgaggcctgcgtccctgagctacaggctgttgaggtgattctgtggcctgtgtccctgagctgtgggttgtctgggtgattctgaggcctgcgtccctgagctgcgggctgttgaggtgattctgaggcctgtgtccctgagctgcggggtgtctgggtgattctgaagcctgcggctgtgagctgtggggtgtctgagtgattctgcggcctgtgtctctgagctgtggggtgtccgggtgattctgaggcctgcgtccctgagctgcggggtgtcagggtgattctgaggcctgtgtccctgagctgtgagctgcccgggtgattctgaggcctgcgtccctgagctgcggggtgtgtgggtgattctgaggcctgcgtccctcagctgtggggtgcctgggtgattttgaggcctgcgtccctgagctgtgggctgttgaggtgattctgaggcctgtgtccctgcgctgtggggtgtctgggtgattctgaggcctgcatctctgagctgtggggtgtccgggtgattctgaggcctgtgtccccgagctgtgggctgttcacgtgattctgaggcctgtgtccctgagctgtagactgttcgggtgactctgaggcctgcttctctgtgctgtgggctccccaggggattctgagggctcttttgcttgtggcccttctgcttggcatgcatactcaggcctgcaacatagcacgtggtcctgatccttcttcgtaatgtgtattttactggttggttgcttgttgttcataatttttattatatcatcttttagagaatgctcgatttagagaaaaaaggatgagttttggaagcagccctaccaatgttctttctcttgtttcttgttgtgtggttttggccaaacgatcaaaacaatcaaatctctgggtcttggcttcccccacggcaatgaggctggccggatgtagggagtgaggcgtagaggatgagctgctactactgcacaggaatgtcccagcctgctgccagctccttggggaagcagcaagatgccacccaggtgagctgcttcctccgcacctatgagaggcaggaagtggcaggtaacatggagctgctggagacccagccccagggaccccctgccaatatctgagtgaacagttcttgcaagctaggaaggctggcccgaggatggcagttgtatctggcatttcttggagtgtctccagtttattttggaaataggttttggcaaaagttcaaaatgtcaaactcctgaggctttcagttgtcctctccctccggctccagtgtcgagtacccagtgagctgttgagagagaaattcttaaatgtaccgcagcgttcagctcctcagtgggttcggaaacagctggaaggaagggtgtaaagcccgcctgagatggcttcctcagggtttgcctcccagagacaccgtggcattggagcagggtgcagctgcattctggggtgggccagctcggcaccatcggccgatcttcctggacgagccagggctcgctggtaggccgtggaaccttctggccgcatctttagcttctctagaaagggctactcgaccgtgggctctaaagagcctcctcaccagtgagcgtcctgcccaactctgggaaaacctcccagatcctggcggggagctgctgtgagctgtggggccgaggaggctcccgacgcccagtagtaggctggggggacctgcagccgcaggaccaagggattgatttctttctcggttataaattgcaactggagacatgctgacatgtgaagggaagctcgtggatggggggcacaaggcaatatcccgaggagagagacaggctcaattccagtttgcgcgcactggacaaagtgaggatggggtcagcgagggagagcaggtggaaagaaaaaaatccatgcggcgaacgccctggctgtggcagcgggtttatttttgaatgaaggcaccatgcatttaaattaaatgtcagatgtaatttagcacccaggcatcaagaggctgagcgtgtgcagggaaagccggcagctcgcaggagtggctgagtgcctgctctccagcgcccacggagtgcgctcgctcgggaggtgtctctgtcctcggcgtgggagggtctttgagaaggtgaagcttggctgttgctaagacacacgagatcattgtttggaaggcgttttcccttctctctccctcaaatgactgtttaattgaggttactctgcaccgctgacacgcggtggaaagcccgacatcacttggagaacttaatcaaggctgatggagccgcgcgcacagaatcccaactgcccgcaccctttgtttcatgttcaccaagaccgaggggaccattcctacgggatgaggaaacacatctaacacaggccttctaaagagagaggagggagggagggagggatggaaagggggaaggacagagaccaccgtgaacacatctccgcttttcgctatgggcagatgcttccatagacatgggactttgcagccaagtgggacttgcagttgccctggacagcccggccttgcgagactcccattccgatttcttgacccctgagggtagatatgctcagaaaagctctggtcttcaggctgcaagctcccaagcaggatccacgagctcctgcaccccaaaccccaggctcctccacacgcactcacgaggggctcttcagagcccacctgcctgctgtgtctgcagctctggcctggctcggctgggttttctccagggtgggggcaccgagtggccagggcggctaagacaggtcggccatcacggatgtagcggggaacgtcgtaagtgctgcctcaacaacatggtgacttgtccgaacatgacctgactttgcatcccagggaaggcacagccacagcttcccatcctctgagagccccagagggggcaggcttcaggatgggtctgcagctgtgctctgggcgagcacgtgccctcgtccagtctcccttcctgggcagcccaggccagagctcccctggggtcgagctgggcgactggtgcgcggtgtggctgtcgcccttttgtgctggcctcagggtcaacgcgcactctctcttctgcttccctgtttccagctggcttcttcacccgaaagcccatcctcgtcttatcaaatctgatcctctccccagccacaagctcccacctaacctacagcccacctccaggtacagaggccaccctctctgtttccgtcttcctgccctgattgcagcttcctctcctacctggagtccagcatccatattttcatcttttagaacagaggacacccatcaaaggcagcaaaccactgactctggaaatctgtgattagagatggccagctccatctcagggatggcgagggccgccaagacaaggaacagccgtgggacagaccctcgcagcagccacgccgcctttcagaagggttcagggcttatgacaaacatctggcagcacccactcctgctggaagcccagacagtcagtgaccagatggttttgccatggccggcagtgctgataacagacggtcaggagatggatttctgtggtgtggctgttctccaaggggcaggaactaactgggaggaaaggcggggtgtcggcacaggcaccctctccaggcctgcgtgcagggggcaaggacagtgaagctactgacacttatgtctctgctcaaatcctaaacgcctccctctgctgacgtcggaacccacaccccgcgcagtgggcttctgtcccccgggcagtgccatgtgccaggcatgtctgctgtgctgtgggaggagacggtgctgttccctggccgatgcccactggaccccacagaggaactgtgctgtggggtgtggttcccacagacccttcatcgggaaagttgagaacttacaataggaagtgcagtttggtgcaagcttttcccttcctgccagcctcctgtgctatcagaacacagccccagacacaaagcccattacaaagtgaccagcacaggcaccagccaccactgcttctcctcccgtctgggcctcactccagccctagtggcctccgtctgggccgcagctcacagcatggcagtgacccttcctccaacacccccacctctgaaaatgtccatgtttctagtcgaagctccgttctctaccacgtgccaggccccacacctgccttaacgcctcccctccgttctctaccatgtgccaggccccacacctgccttaacgcctcccctccgttctctaccatgtgccaggccccacacctgccctaacgcttcccagatcgtggcatgcgtgcatggctgcaggtccctgctctcctggcatctgcaaccgtgccctgcccacctccccatcccccaccggttccttgccaggcaagaaccaaagccacctagcacagcacccccatccgcggccatggctgctgtccaggcatcacgcccacacctgccaccaggcccagcatcttgctccctcctcatcctggcaccagctgaccccatccttgggaggccttggtctctggttccccgctcccctatctgaagtgggtgctggtgagaggctgggaggaccaggcgttgtggctgggatctgtggcaacccaggaaggagctgcaactccgaggagttggggtgtgaaaacaatcgtccactgtgggctcaggaagagcagggcctggtgcgggcccttcccgaggaagcctgtggggcctgagtcctgggagaagcaaactcaggcctggaggctgagtccgtgtggggaatgtggcctgtgctgctgctcctgtggactcacgagccgtcaggacactgagccacgttacctggtgcttctccagcatgggcctgtctagcaaagcagtggcagtgctctgagctgggggcaggcggacatgccccgacactcggcttccaccaaacagggtggtccaagcactgagttctagaaagaaaaccgggaggaggcggtgtgggaccgtgggcagacatcaacctagaccagcccctgtccccccttggctgtgtcagaggtgacagtgacagtggccttccattctctgcacccactgcactcacgggactccctctgcaactctgccagggtggcttcatcaccacctttggaggaggccgaggctccggctggaaaggtgcccagtctgggggggcccttctcaagggatctttgtgttttactgaagttcacggggtgcccccagccctacttggcatgcgtgttttctttgtagttagttttctttgtagttattgggatgccacgtcaagttggtcatttcaggtaaaaggtggcgtaaacactggagctgcagagaaaggaaggtgcttcatgaacactctgcagcggggtgtgcttcaaggggaggaagaacttagattataatgcttttgttgttgttgtttgagacagagtctcactctgtcgcccaggctggagtgcagtggtgcagtctgggatcactgaagcctcaccttccctgggctcaagccatcctcccacctcagcctcctgaggagctgggactatgggtgtgcgctgccacgcccggctaatttttataatttttgtagagacagggtttctccatgttgcccaggctggtctcaaactcctgggctcagcaatctgcctgccttggcctcccaaagcgctgggattacaggcgtgagccaccacacccagacaatattataattttactcttaaaaatctttatgaaagatgtaaatatgtaaatattgagatgtttagactattcaagctgtcaaagacaaaaactacccagaaacccagtactgtgccaaatgttgagaaaatctgtaattccaaacagtagcttctgatgatgtttgttattttaaaaattacaatttagtcctgggtacgaatgggagtatttcagcctttcttgagaagttcatcgaacttctagggcaggttcatgtttacagctgtgtcttcacgggggggtttgagaagttgagtcatcctcatttgattataagaaaatgtggtccatatacaccgtggaatactatgcaaccataaaaagaatgaaatcatgtcttttgcagcaacatgggtgcagctggaggccatgatcctaagcaagctaatgcagaaacagaaaaccaaatgccacatgttctcacttatgagtgggaggtaagcactgggtacccatggacacaaagatgggaatgacagacactggggacccccagagggagggggtaggaaggggagagggaaggagtgaaaaaaaaccaccccttggctactatgctcactgcctggagacggatccattcttactccaaacctcagcatcatgcaatacacccaggaagcaaacctgcacacgtacccccgattctaaaataaatttgaaaaaaagaagaatgcgagcatttcccattggtcacaggcccttcccacggcagcgtccagcacccaggttcccagccagggctgggcggggctggcattgtgtaggtaaatgctgcagtggtttacttggcatctgactaccctgacattttatgggtaggatttgtaccactgcacaaaaatagttttaaccaaaaatatacttgtgaaaaacagtaggaaatgccagaaagaccagacttctttacaatcaaagaattacgtgtatgtgtttttaagtggaattatctggaagagtggcacttccaaaagagtttccatgaatgagtgaataatgaagttctaggttaggatctcggctctgtaatttattatctgggtaaaccagggcaaattttttaatcttttaattaattttttttttttttgagacaggatctgtcgcccaggctggagtgcagtggcgcgatctcggctcactgcagcctctgcctctcaggttgaagtgattctcctgcctcagcctcccgaagtacctgggattacaggtgtccgtcaccacgcccagctaatttttgtatttttaatagagacgggttgcaccatgttggccaggttggtctcagctgcccacctcagcctcccaaagtgctgggattacaggtgtgagccactgcgcccagcctttaaccttctaaagctcagcctcctgttttgtggagtagcagtatctgcgcctgcgctgctctcactgcgcaatggaagcaatacagcacggagcttagcagggaaaggcatgagaagctgctagcgtggggactcaaggaacatcagcagtgtccttaccttcataggaattaaggccaaaccatttatgggtgactatgtcaggagaagggaggaaaaaaaaaaaaaaaccctgttcctgatagacgagaaactgctcaggggaaagaggacgtcgctttccatgtcattattcctcagccagggttgtgcggatgggagcgctggtcacttaagcacatgaagaagaaaaagtctttctgcgaaacatggacggagcctggaacatgcagggccacgcgtgagggacgggccgaagtcagggatgtggggccaggagccgccgtgtggggtggacccctgccagaaaagcaaacgggcagtggatggactatggtatgctatgcggctcacaagataaaagtttttttttaaaacctcccccaccccctaaagagatcattattgttacgacatagaaaaacctagccttgcagctgaggctgcaccgtgcaggcagagaccgtcgaggaacccacagcagaattggccatgggtgaaggctgagtctgcaccgtgcaggcagagaccgtcgaggaacccacagcagaagtggcccacggaggaggagcactgagccgcctcctatggcagcgacacagaagccaggcctggaaggcagagcgggagagcagagagacatgctccacgccgcaggcccagctcaccctccgactgaggcaggagtgctggagctctcggcggccggtggggacaaggaggaccccggcaggcgcgggcagggccggggcaactgggcaggaccccagggaactttggatacgggcagaggaaggtcttccagtcggggaaggcgggaggtgttaagatgcaagcacttggcagttagcgggctatgaggatcttttctatctcgaagccgtgcgtctttcacctgttgttcgactggtatgctctgtggctcacaagatacaagtttttttttttaaacctcccccaccccctaaataaattattattgcaatttaaaaacctagccttgcaaaacagcttttgaagaacaagggaaataattgctcaaagcccacttgctctacaaacaggtgatttcagagacctttgaaaagagccccagctgctgaacttaacctggggccccgcgaatgaaccaggctccgcccctgacgcccgagacaccgcgcacaagaaggcagtgctggatctcccgcagggccctgaagcagctctctggtgcactgaaaaggcagcaccacgtggtggatcatccacggggcagccccagggcaaacgtggtgaagccaggggtttgcgggagggacagccttgccggtgcgggggacgcggtctcgggactgacggcgcaggggacgcgcgggattgacggagcgggagatgcggtcgcgggatgggatgtgctccccgtagctcccggcgtggctgcagtgggccggttgcggggaagaaaagggccggtgtcgtaattgactggacaggtactaatgccgaccacatccaaatatggatgatgacgagcgtggtgttgcccacagtccaggcctgtccaggcgccattccccgtggcctgcacgctcctgggtcatgctccgctcaggcggctccttcagtgaagttgcacagcagtcagggtaacctccatgtccccaaagggcaagaccggctcagaggcgaggtaggtggcacgaggccacacagctggtcagctcagccgggctgggacgcgggccccagaccgtggcccccgtgcagctctgggtccagctggccaaggtggactttgcacaaggtttgggaggctaaagggagccgaggcaggtggcagctgctgtgctgggaaggctgcgtgcgcggggcatcctctcttggcccgggtgggcggacgcaggggtccctggaggacgggactggcatgtctcctgcatcccgcggtgtccttgctttgtgtccaggtccctcctgacccccgcccatccaccctactggctcagagacgtggaggcagtggtcccttccccagctccccacgctaccccccaacccttgctgcacagcagaaggccctgctcagaaaatccctgatttcacgggactcctagtggctctgcctcccggatggagccctgcctgcgtggctgctctgtggctaacaaacagcgtgctcctggtttccctgccacggtacgcccctccagccacgtcaggccattgctcaactggaggagtgacatcgctccttaactttcatacctaggtttatgtcatactttccaagttacacaagtcacatcaaataattccgacgtttcaagaaaaaggcaagtgactctattattcctcgtttctcttgggtctgaaaaatcatgtcctgtgaagcccttcagacctgcctggggttcgagtccctggatctgccgctccccccttccctctcctgggagcatcggtgcctgggcgccgtgggcgcaggcggtcggcattgttacttaggtccgagctaagttacgtctcctctgcccaaatcctgtcaatgcagcaccgtgtccaccatgcgccaagggagcctgctgggctgagatgcacctgtttaggcagcatcggggagcgatgttcctgaggagctgggaggccctgcttcctggatggactggctcctgcgggaactccggcaggtgggagaacccgaggtggacagaggtctgctagtgtcagccgcttggcccaggagcctggcgtgtccagtgtcagctccttgtaagcccatcagggccgcttcattaaagttgaatttaaagccagactttaaagaatgaactgctgtcttttcaaaggcctccttcaaatggaagacggacacgtgtgactcagacatgtggggctcactgtccggggcggcctggctttttatcttcagcggttgctgttattggtcaatgatgttggtgttcagatctgcaagttctggactcatgactttgaggctttaaaaattactttaacaaataatgtacgcgttgagaatggtcgcctgggcagcgattataatggaagttctttgtgttatatctttcaaaatgtgccagtccatgtggggtgctggtgctttggggcaccagcccctgcccctctcttggggaggagctggatggaacacaagtccagcactcacagaggctcatcctgagttgtctgcccagggaacatcagtgagaaccatagtgtaggaagagaccgggcgggcaaagtgggaccatccagcagcccctacctgtcagggggacccaccccttccttccagccttccctgttcacagagggtgctgcaggccgccagggtgctgtccccccaacgccatatcggcattcagaacagatgccatactctgctctaggggcctccttctgcccccacatcacccactgaatctctctaacaaacatcccccacgtggtgatcagtttcccacgtgctcagggggttctgcgccctgccccaaatcttacagctgatgtggggtagagacagaatcccacccaggtttggctcccaggagtgtgacccaggatgggacagcgatttgtgctttgcagagaagtgaactcagcagtcgggatgcagggtgcacgttctcggtgtccccacgttcagctctacatgcacgaccccaaacttcctaaaggctcatgacgcaaataaaaccacaagtcctgccctcgagagatcattatctgggcccagagcagctgctccacagaagtgcgaaggagaatgagcagagccagtccttcctgtcctctccctgtcctccctcccatcctccccacctcccacatcttccctgtgctccccgagtcttctccatgcccctcagccctcttctggccagatccagcctcaccccatcaccattgctattcagcggtcacagtctccactgacacctgctggggtacttgccttttaacaaggcatccaaaataagaaaaaacttttcagaatgcttgtgatttttgtatattgattttgtatcctgagactttgctgaagttgcttatcagcttaaggagattttgggctgagacaatggggttttctagatatacaatcatgtcgtctgcaaacagggacaatttgacttcctcttttcctaattaattgaataccctttatttccttctcctgcctaattgccctggccaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaaactactttaaagttcatatggaatcaaaaaagagcccacattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgcctcatatctacaactatctgatctttgacaaacctgagaaaaacaagcaatggggaaaggattccctatttaatgaatggtgctgggaaaactggctagccatatgtagaaagctgaaactggatcccttccttacaccttatacaaaaatcaattcaagatggattaaagacttaaacattagacctaaaaccataaaaaccctagaagaaaacctaggcattaccattcaggacataggcatgggcaaggacttcatgtctaaaacgccaaaagcaatggcaacagaagacaaaattgaccaatgggatctaattaaactaaagagcttctgcacagcaaaagaaaccgccatcagagtgaacaggcaacctacagaatgggagaaaatttttgcaacctactcatctgacaaagggctaatatccagaatctacaatgaactcaaacaaatttacaagaaaaaaaccccatcaaaaagtgggcgaagaacatgaacagacacttctcaaaagaagacatttatgcagccaaaaaacacatgaaaaaaggctcatcatcactggccatcagagaaatgcaaatcaaaaccacaatgagataccatctcacaccagttagaatggcaatcattaaaaagtcaggaaacaacaggtgctggagagggtgtggagaaataggaacacttttacactgttggtgggactgcaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgcagcattattcacgatagcaaagatttggaaccaacccaaatgtccaacaataatagactggattaagaaaatgtggcacatatacaccatggaatactatgcagccataaaaaatgatgagttcatgtcctttgtagggacatggatgaaattggaaatcatcattctcagtaaactatcgcaaaaacaaaaaaccgaacaccgcatattctcactcataggtgggaattgaacaatgagatcacatggacacaggaaggggaatatcacactctggggactgttgtggggtggggggaggggggagggatagcaatgggagatatacctaatgctagatgacgagttagtgggtgcagcgcaccagcatggcacatgtatacatatgtaactaacctgcacaatgtgcacatgtaccctaaaacttaaagtataataataaaaaaaaaagagaaaaaagaaaaaacttttcagagccaaaggagagaggtgggagcatggtggccccaggcaccgcatgcagggaggggtatcagggccccccttgggaagtgtgtccctgcgtgtccaaggccctgcagccacaatccagccccgcccctgaaaagcatgttaggcccaggtgctggtgccggaggctaaccctccatcagagcccacagccgcccactcacggtcggtcacagggctaaccctccatcagagcccacagccgcccactcacagtcggtcacagggctaaccctccatcagagcccacggccgcccactcatggtcacagagctaaccatcagagcccacggccgcccactcatggtcggtcacagggttaaccctccatcagagcccatggctgcccactcacaggcacagagtccatcccaggccacagtgggaaggagagggagatgccctgaggtgtccagtccaactcaaatttccagccacatacaccatgacctctggcgtgatgtgccctcctcatttttctctcccttcccttttccaacaaaagctcagccctggtgatgacagcacagactccagctctccagaggcccaagacagcctgccccagtcactgtggccatggggcggccttcgctctgaggcacaggttggcggtggccctgagccaggctggtgtggcctcgagtcccttctcctagccccaaaccccacggcacagttggggatcctctcggctgggtccccaggggagctgcacactgagcctccacctccttttcagagttgggagcagctgcccccctggccatgggggaaggccacgcccctaacctgactgcagattaaattcttctggaaatcttagcctgcctcactgcttggtttcctcttcattcggaattaattcctcccttggatgctgagggctggtggctggtcctctcttcgcagtgcagtcacttgctggagtctcctgagggcaggagagccccggcagtggtaggaggaggctgcaccgggcagggttaggggctgctgggcctctgctgtgtggccactgccccatgtggctgccccatcccccagagcaccacggtgcccaccttttgttttcagagaagcaacaacacctcatattcagtctaacctgtgaccattttccaaacactctcatgttcgtttgatcttcatgatgtccgtgaacacagggaagctttagtcgcagccacatgagtggagcatgtggaggctaggagaggccatgcacgcaccctctaggatggccgtaactaaacacacacacacaacaaaaacgtgctggcgagaatgctgaggaatcgtaactggcacactctgcagggaggaatatagcatgatgcagtcgctgttagtgggtcctcaaaaaactaaccacagaatcagcccaggacccagcagttccaccaggggcatatgcccaaaagcaccgaatgcagtgactcagagagagattcgcacgcccatgttcatagcagcagcgctcacagaagccaagaggtgaggccacccaagcgtccaccaatggaagaaaagataaacatcatgtggtccacccacacatgggaatattactcagcactgaaaaggcagagattttggatgcaggctacaacatggatgaaccttgaagatgttatgctaagtgaaataagccagtcacaatatgataaacactgtgtgattccactcgtatggggtccttagagtcatcagatccatagagacagaatgtaggacagtgggtcctgggggctggggagttagtgtttaatggggacagacttccagtgtggaaagatggaaagagttttagaagcagatagtgatgatggttgcacagtattttgaatgtaaatactaccactaaattgtacatttaaaggttaaaaatcacaaatgttatatattttaccacaataaaaaattaaaaaataaaagagtgagagactgcgtgcctggcatacagcaggggacaggagccgattgtctgtcctacagctgggaaatgatccatcctgccattcatccatccatccatcaagcactcatccatccttccatccttcatccacccatccatctacccatccatccatccattgatccatccatatccatccatccatatccatccatccacccacccacccatccatctacccatccactttcatccatccaaccatccatcattcttccatccatccatccatcatgcactcatccatccctccatccttcctccatcatccatgcatccatacctccatccatccaaccacccatccttcccccatccatccactcactccccatccatccttcatccatccatccatccttcttttatccatccaaccatccatccatcattcctccatgcatccatccttcacccatccatccatccttctttcatccacccacccacctgtcattcatcatccattcttcctccattcatccacccatccaaccatccatccatctttccttcatccatccctccatcatccatccacccatccatcatcctttcacccatccatcatccactcttcttccatctatccaccatccctcatccgtacaacccatccatcatccattcttcctccatctgtccacccttcacccatccatccatccttctttcatccacccacacacccacccatccatccatccttcctccatccattcacccacccatccatcatccatcatccatttttcctccatccacccatccactcatccatccatccatcattgctccatccatccacccacctacccatccatcatccattcttcctccatccgtccacccttcacccatccatccatccttctttcatccacccacatacccatccacccatccatcatccattcttcatccattcacccttcacccatccatccatccttctttcatccacccaaactcccactcatccatccatccttcctccatccattcactcacccatccatcatccattcttcctccatccatccactcatccactcatccatccatccatccatcattactccatccatccatccatccacccacccatccatccatcatccattcttcctccatccatccacccttcacccatccatccatccttctttcatccacccacacacccatccatccatccaaccatccatccttccttcatccacccatccatccaaccaaccattcatccttcctccatccatccatccatctatccgcccacccatccatcatccattcttcttccattcatccatccatcatccatctacttatccatcatccactcttcttccatccatccaccatcccccatctgtccaccaatccatccatccatccatccatccatccacccacacacccatccatccatccaaccatccatccttcctccatccatccatccttccatccattcacccacacatccatcatccattcttcttacatccatccacccatccatccttccttcatccatccatccatcatccatctacccatccatcatccactcttcttccatccaaccaccatccctcatctgtcaaccaaaccatccatccatccatccatgcatccatccttctttcctccatccatctatccacccatccttcctccatccatccattgatccacccataaacaaacactttcactgaagagacacgggaggaatcagaaaaagctattctcagagcttctatcctagagaattgctggcacttgcagagtgtgtttggatgacttgggtgttcctcacaaatgcctgtgctgcgggtcctattcttttccccagtttatggaggagacactaaggtacccagaactgcaagaacttgctcaatgctccatagcatttggctgagacaccatttcttggaggacaggacattgaaatctcagaggctgggtgagacacagggccactttgcaggtggctctcgaaacacgtccccttggctacctccgttggggccttcaccctctacttgtagttgatggcaccagaaatggtcttttctgggcttatgtctctgtcttcctggccagctctcagcactggctcttgccgggtgggtggaatcctgtctgatgacccagctgggagtggcttgtccccctctggacactgccagccctcctcctggcaccacctagcaccatacaatagtcactccaggggctgccattgccacagctccccctgcagggtaggggccaggccttggcacgtcttgattcaaatcctggcacttgcagtgtagatgaggagctctgggcaaggtactgagcttccctggctgcagggaggttgacatgaagtagccaggctgtgctgggcacacagcactccacgtccatcatccatctgtggcttatgaacgccttgtaccagatttatccttggaccctaccaatttaaggggaccacggaagcttctgaacaagaaggaggggtttccctgttcctcctggcatcttggttttacaatgagactgactgccatgttatctgtgttcttaggataacccaatctttctctctccttctaccttgataatgatgcctgacactttgtacggtgtttgcctttgcgtacaaatggctgggaagtcctcacagtcacaccctgcagtaagaatgctcacgaatacagcagtaagaatgctcctgctctcccaggaaacactgcattggggaagtgagtgcccatgggtgcaagtcagcaactggccagggcgaccgctctttcactgccaggccagtctgccttccgtggtcacaggcgaacactgttctgtttggtgctgtgcctctgcagtgtggtgagaactgtctatactcctgctcctcttagaaacgctgtgtgtgtgtggaggcggtgggaaccagtggtcctggcaaggcctgccaggctcagacctggagcagagccaggccccagctgaagcagaaacttccagctctgtgctccttgctattttttgtttgtttgttttgttattgtttttaaactcaaaaggcaggtaggacttaggaggcaagaaagcccgcttgagggacattaaggacatgaaggcacagtcatgggacgcttccatacacgattcctgcttattgctgacaccgagcggtaaaaagagaattgccactgtgagtcacacactctgcagtgtggcgactaatattgatcttccaaacggtaaaaacaagaacaaactggaaagacaaactctacttcagattgcaactacttaagcatctttgtttaacaaaatcaataaaaaaagatttcactaacaagactgcaacctatatttgtggctatgaattccccagattgctggaatatcaaatccagagcacaggagatgcagagagagtgaggcccagcaagcctgttttacagtcaacggatcgtcctctgctcctccgagcagctcatctgcgttcggctgtgcgatctgagtgtgttcactgaagcacagcacacgggcagaaccgcacgctacatcctcaggctttgctttggggccaagaagcgacccccctacagtgacagagtgtggctccgggccggacgccccacgctggcctcccgttcccatatcccggccatgagagcacgcggccgcaacacttgtcttcaaggagccatgatggggatgacgtgaggctccccagctcctggagaggccaagggggctgcgacgccccagcccagccccagctccaccccagatgtttctgttcagaaacaaaatcagttacaaaaaaacctaaacacatcaccccacaagaaaagtcatttggaaaaatcatttggaaatcacactgatttccttaaaatataaaaaacattgatttatctcgatctcatccattctgcttaggggagcagtttctgctttaattgtagtgtctttctttagaaaataaggacaagtgattggggtgttttggcacccacagtgccatggcacctatggaggctttaaagaacaaacatgccctcggaagaagttactcggcgaagtcgacacacacatctctgagtcagacatttcctcacattgtcccctcatttgtcaacacataattactgtcaccgctgtgtgctgacgctggcatcaggttgcacgtgccagtcagcataaaaatatggccgtaatgttggcataatttttcatgatcatcttcattaaccacagcgaacgggaggagcgtttgcctgcacccagccatcgtcatgacaacgcctccaccgcggccagcccagtgtccaccgagggcagcggttgaatgtcctcattattccgccccccacacgctttgcccgtgccaagcaaggaccaacacatgccggtgatttatccccaggccactcccgacggcatccaggcttaaggcgctggtctgatttcacagtttaattactgctaatctgagaggccacagctaatgagctgccggcaaccagctcgccctgctggaattccacaccccttccctggatgactcccctcattgtcgggggggcagttaaggaaggtgtattgacttctaggtgtgacaggttgactaagcacctatggaaacatcacagcaatgtcaacaggcaaatggaacacagataggattttggaattcagccaccacaactccactgaagacagtatgggttgctgatacaccccagaccttctgcaggccttgggtagaagatgttgggcttggctttagccacgccacgggctcccttggtcctgcataaaacacacccacacatcttcaccaggatttgtaacagcacagcagacatgtcaccagcccctccacacggaactctcttccgcagctccctgtggctcagcgcgttcctgcctcccactccaccacagctccctcccagacctgcaggcttcacatctaaaacactatcccaggcgctcctcacctggattccctgggggctgccatgggcccctccctgccacccgcccctttgcacactttattcttcccaagacccggcagatggcctgaaagcacatgtggggctgtggcctctggtgcaggcatcatggcttactgggctttaggatacacaccccgacctcggctaccgcatccacgcttggccccagcagcccgtccggcctggggttctctgtggcttccttggtctccgagcctccccagcactttcacttcccgctgccaccggccccggtgaatgctgcttctgcttctagaacactgctctgcaatttagagatgaaattctggcacccttaattctatttgtttaatccagtgaatttaatttcaggaacatattggaaccatgcttagcttcagagcagagtttatgtagatagaatatgactggaggtttctgctggtttaagtgtgtcagtcacagaatgcatgatgtcagtataacaactacccttgcttaatgataacgctaattaaatattcttagcagcatcatgtggagaaactggattttcaattaagcactttctgaggtgagggtctcagcaggtcccacctctttacgttaaaccggaggctttctgctgttgtcaggccctgtgcacccagagaatgtaggaattatgaatgcgtgaagctaatttcttttcattttcattcaatggtatgtgagcttttccaaatacatgatcctactctctcctttggggagaaatctttgttaaaaattagcgctataggggagcttattttgcccaatgacagagcagatctgaaaaaagcatcaaatcttccttcgtatcctctaatacatccctccagctcgggtagacggacatcctcgggaagagcgttcagccagctccagacacagcaaggtcatgaggcgcctgcattcagattcattgctgggtgtgctgaagagggccacacattctctgacgcacttgcccccgaggtgagacctctgtcctccccacctgagtgtgggggctgtgggcccgcttggccagttgaggcagcagaatgcacctgcccccgaggtgagacctctgtcctccccacctgagtgcgggggctgtgggcccgcttggccggttgaggcagcagaagtaacgccctgccagtttctggcttctgggctcagactcgagagactggcagctcccatttcctctcttgggacacttgttcttgggaaactcgctgccattctgtgaggaagcccaagcagccttgtggaggctccacatgcagaggcccagagctcccagccacagccctggctgagctccacaactgccaccacaatgtgccagctatgtagacaagccctctttggggcgagccctccagcccccttggaccactccagctgatgccagtggagcagaaacaagacttccctgtcatgcctgaccagattatagagctgagagcaaaacagggctctccaatttgggataatttgctatgcagatatagattcctggggtacctgcccccccattccctgtctccatctctgatataaaactaatcccacctgctgccagttcatgcccttctgtggcttgcagcagctgacactgacacctctttgccaactcaatttaacagccacccaccatgtcacgggtgcagagtgctggatctgggactccacagagcagtgagacacagcccctgccctcagggagcttacaactgagtggaggagaaagacacacacggcacagggaaaatgtgctggcaaagcagtgcaaagggcagtgcacacacacagtcagagacacacaaacacacagacacacatgcagacacacaaacacacagacacacacgaacacacacagacgcacaaacagacgcagatacagacacaaacagacacacatgcagacacagacacacactcacagacacagacacaaacacacagacacagacacagaaacacacagacacaagacacaaacagacacacacggagacacaggcacacatgaacacacacagacacagacacaaacacacacagacaaacacacagagacacacacagacacatacaaagacacacatacagacagacacacacacatacacacggacacacatgaacacacacagatacatacacagacacacgcacacacagatgcacagacacccacacatagaaatacacacagatacacacacagaacacagacacaaacacacacatggatacacacacacagacatacacatacacagacagacacacacacagacacaaacacacacacaggcacagacatacacagacacagacacacatacatacacagagacacacatagacacagacacacacacatacacacagacacagacgcacacagacacccatacagacatacacagacacacaaacacacagacatacagacacacatagacacagacacacacatacacacagacatacacacacacacatacacacagacacagacacacacagatacacagacacaaacagagacacacatagacacaaacacagtttgtgagagccctggcccgcagaccatggtggctgcagtgtgagcccagcagagtcctgctcagtgctgcccagagacctggggcaggaagtggaaagaggcccctgatccaggtgcagctcctgctcccggaaccgcctgtgaacgactgtgacctgggcgaatcctgctgcgggcggcctcagctccacactctctctaggatgaatcaggtggagctggcacccagggcgaccccagaggacacacgaggctctcggcattgggtctcagcgttgggtctcttggccgggtctggggggacccctgtggggggtgggagaacatctttttgaacaaacacgtaaacacattgagtctttggtcgcttttgcatcttctttcttctctggcctctgcgccccagctcctttgtgcgaggtcccatgtgctgctaggccacgggtggctgtccagggtgtggcttggagccgtggagctggaggcctgggtgatatggtccaggctgcatgccgactccgggtgtacactgggtactggcggggtcttcctgggccgcctgctcccctgtaaatgggcagtgatacaaccagcttcccagaactcccagaactggatccaggcctgggtgagaaggtgccttgcacagatgtccacacatcatcctcagtgctgggaccatcaagatgctacagtttccaaccagcagctcatcgcgaggacctcgttctaggcactcgcagcagacggaggcaggggtcctccacctccgcttttctgacccctctctcttcaggacaagcctccttggtcatgctccggctggcctttagctgaggtttagctctacgcggacattagaagcacaaaccaagcacagccccttctgtgagtgggagtcatgcctagaaaacaaacaggagagaggcggctcccaacctccaggagatgaaaacctgttcttacaatgcgtgggactcttaccctgacgagctctgcagtccccacagacgcctttgctcaagcccacctgcctcttcccagcaccacccgtgtcttcatctggggagaagagcccgtgctcagttttctccatcagcccgctgcgagggccaggggcccctatgcactcaacatcagcttcacaaagatgtagtgggctgtggggccaggcggcttgctgtacctcccacccaagcccagggccctctcacccagactttggcccagtgcctccctctgtctgtgttgcctctgttccttggagctgtatcttcctcagcctcaatttctctgcccattggtgtctttgttcccgaacctcagcccccaggtcctggttggtggggcttgtgtccgcctcatccagttctggactctttgtgatgatggtaacaataactggactgatccaagttgaagtcagttggtgaatgaatcaataaactccaactgagagctctacacagcacatcctaagtgtcatacagagcactaagtaatttgctttttcatttatacctcacttcattccagaaagatgcatacaagttagcaaagtaaacacatatttaaaaagaggtgacaaaaagaaaacatagggaaaacaagaatgggaaataagttggagcctagaatgaggttagtatgcaaaacccatgacacggacctacttactaggagctggctacggatggggctgtgagctccctagctgccacggggaagagaggaacaggatccacaatgtctatatgacaaaaacagacaatctattttttgaaaatcatagctattcttaaattaaaaaagaaatgttccaggagtcctcacagagatgcgctgaatagaatatgcaccatcctccatgatgtctttatacaacagggcaagggaatgcctagggttgctggcctcaggccaagtaaaaatggctatgcaggagcccagcatggcctgggcatcatgcctgtcaagcctggtgaatcctagggtgggcctgcgagggtttagaagggataaaccacgtcaatattattcttcccaaccaagatttcactggaagttgagctgcagtgagtttaagaaaatggtaagccccccatctctgcacgcagttcataatctaggttgtgagaccacacaccggctcatgtgcacaagacagtgtgcgtggagggtgacagtgtcggcaaaagtgggctcagggctcagagctgtaactgcggttaaggggttaggaagctggccttgggctggatccaggaccccagagtgactcagcctcatggtacagcagagggcacgcccgacaggggaggtcttcgagtcaacaatgggaagtagaaatctgcccaagatgaggggaccagtccgagtggggaggcttccaaagatgagaggaccagtccgacgggggaggcttcctctagaggaaccatgaggacaagtcagagtggaggtaaaaggcctgaaataataactggtcaaggaacatggtctcttcttctgctacttacatgccagagtctctgaaagttcttgatgagaacagtgacacaatgaaagcaaagtcagggaagatgagaaggtggccttgcatcctaactgctgtcagcagagtctgagggcctgaaaacgtccacatgccagggagtccctcagtcctcaggaaggagaaacgtttcatgaaaacgcgaacagtctcggaacgcctcactccgtcacggcagtgtaggctcagatgtgacttgggaagatggcgccactctgcaggacgccgtgtgtggcaaccactcgctctcacccttcgggtctgcggcagctactgtcatatgagctgctctttagagggacagaaatccacaggaccccagtttccacccaaattcatgagccgcagtggccaggctacctcacctcaccctgctgggtctgggcagtccctattctcccataggcataacggggacagtgaaggtgcaaccagcatggacagggccgagggatggaaggaaaacaaacccttgcagttcaacccacagggcggaggcggcagcgtgagaagcttcctgaatacaggactcgatgcctcgaggagaggagcgtggagcacgcccggggcacatggggacacagcagcgctgggaaggcttcgtcctcgggagccggcgctcacatgcagggagtcgcccaggacagcaagcctgggtgtggggctgaggcgggcgcagcctcggggcagtccccacacaagggcaggacggagcctggacggaagctccacgccctggggtacctgctggggcatccagggtttcctgccccaggcccgggtcatggtgtcccccgcaggcctgcaggctgggttcctcacagggcatctgctcaccaagtaagcctggcgtggccagaactgtgtttcttgagttgtttgagccgtttctgttcatgacctacagtaacgccgctgtctctgtgatgctatagggatggtcagtgaggagaccgccgcaaaatgcagactcagaggtgtgcataggtgggctgggcccggggggatagccgcagccagctgtgtactcggaggtgggcaaggagtgaggcggagggggcgtcacctcctccctctcctcctcctcttcctccctcttctcttcctccctcctctccacctcctctctcctctcctttttcacctcctccctctcctcctccctcctctcctttttcacctcctccctgtcctccttctccctctccttcacttcctccctctcctcctccatctcctcctcctccttctcatcttcctccctcctctccctctcctcctccctcctcttcctcttcacctcctccctgtcctccttctccctctcctcttcctccctctcctcctcctccatctcctcctcctccttctcctcttcctccctcctctctcttcttcctcactctcctcctcctccatctcctcctcctcctcctcttcctccctcctctgtctctcctcttcctcactctcctcctcctccctctccttctccctctcctcctccctctccttctccctctcctcctccctctccttctccctctcctctctctccttctccctctcctcctctctctccttctccctctcctcctccctcttcttctccctctcctcctctctcctcctccctacctctccactcccctcctctggtgctgtggctttccctcttttcctcctctcttcctccctcctctgctcctccctcctcctgcctccctctcctccgcctccctctcctcctccctctcctcatgctctctcctccctctcctcctacctttcctcctcctcttcctccctctcctcctccctttcctcctccacttcctcctccctctcctccctctcttcctcctccctctcctcctcctccctctcctcctcctccctctcctcctccatctcctcctccttctccccctcctcctcgctcttctcctcgtccttcctctcctcttcctcttccctctcctcctcctccatcttctccttctcctcctccctctcctcctcttccctctcctcctcttccctctcctcctcctccctacctctccactcccctcctctggtgctgtggctttccctcttttcctcctctcttcctttccctcattttctttctccgcttttcctgttctcttttcaacacttttatcctcagtatcattttctccacacacaattcaattttagagaatgcttgcatttttttcacattcaaacagatccacaaattcttgttagatacacaagaaacacatacaagtggaattggaaacacgcccatgtcggtcgctgagttacagaaggggccatgcactgtgacttcctgatgccagaggacacgcagtgccccacactgctaagctcagggacgcagccttcctgatgccggaggacacgcagtgccccacactgctaagctcagggatgcagccttcttgatgccggaggacacgcagtgccccacactgctaagctcagggacgcagccttcctgatgccggaggacacgcagtgccccacactgctaagctcagggatgcagcaaggctctggcagatcctgcctgtcatgtcctgtcccccggacactatgaaagggcagtcccgctgcatcagggacatgcatgctcctctcacacatgtggattcagagctagggccagaaggtgtgcttaggcacagcagtcattcctgggctgctgacataattcagcgaacttcacatcccagtgggaagggcaggctcgctcatttataatcagtctgcatgcaatgcctacagtaaaactttgaaatagaaatgaaaatttctttattgttatttactttaaaagcactgaaagatccaccagaataagatgtctgctgaaaagctagtttctttcaaccactgctgaggaaaatggtttaatccataatattgatgcataattgacttgtataacattaaaggacctttagaaaaatctttacaccacagcaaaaaaaaaaaaaaaaataccccaattcaaaccaaacgagagcaaaaaccaattcagacaggaaccactgaaggaattaaaagttacagaaccagagtctaaagtgagcacagcaaactccgcggtgacaccagagctccaagaacacacagactccctgttttcctccctggggacaggctaggaagtgaggaaggcaactgaccttctcaaaagccaacgctccgcctgcatggctcaggctgacgactaaacatgtccacgtgaatgcaggcgtcgaatgcccaagtacatgtgaatacaggtgtcgaatgcccacgtaaacatgtacatgtgaatacaggcatcaaatgcccacgtacatgtgattacagttgttgaatgcccacgtaaacatgtccacgtgaatacaggtgttgaatgcccacgtacatgtgaatacaggcatcaaatgcccacgtaaacatgtacacaggtgaatgaatacaggtgttgggtgcccatgtaaacatgtacacgtgaatacaggtatcgaatgcctatgtaaacatgtacatgtgaatacaggtgttggatgcccacatacatgtgcattcaggtgttgaatgtccacataaacatgtacatgtgaatacaggtatcgaatgcctatgtagacatgtacacatgaatacaggcactggatgcccacgtaaacatgtccatgtgaatacatgcactgaacgcccatgtaaacatgtccacctgaatacaggtgccgaatgcccacgtaaacatgtccacgtgaatacgggtgccgaatgcccacataaacatgtccacgtgaatacaggtgccgccgaatgcccacataaacatgtccacgtgaatacaggcgctgaatgcccacatatgcaacaagtcaatgtcttcctatgccactgctctctggacagaccacattctgaaaacaatgatgaagccacacagtgctcagctcaagtcccaggaacttcctgctttatgctggaaacgggccacagcgctcaagcagagctccgctcacagccaggtggccgtgttctctgaggggttgtgccggggtcttcagacagtgccctccctggggtcttgggaccctcaagcaaatgccacctagaagcaaaacctgacttaggtcaccaggtgcaggccttacatatagaggtagtagcgctacattgaggatgctggacacggcttatctcctggaggagggctgcctccttgccatgggagccccgccctggctgccaggcttccctgggcaaggtcagcaaggcatgtgctcggtggaggaggcctaactgttgctactcttggtgacctgaggtgaaaggtcacgtgctggtcgcttgtgctgagcaaggccttgcttctcatctgaccaaagaagaccgtgtttcctgggaccctgcaggctgccagaatgaccgcccacccgctgcccctcaccacacactgctgcactgtgctccacatcctgacaggcagcaggaacccccaaattccctcctcaggccagtgccctccacgttgtccccagcagggcgacggagggtgggggcggcaggctgtctccggtgcttgccttctctgtctaaataacttgcttctcaccctgctgcaggagtctccgaagcacaaaggctgaccctagactctggccaggacgagctggggtgaggggccccggccagaaggatgtcctgatgaggggtcctgagggtctggggaaggcgctgtggcctgaatgctcaccctatggctgggtcacccagggcaccccgaggtcatcagcctgaggaagagtgctgggtgatttcattctccctggttgctgaaaatgagcagtgtgtgtcctcccaagcagggctgggacgccactgataccatcgacgtacaacacgccgcaagcagccctcgaggaatggaaaactctcagactgctgtgtccacacgggttaataaaaatgctgaccccagttcccaaggtccacaatgtccatggagagtaggattttacacacttattgatgaactgctatgagtttttgatgatggcttggctagttgaattctgattcgatactttataattagggctcactagtgacgagcaaaagcccgtgaaactgtctttgtttatgatcccaccacgtatctctactattaaagaattagcctctgggccgtgtgtcctcctggtctacctccagcacaaggacgttcctcagagcaaggcatttgctcgctccccttgctccttacacacggccttcccactcccagctaacacctgaaataggatgggatagtgcacactctgaaggtgaagctttaggtgacgtcgaagcatccagccatatctgtcagtttatataaggggtggcggctgctcagcgaggcctcaggagtgtgaaggaggcttggctggcggaggggccgtgctgctggatcagatggcggaacacggcccagagcaactgaagttcgcttgtccccacaggcagctcgacatggtgcagaccgtggcagccaagtcaggcatacagcagccctcttgctggcttccagtactggctctgcacgccttcaccgtgagaggcccctggacaagggactgccttcctctgtgcctcagtttccctgtttgcacaatggggcttcacccatttcgcagggtggtcacgggtattccctatgttggaatgcatgatggggccacacccagcacggagagagcacttgacactgttgcttgcatgtgcccccgggccaaggtggacgagctctccaaactcgctttctctgcctcatccgtgatgagctgccccgcgggtccccacagatcaatcaggacagaatactcactaaccaaaggtcggtttcacttctctcctcagtgcacacctgaactctcaccacccccaccgaggcagtgggcagcccctgagccaggcagctccaggccaaaccttctctggcctcctgccgctcacggccacaatcaccccacatcctggtccactcacacccacgtcacccacatgcggctccttctagccatgctcactcccctctgcggaacaagacaagggctcccttcgcctggctgtggtagtgcttgcggtcctatggccagagcactgccctgccacagccctgaccccacagcaccaggccttttgatgaaaagtctgtccttcccaggtccacggctgcttttgatttgatatattacacatgggctagtgttattatcatctcctcaaagtggagggtctgctacattaccgcctggacatgtccggaccaaaacatattttcagaataacacacagttaaccctccctgtgccaagttgttgatgtcaagtctctttgaggacagtgcttacaacatgcgtgcccttcttctggtcccagcaaatgcagcaaacaccatcgaatcaggccagactcgaccactgcaatcaattcttctgggtctgctctcagacttcaaggtgagatgaatctgtactaagaaaacttccactttttcaatactatcccagagagcctggttttattgtcatgggttcccatctcatacaagttcgagtatgaagcgtgcagctgggagagctcctggatggtgcatggcggaagcttcctgactgaggacaagctgacccagcttcctcccaggttgctttcttgccctcagtcaaatcgttatttctgcatctttatcaagtcatctgacttcacagtacccaaaacgtatattacttcagcctcaataccctgccccagcctcccagccagctccaaatcacatcccactgctgtcgctgacttctgtggcaaaccacaccccactgactttggcagcagctgtcagccctttctgggctttcaggggtggatgtgaaatgcccacacagcagcttcaggcagatgcccatatgcctgagaagcttcctgcattttcagccaccactgtcctccaagcttgccacagacgggagtaggttcccaggtgcgggcacacaggtatggcctcgcctatgctatctctttcactgtccctagggaatagacctgggctggctttgccaaaggtgtgggtggatttgccctgatggcttacccaggcctcgcctgctctgcacaggaccgtagaccccatgctgaggggcggccacagaggtgtgcagtgcaaagccacagaccaaactgcaagtaatttgttcatgtaagaattcagctcatgagctcagccctggcacaggctccagtcaaccacgctaagtgggtctggactcaggcatccgagaattaatggggccccgggttgggatgcatgcagtgccaggcggaatcggttccagcaggcgtctgggagggccggtttggccccagtatctgaaaacggtgaatcagctctaagggtaggagctgcagcccgccctccacagagggggtccagggcttcttactgatcatccaggcatgggaagctgatcagggtcaacctatgaaatcacacatcccagttatgttgtctataatcttaacagaaacagcagaaataacctgagagagaggagccatctaaaaactcatacatgtataatataccaactgcccccaggggtccctgaaagaacgacgagtgtcggtactccaagaaattatttggaaaatgactacccaagagatgatcacacagcatcgcatcaacattcaggatttctttccagcacaaaaatgcccagtttggaaagaggaatcagaggaaaatggacaatgaaaataaaggctttgctctctttccttaaatagtagaggcgctgggatgacagaatgtgctggctgcttgactcggggagccttgagtgcactcggtgctggctggctaacatggtctgactgtgtccccacccaaatctcatcttgaattgtcccataatccccacatgttgggggagtgacctggtgggaggtaattgcatcacaggggtggataccccatgctgttctcatgatagtgaccgagttctcacaagatctgacggttttatcatgggcttttccccctttgctcggcacttctccttgctgccgccacgtgaagaagaacatgtttgcttccccttctgctgtgattgtaagtttcctgaggcctcctcagccctgcagaactgtgagtccattaaacctctttccttcataaattacccagtcttgggtgtgtctttattagcagcgtgagaacagacgaatacacctgccttggcggtgctgtgacacgtggcctgttactcacgttcccatctgaatatgtaatgcacaatggacactcccatgcacagcacaccgggagggtcctcaccacacagcctgggacatacgtccatccatacctaggaaggttcatcgaacgcatgtctgagcctgatgttcctcggcactgctggcccaagaggagctgacagcccacaatcctgaacattaccttgtgcttatttaatctagtatgaagtcatcttactaagaactccactaattctgagcatgcaggggccagcggagtccatactaaagttgaccgatcctggctataaaaagttctgcaaagaaaagtatggcagtaaacaagattccaggagccctcttgaaacagcagagaagacgccctggcaggaaggcctgtcccacctgtgggtcctggattcagcctcccgccccactcccacttactcggaacagggactttcccatgtggattcgtatgaccctacttttgagtgatttcctccggaggctgttcacatttcatctttgctccaggccctctgaggcttgaacactgccctgttttcattcaagaagaaaagtgaaaccaggaaggcaggtgtctttccagagggctgggaggctggttgaatggaggatattccatctcttactctttcaagcagagcgcagctgctgtcccacaggagtaaattcaggatgagtggctgaaacatttcccacatggttggagtttaagtctctcaaggtagagacactcatggtgtaagtgcagaggaggagaaggaagctgggatgggtgtgtttagttctgcttccagggactattcctaaattctgcttgtgggcagggcacaggcagctcaacgttaggccagggaccaatcttaccacgtggcttctggcccagagcagctcgtgagtcagcctggcctagttggaaaggcaccaactaggtctcaggaggccaagtggggggcctgcccccacctctggggtctcagcatctgcacagtgacggattaggggggcggttcagcagcccctcgaaccttcacccggggctcgtttgctgcttcacactggaggaggtgctcctagcaagatgccgacctgcagcagcgcccacaaggctcagggctgggtccagcctcacctgcaaaagctgtggctgcgggaaccttcctgccctgcaggaaccacctcagcctcagcctcagcgctggagagaaagccctatcccgctcggcctgaccctcctctccacaaagggcttgaagagcaactgacccatgaaacgggcaggggctgggctgatcccatatgaaacgggcaggggctgggctgatcccgtatgaaacgggcaggggctgggctgatcccgtatgaaacgggcaggggctgagctgatcccgtggcagtgcaaaccgagggccccctgggtctcgacatttcaccgcaaaccctgaccccacacccggcctctctgcagctaatggaaggaaatgaacccatcgtgtggggcgacataggggcccagggggcctggacaagtaataaggtcaagatatttttggacttgttcaaatgggtgggcagctgtttctctgaggaaacgcgcccctccccagtggccaggtgagcagtggggctggagaggagagcagagggagccgaggccctctgtccaggcggctgaggtcacgcggtctcttcagtttccatttttccacttgtaacggctgttacagccgctgtttcatcgcgtcgtcataggagttgaacaaagctgtgtgtgtgtttccagaatgttggcacagcggcgagaaggctgaccgaacaccgagaagcagccagcacaggctctccacaggggctctggcatggagcaggataacccgggcccacgtggggacacgccccgccccacaggcttgcaccggggtgcggcctgccctgtctggggcgccaaggccagtggtgtaaatccacactctatggtgacggtggatccacagctgccgcgggtccccccaaccccaaagccactgagtgaaaacagaccacggtgctccaaaacgaaatcgcccccgaggatgaaagggggtggtggaaaaggccttggagcctggggcagggctcagaggggccccaggccggccccactcccagactagagccagcactcgcgggcaggcctccccaggaccagagcgcctgcgacctgcctgggtgccatccgcaaacctggtctctgctgaaatctgaacagtctacactggacagacatggagggaagcttctcccaggaccagggtccctgctttctgcagacggtgggcagagggcagagacggagaccgtgggcacagcacaccaagggggagcctgctcagagatgggcatggggccggcctgggaagcatggcgggaggggagaagaatcgcgatcctttccaggtacacagtctagcagctgccacgcccggctgggagctgagacgcgcagggggcccagctgaagcctgcgttttcccttctgcacaacagcggaggttttcctggagttcataatcactggttttttttgtgtgcgtgttcaccagcctgctcacctgggtagcagggtgggagggccgggtggggatggctgcagggaccccctgggccggctctgggtgctgctgctcccaggagagatggtcccgtgcaagtgccaggcccctgctgtttggcctcctctgccccctgtggggcacgagcgttagccgcactccgagtgcgcgccaagggcttcagctggctgagcgcttttgctgtggggtggatcccaggccctcgggccagccctgcgtggggttctccctgctcacacaaaccacacggggaacggcacaggtaatattaaccaggactagcacctagggccccacaggtaccgttcacgtatcctggctttagtcttgctggttttctcaccagcatttagtgctagttcagtatttatttaaatcaacatgttttgaaaaactgcctaagtatctgaattgttataaagtttaaggaccatgaagtctaagaaggaagattatttattgtacttctgggaaaagcccccagaggtgggctcatttgctgtgatcttcgtcccattcacaaagcactcctgggcactgtcccagctgtggatggcactggaaactgggcttgtccacagcgtgagtcccttgaggctggaagcacagagtggctgtccccaggtagttggtgacggggtgaggaccgggctcgctcccactctcaggagcctcactatggtccccagagatagaggacggtgaggcgctgccggtgagggccacaccaggccacatccgtgcagaaagcaccctctcattgcaatgtgtttggaaacatgaattcatgtggcagcggtaacatttagaagagaaacagccacatttaaaaacgcgtaagactcacagaacctcagcctgctgtggtttcatcatcaggtgggtggcacattccagcggctttggccttgcctgcccagtgcccagagctcagtgcccactgtgggaagtgcagggagcagctctggcacatcccacagtgctgtctgcaccaccgcacacagagtgccagtgtcagctgtaggtcccatggcctgaggaagccactgagcctgggacagcttgaggggcaggaggcggacacaggtgcggcgggggacgcgggggtggctgcccgggaggcggacgcgggtgcggcgggggacgcgggggtggctgcccgggaggcggacgcgggtgcggcgggggacgcgggggtggctgcccgggaggcggacgcgggtgcggcgggggacgcgggggtggctgcccgggactggctcttctggaagcaattcgtgggaaacccacttggatgccacttatgacccccgcgtgccagtggatgcccacaacccctctggggtgtcggggatcaggtgagcaagggggctcatccgtggcctccaggccccaccttgatggaaactgcgacaggagggggtctggcctctgctgggagtgacatctgaagatgccatagaaagtctggcgcagcagccggtgggcctggggggcgcgtggactcccagctgttgctgtgcctgggtcaccccagtgggcagggcgggcagggggcttccccacagtctagggggccaggagagcccctgggcctcacgtcctgcttctctccttgtccttcatgtcttgtaggcgaccccacagagagagaggcagaggagagtggccgtgacctggaggacaaggacatgcatttcacactgaccggggcctccctgggacaccctgaacacctgctctgtgggagacggggtggtgtttgagctggtgccatctgggtcccctggggtggtggctgggtgagcccagccccatctttccctcggacttcatttgtgctcatggctgggggaggcacctgggggccccgtccaagctgccaagggctggggtgggctgttcccctcttggcatctccctcacacctctgcacccccagtggataaaagctgctggcaacatcgacgtccccaagacactgacaggcctggaggtctggacaatggggagccagcaccgggtcccctgggaaccacgcagccggggcctggaggccgacacaagccagacccagcctctctgccattcgcaaatcccagtgttcaaacagagttctgccaaagaagagaagaaccagtaaaaagcagggaagaggctgggcgcggtggctcatgcctgtaatcccagcactttgggaggctgaggcgggcggatcacgaggtcaggagatcgagatcatcccggctaacatggtgaaactccgtctctactaaaagtacaaaaaagtagccaggtgtggtagcatgagcctgtagtcccagctactggggaggctgaggcaggagattcacttgaacctgggaggcggaggttgcagtgagctgagattgcaccactgcactccagcctgggaaacagaatgagactccatctcaaaaaaaaaaaaaaaaaagaaagtacaggaagctttcagcctccttggcaagacactgctgtctggagaccctgggagaagtgtgccatcaaccaacgtgaccagaacccatcctggtttagggaggagctctccacaggcctccacggggctggagcagtccccaagctccaaagagtcccccacgacctcttagtcgtcacccctaggaagggcctagaaggcagatttcccaccatgagaagccacatggagcccagctcccaggcatgcagccctgctgggctatgcggggaagatgtgtgctctgaaggcctctggggccacccaactgccatgcaggaggcctccggggccaccccactgccacgcgggaggcctcgggggccacatctccgccataggggaggcttctggggccagccctctgccacacgtgaggctgccggcccacttctctgccatgtgggaggcagccggggccacatctctgctatgctggaggccgctggaaccacctctccaatgctggggatagctccctggagccatctcctttctcacagaggcgaaacccacaccttccccaaggaacggagctcacgccccttcctgcctccatttcccaagctgtcaccgtaacagtcactacaggacagtcagaatggtaggatttgagctaaattgctagaattagagagcgtcacaaaaattctaggaggtcagcaactttaggtaatgcccacacctgatgggggaaatcactgtcttccggcgggctggtcctctttggtgacagatgaagtcagatgcttccgggatgaatttggttcacctttgaaggacactttgaaagcaacacaacaaaactggctgggccttgtactctccgctccctcgagaagctccccgcccggtgccgctggcttctactgtttctaagctgcctgttgggcacgttccctcctggtggtcccggggcagccagacccaccctgggacatccaggccccctgggcacagacatcttgtacaaggtcagagagactgggtttcgggcttcatgagcctcagaaattcagctctcaggaggctcgtgggaggcctccagggtcaggtctctgccggagagaaaaggggcggcctgggcttctcttcaaaagtgttacctgacaacaagggaattcagccacacaccaggtggctccgtggtcccctgaggtccccagcctttgacagtgtgtgtgtatgtggtgtgtggtgtgaaatgtgggtgtgatatgtgtgtgtggtatgtgtgcatgtatgtgtgtgggggtatgtgtgtgtggtgtgtgtggtatggtgtgtgtgtctgtggggtacatgtgtggtgtgtgtggggtatatgtgtggtgtgtgtgtatatggtatgtgtgtggtgtgtgtgtgatgtgtgtagtatgtggtatgtttgtgtgtgtagtatatgtggtgtgatgtgtatgtggtgtgtgtagtatgtgtgcaggtatgtgtgtggtatgtgtggtgctgtgtgtgtggtatgttgtgtgtgtatggtatgtggtgtgtgtgtggtggtgacatgtgcgtatggtggtgtgtgtgtggtgggggtgtgtgtggtgtttgtgtggtgtgaatgtgtgtgtggtgggggtgtgtgtggtgtttgtgtggtgtgaatgtgtggtgtgtgtgtgtggtgtgtgtggtggtgacatgtgtgtatggtggtgtgtgtgtggtgtgtgtgtggtgggggtgtgtgtggtgtgaatgtggtgtgtgtggtgtgtgtatggtggtgtgtgtgtgtggtgcgtggggtggtgacgtgtgtgtatggtggtgtgtgtgtgtgtctgtggtgggggtgtgtgtgtggtgtttgtgtggtgtgaatgtgtgtggtgtgtgtatggtggtgtgtgtgtgtggtgcgggggtggcaggatgtcattaacttggttctaaaggtggtttgggttcaggtcctggagtacatgctcaggaactgtcaagcaatctgggggcacaggaaggagaccgggcgctcctgcaggtattaaatcgtgttttgcgtgaagatcagcgttcagaccagtagtacaaaacagatggtctaggaatgaacgtgacaacacaagggcctggagtgtatgacgaagggggcatttcaaacccgtgggtacagaaaaaatccacccgataaacacaagtgggaaattgtgtaagaaaatgaagtgagattccaatattaaaaagtcagataggtcaaaatctaaataataaacaatttaccataagataattagaagaaaatataaaatactttttaatcttgggttcaagttgtcacaaaacctaagctattttttttaatccagaagtattaaaagtttgctatttcctatagacaaatagctcctacaacttggtgaggaaacagggtccaggagcattttctctgctcgggtgaagctcaggggaagacataagtacatgaaagacattccgttctgtaatgattaaaaaatcaaaagttaacaccatcacattggtaaacgttaaaaggtttaataactttttttaatatactgctgttgcacatgcaaactgataaagcctttttggaaagtaatttggcaataaaaatgcacatactttatgagcaaaaaaaatcccgtttcttataatctaattgataagaattatagcataagtgcatgtatgtgtatgagaacagtcactctggcatcgcctgcaacagcaaataaatgagtggcaaacaagctctcgcggagggtatttaaatattttatgtgactaagaagaatgagatacgtccatttgctgtgataagaaaagatattccacagtttcgtatttgttaagtattttcagcaaatcatggaacacgatgcaacacccgattccatgtttgaaaacagaacagaacaaaattcaacaagaaataagcgcccgcgtccacatattctcgtgcctggcgtgttttacgtgcttgggaagcggagcggccgctgggcttggctctgaggtcgggactggtgcaggcggatgcatgtatgtgcccgggtcccgcctccacacgcctgcctggcgccagcctgcctgtcctccctgcacccgcccccgctccctgcacccacctgccccccctccctgcacccgccccccctccctgcacccacctgccctactcagggtggtgagagcggaggggctctggggcttcatccacacgtctcctagtcaccctctcgaccaagagcatcctctggattttacattcacttggcaacaaaaaaagtttgagagaggactttgaacatcaaaaatgcttacatttgttatgtcacaaacacaaagcgttctcctaggaggtttctggtacagaccatgtttcctgaggacctggagggtatcgcacctacagccagcaacgccgtgcagcacgctcggagcgcacccaagagggcagatcagaggggcgcacgcggatccccaaaatcctgaagatatgtacggaaaatatgtgcggcttttcctgccgaccaggcctccacgaagtgcttcgataaaataaaaccagcctgtcatggaggagtcccctttgcccggagagcctgtccttcccctctgggggtcacactgccagtttgtcaaagttgggcgaagtggcccctgcctggaactctctggccttatgaagccccctccccgttcatgccgctcaatcgagtgactcttacagatcatcttgagctgcctcatggggtggggctcgcgttcccatctgccttctgcaaggtgtggcctctgacctgcagcccgcactgagccagcaagccgcgggagaggccaggcgcccgcagcggggcatctgcgcctggtgtgcagcgtacttgctatactcaggccagcccagccctgggccatctccctgagtttcagctccccggggccacctctcctgggtcccctctttgctgtggctctggcggacattagccagcagtggagagaagcccatctccacccccagggagctcagccgaggtctccgcgtcccagcaccagctgccttcagctcgagggtgtgttttcgggggtggggatcccacatggcacggctcctgcacgtccagggcatctgctagtcgtctttgcctgctccccagtgtcccaagcaactcagtaggaccttggggaagctgggtgctcacagaacaccttgtaagcgaatgaggaaagcaggcttgtccgctggccacactgcacgacagacgtctgcccaggctggggccgggggtctctgctcctacagcccgcagatgggccacccggaggctgccccgtgatggctggacctgaggctttccagtgactaggagggcttgggtacttcttattcatgagctgtacgttctacagcgtggctggtcatttaatgtgtgcaatcgatgggcactgcgcttcaacttcaaagcatgaccgggcggatcaatctcccagggccgcgggtgccgagtttaaaactcatctctttttctaaagtggaggcaagggaccccagtttgggattaatcagcagtgatgagcttaaataaatgagataaattttctatctatcttgtaaggctttttttcagaattaatgggacccctctacaatgcgctgtgcccggggagaggaagggggcgcagctgcatctgcagctgcggttgtggtcgggagaatgagggcctggagctgcccaggacgggctcaggcacaggcacccagccgagagtcccctgctgttccctctgcagagcaaacacagtttctgctgaaaagaatgtggcagatgaacaaaaattgtaaggttttctaaaggtgtttcattacgtgagatggcagaggttggtctccatgtcacagatgaccctcgcggcggtgataacctttacattttggggtgctctgtggaccccctgtgtaccctgtgagtatgcacgtttctagaggtggagtttgacccttgaattgttcaaattataagtagaatcacagaaattgggggaggaaaggatctgaggggcctccagggcccgtggcttcaccctggggtgggggcaagggcggggcgtggtgcctcttccggggtgggatgggtggatgctcgtggttcattcccacgtgggattctcacatgctcgccctccggctgtcaggagcaatggtgagttctgccacacgtggaaaacacgttggcttctctgggttttaagtgtcctgtcagcagctcggagcctctaggagacaccgtcccccagggccacgtatagatccactggaggcctgaatggcataattcgtggcacccctggcaccacacaggggtgtttctgtccccttctcctcccatggcttagaagcagtaatctcctgacctccaggcagaagtcaatttcctcctttgcctcctccgccttgcagggaccccagggctgacctgcctccctcggccccctctctgccagagccaggtctgaggtcaaggctttcggtgtttctgaggccacgctgagggccccacagccccttcccgggtccccaccctccaggccaccttcgggcctcggcagcacacctcgaggggcccaggacaagctcggggcccaggtggccgggagggggccgcctgtgtctcgcccctcattctctgctctgacccgggctcgcacctcccctcgttctctgctctgacccgggctcgcacctctcctcgttctctgccctgacccgggatcacacctccgacccgggctcacacctcccctcgttctctgctccgacccgggctcacacctcccctcgttctctgctccgacccgggctcacacctcccctcgttctctgctctgacccgggctcacacctccctgctccacccaggctgcctgcacttccggttctgcgtctggccggcctacgggcactcgggcagtgcggtgaccaattatagcgtcgacgatggcagcttccctctgaaagcccattgtgtctgcccctattctttgaagcttcactgctttcggataagtatgaaaataggctctccctctctgagtcaaaggaggcaattatacaataggactatcaccctcactgtcactctccgctttgtttaaatgtggggatttcatttcttcatcgcctctgtgaacacccactaaaaccgtaagtgggaaaagtgggtgccttctgtattttacattttttattgtgtcacttactgcaaagcagctcaaggagcctgaagacacccagcctgaaaccacgataaatgtgtggagttgtggagacagctcaccagcagaacagtgagctaccttctctcccagtaaccttttccagaggaaacctctttgaaatatcacaagcaaaatttaaatcacaaaatacttcatatctgcctgcactcattgtcatgctaaagcacatcacctcggtcctcagagaggagggatttccatgtgaaagaggccagagtgcttccctcacttagcggggatgcaattataaagtattgaaacttcctctaagacatggatccctgtgcgtcgcagcccctcacctgtgcacctgggaggcacctggggatggggtgggggtgtcaagcttgaagcccctcacctgtgcacctgggaggctcctggggctcaagctcaaagccccctcacctgtgcatctaggaggcacttcggcggggtcgggggcggggggggctcaagctaaaagcccctcacctgtgcacctgggtggcacctgggagggggactcaagctcaaagccccctcacctgtgcatctagggggcactttggcaggagggagggtgctcaaactaaaagcccctcacctatgcacctgggaggcccccaggagctgcagcaaagctgggccccagccacagcctgcaaaatctccgactccacatggggcctcagcaccgtctgtttgctcaccctccccagggggctgaggctgggaaccactgctctttaactctcaacctcttcccaaggtgctgtctatctgtggcccttggagttctgtactcggcagtcatttatttacaagtcgcatgagaaagtccttccagccactttctgtgcttgctctgacatttgcccaaactaacgttgctgaggttgacctcatgtttattcagggaacttgattcattttcaagctattgataacaacaaagtcctccccaaccaaggaacttccgccatggaggcgttttcaaaagaaagtgcttgtgctcatccccagagggttcctgagcctgtggacgaggcgggaggcgggaggtggaggaggtggcacctggcagctcacctggtgtaccttctgtgagacccagccagcccatcggtcaccaaggggtgcatgtcacaccctgacctgcctgacggagggagcccatgaagcagaacaaacacatgtgatgctgacgccctcagaaacctggggctaaggccacacctgatcaccgtgatggaggggggcaggcgccgaggcgaacttgggagaggccctatggtgcacacccctacccttcctggctggagaaaaatggcccgccccgtgaaacagcaaataaacacacgcgttccaggacgtgagatacggcctccacatcaatcagagggacctgcccagtcctgtcaattttccatctaaattacataactgtcctccttagagacgcggggatgcccaggcacaggcatgaaagatcggccttgaggttattttgtctctgcaagtattgatgcgaggacttgtggcgcttttctttcccggtgaactttcccaactgctgatgttacgtgcactaagcacatgattttcctattcattcccgaatctcacattttaccgggatggtgacatccctgtggggccttgtgggctctgagctcatctacacccaatcctagtcagctctgctgcccctgcggggtaaactggcagctctgagttcactgggtgctgtttactgaacgcctgcccatggaagccactgtcctcatcactgggaaaggcgcagagaagagaaggaaacgttaaaaatctggttggagagaggaaacaaacttggaccatctttgacagtggtattagtccattctccatggctacaaagaaacacctgagactggatgattctaggaaagaggcttaatcggctcagagctctgcaggttgcacagggagcacggcagcttctgcttctggggaggcctcagggagcttccagtcacggtggaaggcgaaagggaagcaatctcgtcccacggtgggcgtaggcgcaaggtgggaggggctacccaggtttaaacacacgggtctcagaaaactcactatcatgagaacagcaaggagagggtggtgcaaaaccattcaaaaatcacccccaagtccagtcaccaccccccaggccccacacccaacactggggattacggttcgacaggagattttggggcacactgatccaaccatctcaacagcaaagagtgatctgcctcgagttccgactcgccgctcagacgaactcacggctcagctgggagaatcacacgggaggggcccatgaacgggcactggggccacagccggggattcaactgcaccgaaatcccagccctcaacacggcccacggctgtgtcatcccggatttatcactataaagcaaaaccaaaaacggacctcaggtttctctgcaatatgtaggatccgtgaaacctccaacgtgaaatgagaagtaggtagcctcgaatctgcacccaggcagccccaaaggctatctgatgacaacacacattttctcatgaagcggaggagagtccggccttgttgctgggcctgcaggacatcccatcgctcatcttaattctcctgagggtgatatttacacctgatatttacaaggtgtggcaagtgagaatttcatcccagcctcctgcctggcaggttacacaagctggccacagggatgcttatgggctgaggtcgtgggaggcatcccgtgagggtcacaggctgaggtcgtgggaggcatcccgtgagggtcacacaggcaaagactgtcagccaaaaggaattccaaggcccggacgggaggcggccacaggctcctgggtgtgctgtgggacgtaccactcggtggcagggcctggccagagagctgccctgcaggcctgtgggatccttcaacgcgaagcttgcattccaggagctccctgagccctgagaccatggtgaggggctgcgttgggccaggctgggtgtgcacctgtcagttacattttcctatgtgtcctccttcctttctttggagcctgaatctttgtctttagcatcctttgtagtcttgaattctgagcccattcctgagacccctctgaacctccagaggccccgcagctctcaagctggaggactggggactatgctcatctttcctttgaccccaggtctgtcttcctacatttctttaacgattatttctctgggccaggcgtcgtggctcatgcctgtaatcccggcactttgggaggctgaggcgggtggatcacctgaggtcaggagttcgagaccagtctgtccaatatggtgaaatcccgtctctactaaaaatacaaaaattagctgggtgtggtggcgcacgcctgtaatccaagctgctcgggagactgaggcaggagaatcgtttgaacctgggaggcggaggttgcagtgagctgagatcgtgccactgcactccagcctcggtgacagagcgagactcagtcctaaaaaaataaataaaaataaaaatagaaaagaattatttctctaccttttggaatgtgaaattgcctctgagacgaacctgtgatttgtcacctctgggagatgacaaggatgcctctgtgacctttgtccccatgctaaatattttgtcaccatgctggctttcttgtttgcatcagtaacagaccggccatttctcccatttggctgtacagtcgttagcagtggcccctccacacacacagacacacacggacacacacagacacacacatggacacacacggacacacacacacacgtcgcttctggtctgagaatgtctgcctcctttccattcccctgggcaggttattttcttctcctaatcacaaaacccatccttcatcttaataattctcctgagagcgatatttacaccctataattagaactttatgttcgttttattaattacctcttttttgcctattgatgtgaaagaatctggggctaaaagtattacagatggctctacacattgaaccgttgatatttaaactcaatcagcagatgctggtgctgtggggtggggtggggcagggtgggcgtcccaccggctcctcaggccttcctccacatcccatcggctccactcagggactccacttcttctcagcacctgtgccctccagtccctctcccaggaaggcagcaggagaggagacccccgtgccatcttcaataccacccctgtgactagggtgctgccccctcctcctttcttctccaacttctagatttggcccctaaatgtgactgaataacgtggcaagcccttcagacatgacaaccccatcgggtcagagaggtagtggttgcagctgggcctggcccaccatcggggtggggccagcaggagcaggagcacgctgtgtgctcgtggggaggaagggctgggtgaggctggagcgtgggtgggaggtgctggacagggatgctgagggcaacgggccctccctgcaccgaggcttcagcagccctgctctctgctgtcagcctcggatccgggctggcctggccttcatctctccccaggctccaaagaccccacatcgccatctcttgccgtgagacctccccacgctgaacgtgtgttcctctagccacttactcaacgtctccactgcaggccccagtgtaacttggccaagcagacatttcattttccccaccagagcagacccagcccagggctccctcctcaccttgggacctacagcaggtcctgccccagctccatgtgcgggtccctcatctgactcgcacactgcccctccgactggcccagggcctccactccagcgtgtgctcctcaggcccagtgttctgagcgtggagtgaactttctaagtcacaatttaagtcacatccctctccctctggaaatgtctgctggctttgcacccaccaaggacaagatccacagccttcaacacacggcatcacgaaccacctcccgagccggccccctccatccctcagagtcaccacaatcggcctaccccgtccctcagaggcaccacagccggccccctccatccctcagaggcaccacagccggccccctccatccctcagaggcaccacagccggccccctccatccctcagaggcaccacagccggccccctccatccctcagaggcaccacagccggcctcctttgtccctcagaggtaccacagccggcctcccccatacctcagaggcaccacaggcagcctcctctgtccctcagaggcaccacagccggcctcccccatcccttagaggtaccacaggcagcctcctccatccctgaggcaccacaggcggcctcctccatccctcagaggcaccacaggcggcctccccatccctcagaggtaccacagatgccctcctccatccctcagaggcaccacagccagcctgcgtggcctctgtgtttctccccggggtctttccaggctgggcttcttctcgtcctaacgctcagaggcctctgcttagccccaccttccatcactgtgccctcttctcctttcttcacatcacaccttactagaaattacccggtcactatagtgcctgtcccttctccgcgacaaggggacccctagcgtgcttccccgctgcgctcccagctcctacaacagtgtctggcccctcaaagcgactcaacgaccctctgctgatccaaagactcggcatccatgtgcctcccaggccgccgcactcctcctcctgggaacaccctcgtacggacgttctgtggaaatagatgttgtgttttcacctcttgtaccttgttcacttaaaatttaatcaacatcttattagagaaagaaagaggttctttgctttttttaacttttaaaatatgaatacctgccgggtgcggtggctcaggcctgtaatcccagcactttgggaggccgaggcgggcggatcacgaggtcaggagatcgagaccatcctggccaacacggtgaaaccccgtctctactaaaaatacaaaaaaccagccgggtgtggtggcgggcacctgtagtcccagctactcaggaggctgaggcaggagaatggcgtgaacccgggaggcggagcttgcagtgagccgagatcgcaccactgcactccagcctgggcaacagagagagactccgtttcaaaaaaaatatatatatacatatatatatatacacacacatatatatacacacatatacatatacacacacatatatatacacatatatatacacatatatacacatatatatacacatatatatacacacacacacacatatatatatgcacatatatatgaatacccaatacccaatccacagctttctctttgtggtgcttatgtggtgtcacaatgcgtcttgtgcctctcatctgattccgctacacggtgcaagttacgccagaccagaaactgaaccgacgctgaaagtatcaggccttccgcttagcgctgccttcgagatcagtctctcgacccctgttaggagcaacggcggtgaggcaggatgaacggcctcatccacggagcactgctttgccgtctccagaaagagctgtcgaggtttatttattcacggagaggctctgcatcacgagagtgctgcgttaacccaggtgcgggggatattatcctccccgtgagagcagctgcatggatttttttaatgtcaaattccatatgaaacagcacaaatccccatttctgccccactgggttgagaaatctgtgggtgatagagtataggtaaaaacatcttagcctgcatgaaaacaaacatcatcttagaagaaggaaagagcaaatgttttaaaggcctaaaaataataattttctctagggaaaaatttgatgggcacgctatgatttattgccaaatgatatttaagaaaaattcacaggagaggcggctgctgaatgcctccaccgagggttctgggaaggaaaacgcccgcttagtggaagaacagaacggccgcacagaaagtgcttggtccttggcttcctgtgtctcccccaaaacacacgtggcttatcagaaacctgcaggaaaacaacacagatttattctctcacaggaggccacggtccagatgggtttcactgagctgaagtcagggcttgggtgggccgcacgctctggggcggctcctgaccttttctggcttgtggcacctggctggacttctcggcgtgcagctccttcgtccaccgtgaaacccgccccggcgtccctctccgactccgcttccttcatgggacttcacttccgtgtgctaagaacgtgtagcgaggcccaccgtgttgacacttccctgagtgtgcagcgtggtactgttggctctcaaccgtacggcagatgtcgagaccgcgttgaggccgcgtcgctgaaaccttgtgcccttggaacggccccttcccgtgcttcccccagcgccagacccggcagcctccatcctcctctcttcttcggtgcgttcaattgtcatagattccacgcttcagcgacgtcgtgcagcctctgtcctgggcctggcttttgtttcacttcacgtcatgtcatgcaggtttatccctgttgttgcagatggcaggttgtccgtcttgtcttaaggctgaagagcacccactgggtctatgcaccacgctttcctgcccgctcgtccctgggggacatgtgcttccatgtcttggctcctgtgaacaatgccgtgatgaactccggagcgcacccgtcacttcgaggtcctgatttaacttcctttggataaatatctggaagtgggattgctgaatcatatggtggctctatttttaattttttgagaaaacttcatactgttttccataatggttgcaccatttatattcccaccaacagcatgtaagtgttcagagtctacacatcctcaccaacacacgtctttttggtcacagcctcctgatgggtacagagacgtatctcatcgtggctctgatttgcatgttcctgatcattagtgatgttgagcatctttccatgtacagtgtgttggccatttgtatgccttctttggagaaatgtctactaaagtcctttgcccatttttaaatcaggttatcattattatttgctattgaattgtaggaagtccctatacattttattttattattattactttttggagatggagtcttgctctgtcatccaggctggaatgcagtggcaccatctcggctcactgcaacctccacctcccagattcaagtgattctcctgcctcagcctcccaagtagctgggattacgggtgcccgccatcacacccagctaatttttgtatttttagtagagacagggttttgccatgttagccaggctggtctcgaactcctgaccttaagtgatccacccacctttgcctcccaaagtgctgggattataggtgtgagccaccacacccagccacctatacattttaaatattaactccttatccgttatgtggtatgcaaatatttcctccccggtgaccagtaggggatgcagagaccacacacccaccactcaccctacctttcgtgggctgccctctggatttgctgattgtttccctgctgatgcaggagctcactggtttgatgttgtcctgcatgttcacatttgcttctgttgcttgtgcctttggtgtcagatccaagaaacctttgcctagatgaatgtcatcatgcttcccccgtgttttcttctagtacgtttatggtttccagtcttatgtctcagtctttagcccatgttgagtgggtttttgtggatgtgaggtgagggtccgatgccgttcttttgcatgtggacatccagtttccccagcacctgtgaagaggcgacccttccctatggtgtattctcctcatgcttatgaaggagcacttggcagtgtatgagttgtttctggactctctgttccattgatctataagtctgtttttatgccagtagtgtattgttttaataaccatagctttgtaatatattttggaattgggaactgttgcatgattttttgtggagctctgggcaggtttttcatgatggcaaaatatgtcaacttttctttttggtgtaatttcttcattgctaacattttccctagacagtgaaataataaacattttctaaaagttcctcaagaaaaactattgaaattatttagtagaaacatatgcaagagtagataatattgatgtatccttattatatttagaagttaaaattaaagaggatcttatgggaaatttaaaaattgcacagtaagggattccttaagaaacaggcgcaagcccttatttcgtagcatctaattcctcaccgggtgtggaggggcctgtttacccaatgcccccgcgaagtcatagtttggtggcatacagctcttaagaatgcttattagctcttaatatcagagaggattaacctcctacttcatgaaacaatttgctaaggctgggaatttttcttccatgtctgtgaggactgccttcccttctttccacacacttcttcattcgttgtgtacctgctgagcactcatgatatgtcagaccaagttctagggactgcagtggtgaacaactccagtgtctgtgcacggagcttccattctgtaaccatgcagctgctccagagaatgccaaggtcccagccaaaaagctctagatgattctagactgtgcacggagcttccattctgtaactgcagctgctccagagaatgccaaggtcccagccaaatagctctagatgaggggtgacacataaggtgaggacccacgcgtgcacacacatacacacacttgcacacacatgcacacagtctcccctctgacccttctcgccctactgggtgaccagtaggtgatgcagagaccacccacccaccattcagcaagatctgacaccttctgactcttgacagatgatttctgcagacagatccgatgtcatcttcctcccagccccccttctcccagtcctgcctcttcccaccctgcaggtctaggcctcactcacgagagaaggctggttttatccactgtgtgtggagcctggcaacaagcatcccacattggtgtgatccaggttaccctctcgccatgcagtgccctcactgcccttgctgcccctgagctctcagagggatgcgctgcctcagcgtggggtgggagtgccgctctgcacactagactcagtcctctctctgcctggaaatacccacaaaggccacaggatacagataatagctgtactggtgctctcagacacattttccatgaaaagaagaaaatagcaaattccagtaagcattaaggaaactccttctctgggagtctctgttcctctcccccacagtgcttcttatactgtgcatttgaaaggtgttttaaaaggacttgttgtttctttaagaagcatagaaaaaatatatatactcctgtgtgtgtgtgtgtgtgtgtgtgtgtgcgtgtgcaaatacatcatcaactgaaggtctgaagaaaagggaaaagatcgcagctcatcaggaatgaaaggtggcttgttctccagcatcctagttaaaagttcaaagcacatttttcttataaattaggctggagtaaaattcagggagatgggaaaaggaagacataaatttttaaaacatgcgaagaatttaaatgagcaccaggggtgaaaattagacacatagaacatgtattcgacgtaaactcccggttgtttaaagtcattaacgttgtgtcgttatgtctagtgtcaggttatggctccacagcctgtttgccagttaagcggtgggggcagggcaggccttggtcaatatttgagtaaaagaagaatcttaataaacccaagaaagtaacttcaataataagaccaggcagtgttttgcaaagcagaacagaagcaattcaaaagggagagagacacagccagaggccccaggagcccccaccttggggacatggagtgtctgtgtgagcctggctttgttctgaggcaggagggacccgagtgcttggggccagccctgtcctgttctgcgttagcgatggggtctggtgcttctccacacacaccgtggctgtgtgtgcaccggctgggtgacggcccaggtggttttgtgccagctgctgatgctgagtgcacctgaaaggcccacttagcctctttgtgaagaggtgtgggaagatgtgcacacagtagagagcagactatcacaagccacaaaaatgtgtgtgtgtgtaatatatataaaggtcgaccattccttatctgaagtgattggaaccagaagtgtctcaaattttgcattttagaatatttacatcacacttactggttgagcatcccaaatacaaaaatctgaaatccaagatgctccaaatcagcattttcctttagggtcaggcctatgctcaaaaagttttcgatttgggggcattttgggttttagatctgggatgctcaacctgtaggtgcatgtatatatgtgtatatatgtatatctacatatgtattcatgcatgtgtacaaaaatatgcacatatgtacatacagatgtatctgtatatatgtatatgtgtgcatgtatgtgtgcatatgtgtctatagatgtctggtatatatgtatatgtgcaggtgtaaatgtgtgcaatagatgcatatacgtgtatatgtgtgtatgtatgtatacatagatgcatatgtgtgtatacatgtatatgcgtgtacatctgtgtgcccataaagatatatgcatgtgtatgtgcatacgcatgtatgtgtgtgtgtgtgtacatcttctgtctctgcattcttactggcaggattattgggaactattggatctttctgaggaggccaggatgatttccgtggcctgccagtttctcagagctatctgggttgaggcactgagaaccccctcagtccaggcagaccacggcccggtggtctgcatgaacaaagtgagtacttggagggccactggcatgggcccagcttcccgctctcctctgcatgcacagcctctatcccatcagacctgcacctcagcagcaccaagctcaggggctgccctgggctcccctctgagcatcagctcctctgttccagggagagcctctgctcccctcagggcccacctccttctagcagaaagctgattcttccccagactgggccctcagttctctgctaggtttggccaggctggtgtctttgacatgatcttctgggaggagaggcagaaatggggcccttccgatgtagctggcaaagctgtaggtgaacggtttgtaccaccagggaactgtgcccgagaacacatatgttcccacaacaatggggtttgtcagcttgcaggtgcccagccctttccgtgccctcttgagatgggttggggcagacagagtaggaatgcttcctggctgattacaaggaaatcccggcccattggatggggaagccacaagacggctgcttggagagatggtgctgcacacacatggcagccagaacgagtgtgggttcagagagcaggaatagcactccctgcccttgtcatgctgtggccaaggtttaggactccacagggcccagatgtctcctctggtcccaggaggatggagcctcagacctggggccatggggagggaagaggtgttccttgggacaagcaggagcccagtgggcagatgcctttctgcacagccaggggactgctcctatttctactgtttgcctggcccaattcatcacaggagggtgagggcagggctgcatgcctgagagctgacaaatccttcacatcctggagctttgtactgaacactgcagggttccatacagctgtcagctgcagagactaggcaccgcccctgcaaatgcctggcctcctgctgtccagctgccttcactctggcccggaagtggttctggggacagtggcttccttccagggcagaagctgagatccagtgtctgtggagcctctcatggcacgtcaggctctgggatggatgtttacgtgggttaccctaccaaatccctgagaactgctgctatgattcccactttacagatgagaaaactgaggcttagaacattaagcactgtgagctgagatcattggctagtgagcagcagagctgaggtccaactccaagtgtgtttgcccccaaactcacactctgtaaaagtccatgggcatcccagatctcccacccatgtcttcccactggaccaggcatccccagcctctgggccacggactgacaccagtctgtggcctgttaggaactggggtgcacagcaggaggtgagtggtgggtgagtgagctgttgagtggccggtgagtggtgggtgagtgagcaggtgagtggcaggtaggtgagtgggtgagtggcgggagagtgagctgttgagtggccggtgagtggtgggtgagtgagtacgtgagtggcaggtaagcgggtgagtggcgggtgagtgagcgagtgaaactttgtcggtatttatagccagtccccatggctcacagtactgcctgggctccacctcctgtcagctcagcagtggcatcagattctcataggagcttgagccctgttgtgaactgtgcatgtgagggatccaggttgcacgctccttatgaaaatctaatgcctgatgatctgtcactgtctcccatcacccccagatgggaccagccagttgcaggaaaacaagctcagggcacccactgattctacatgatggtgggttttataattatttaattatatattacaatgtaataataacacaaattaagtgcacagtaaatgtaatgcgtttgaatcatcctgaaaccttcccccaaccttggtccatggaaaaaccgtcttccatggaacaggtccctggtgccaaaaagagtatggaccgctgtcctggacaaaccctgggcctggaattgaccttgttgaaaacactcttttggattaagcatctataagattcagttgttgccttggacgattcacatttcacatggtcagtccctgcagcacctcccgaagtgtggtgtgtcacttgcttttatgtggaatgtgggcagttcttaaaactttattttaatgcacacgttcagtccctgcagcacctcccgaagtgtgctgtgtcacttgcttttatgtggaatgtgggcaatttttaaaactttattttaatgtgcacgagaaaaagcaaaatagtacatcaaaaacatgaattttgtgggtactgttgcttaggataagtaagaaggtttcgaaagctgagtcagtccaaagaggaacgtgttgcgacaagccagatgccttatggagccaggaggctgtgactctggccctggagggggctcagccctgagcgaggtgtggaaggagcccggcaccacccctgccgtgtgagctcccacgtaggcccagggttggatgagatgacaccgaggctgtggagccaggaggctgtgactctggccctggagggggctcagccctgagcgaggtgtggaaggagccccgcgccacccccgccgtgtgagctcccgcgtaggcccagggttggatgagatgacaccaaggcactgtggcgagcagaaccgtttccccaaaaagacacgttcaactcctaacaccagcacagtgaatgccgccttctggacatagggtctctgtggatggagttagtaaagatgaggcccttatccagtacggccggcatccttctaagaagagacagcacagacacgccccgaggacggagacggaacggagtgaggcgtctacctgccaaggagcccccggcattgccaggagccacagagagtcgcccgagagcttcctgagcacgtggccctgacaacacctggatctccagcttccggcccgcggtcccgtcagacaattcatttctgtggtttgaagccacccagtttgtggcactttgaccccaggatcctcacaggaaaccgtctcactggcccagtcctgctgggccctgcccatgggatggacttgctgtccttgaacaggaggcaggttcggggaacaggactgtaatgggtcatggaaaataccaggctgatggcagagggtgcgtggggaggagatcagggaaccgccaggccggagctggaagccggggccaccgtccaactcacgagggctcggcagagaggacaggggagcttcccctgctggctgaagtgggtggaggcgaacctggcccacaacaccctgagcttctgcggagccatgtgagggccacgtggagaacactgcagttccaccttcatcagataaagccaaccgttgttgtttaagcaaaggctgcggacagtgagcacagaacttcacaacacatcatggtcgcagcgcaccatcccccgtgatcccaaagcagcgatctagacgtgtggggtccacaggcgggcgccctggcactgggggctctgcaacttgacgaggctatgccaggctgggctagaggtgccgtgctgggcacaggctctccacgggatggcgggactgctgggcacaggctctccacggggacggcggggctgctgggcacaggctctccacggggacagcggggctgctgggcacagggtctccatggggacggcgggactgctgggagctgggttctccacggggacggggacggcgggactgctgggggctgggctctccatggggacagggacggggacggcgggactgctgggggctgggctctccatggggacggggacgggaacggcgggactgctgggggctgggctcttcacggggacggcgggacttctgggggctggctctccacggggacggcgggactgctggaggctggctctccacggggacggcgggactgctgggcacaggctctccacaaggacggcaggactgctgggcacaggctttccacggggacggcgggactgctggggtctgtgctcctcaccccagggctcacgcttttccatgagaccctccccagccacatcgggggctctgaagactgagcactgagggtcagcagcaggtaggagatgtctttgaagtttcatctgttatcttaaaaactcgtggatttttggggcggggcgctgtggctcatgcctgtaatcctagcactttgggaggccaaggcaggcggatcacgaagtcaggagatcgagaccatcctggctaacacagtgaaaccccatctctactaaaaacacaaaaaattagccgggcgtggtggcgggcacctgtagtcccagctactcgggaggctgaggcaggagaatggcatgaacccgggaggtggagcttgcagtgagcggagatcgcaccactataccccagcctggatgacagagcgagactccatctcaaaaaaaaaaacccaaaaaaataaaacaaaaaaaactcatggatttttgtaatctactctattatatatatatatatatatatatatatgcacacacatgtatgttttagtatcaaaatgacttcaccccaaatctccacgtgaagtagatgcgtctcctctccatcgtggctgttggcacagtgctgtgtacctgagtgtgttcaacgtcttgagatttctaagcttaagggcaggagatagcccagggctggcacccaaatcctaagaaccctggccaaatatacaggatttaatgtcctcagcaccaggcatcacacaggaacgtgcgtgagcccatgaaatacttgctcaataataaatgctgccaagctgctaagcttggggaacctgatgagcactcggcttatgggagactgatgctccccacaggccggcccctgtgccgagactccacgcagtggcttcctcgctgtgacagcctcccctcatctgacgaggtccaaacagcgggtccaattctacccacacctctttgcatagggtgcttctctggattttagggtctagaccaaagctgaggctgttttatacattttggggtccctggaactcaggacaaggccatctgtatccccaatgctgaatgagtctccgacaggtgatagggcgatggggtcgctgtctaagtagggaaggaccaccctcgacttaagacatggctcagtgaaaaaagcctcgctctgaggacaggcagtgagaaatgaggaggttcagggcaggcggactccatgtgactgagggtttggccgggctccccttatcaacccggcatccctcgaccatgttctctggtgcacacaggtgagcagagggcagtgtctgctctggccaaggcaggggcaccccaacatcgcagccccttttggatgtgaggtccgctcattagatccgaggggccgtcctcctcccgtgctgggacccttggggcttgccgggagagacgcccagagggaaggggctttgtgggaggaggggttccgctgcccttcctggggcacctgtttcgctttttgtctttctttcctccctttccactccactccctttggggcatgagggaggtgagggaggagggtgggaagaacaaaggagagaattctgaggagggcgtcctgagttccagggacttctttcatcaagaggaaaaagaaaaactctttcaacactccctgtgcatagggtgctaatgagctgcaaattgaaattatttggagtttttcttaatggtgaaaagaaagaagttgtcagaggagaccagaaactctatgtcagctgagaaagctgtaagcgagagagatgaatggacggctcatctgtgctttggtgcatctttcatcagccggtgtcacccttggtagccgggtgctggccaatttccatttaacttccatttaacgtatagccaagg

SEQ ID NO: 2534 - DNA, 15873 bp, Homo sapiens
tcttcaagccaaggtggaattaaatcctaaaagtcaattcaatacccaaaaccaagcaggagaaatccacaggcatggagcacactgacacttggaaaagtcagcccactgactgaagttcccatttaatagaagcaatgagaataatcgacttttttgggtataaatatgtaaggtacaagtgcagttttgttacacagatacatttgtagtggtgaagtctaggcttctagtgtatctaaatactgatgtacattgtaaccattaggtaatttctcatccctcatccacctcccaccctcccactcttccgagtctccaatatctattgagattaatatactttaattgtgtttaattcacaaatgcataaatgaggtttatctcatttaaacctctctaccacctgacttaggaaaagagacatcattacccctgttttatagagatagaagagtccagtcctcatccagcaggaatctgggtttcctaacccctggccaggatctttctggccatatgcagcctccttcctgaacactaagccctgcttctagatcacaggaggagccaaagcaggagaaacgaagcttcacattccagaaaactacagaggatatagtcattgcgacgtccatttgcacagattgagtttggagtgggaaatgttacagtggatattagttaatacgcgctgttatggcacagacaatgttggggcagaaaagaaaggtcatttttataacagtgggtggcaagaagggaaggctgcctgtaacaggaggcattgagctctgccatgatgttatttttatgctttttaaaaagagctttttggccgggcgtggtggctcacgcctgtaatcccagcactttgggaggctgaggcaggtggatcacaaggtcaggagattgagaccatcctggctaacacggtgaaaccccatctctactaaaaataaaaaataaaaaaaattagccaggcgtggtggtgggcacctgcagtcccagctactcgggaggctgaggcaggagaatcggttgtacctgggagccgagatcgtgttactgcactccagcctggacgacagagcaagactctgtctcaaaacaaaacaaaacaaaacaaaacaaaactttttaaagctatatggattaaagaaagctgaatgattaaaaaaaaaaccatgaaaagaaaaccaagataaaacagatatttataaaaagctatcattggttttacacagatcttagttccagagcagctaataataatatttaagatttactgagtacttattaagtgcccaggcactatgctaactgtgtaacgggaataatcccattgaattttcacaaccatcctataagggaggttctattataatcctaactttgcagatgaggaaacagaactggagagtggaagtgacttgcccagggttaagcactgttagggaagtcgacttatgtagagaaatctttcacttgccttagactggagggagagtttggagagtgtcctgttctcctgttagtcctgttgctgtataatttcctaaccctggtcttctaaggctttgattcctcagtctccggaacatctgatggagttggtctagaaagaattcaggagagaatgaagttaggatccactccatcttccatcccttcaccaggatttattgacatcctatgtgccaggcgccctgctagatcctggatgtataaagagcaacacacaccaccgcctgaaagaagaggacatagcgttagttactaaaaaataattaccatgataaatagcacaaagaaagtacatataaaccactgtggagcttaaaaaatgacaatgagacaggaagaaagtcagggaaagctcccaggaggaggggatatttaatttgagtcttacaggactaacagaagttctacaagccaaaaaggtggggaagttgtgaaccacctgaatagtgaatagtagtccaataacaccactatccaaaagctctcacatttgagcaaacccattggtaactctttgcaatcatctctgtgtccctcagtcaaaatgaaaacaaaaatgcccaattccccctctttcctcatttgcctcccagacactgaaaaatgttctctaattcatatccacatggagaagaaaattctacatacttggaacaaaagcatgttccatggtagcgcatgcaaatgagatacttgtggggttttttaagtcaattctcctgtcttatcctgtttccatagctctcctctggtatatttagacactcttcttctatcctctcaaccaaagaaagaactttataaagcacaaatctagtgacatccagaggaagtcttctacatggtgctatttttattttattgattttattttgcaaactagtttgtcttcctcctttgtacttccagacagtaatcaaaaccctataaactataaatatattgttaacattgactcactggaactatgtgagaaagtacttactgctccagtccctcagatcctgctccatcatatcaaggttaggaaaacgtggaaagcaccttagagacaatgaaaattaaactgaccttttttttttttttttttttgagatggagtcttgctctgtcacccaggctggagcgcagtggcatgatctcggctcagtgcaacctccgcttcctgggttcaagtaattctgcttcagcctcccgagtagctgggattaaaggcgccggccaccatgcccagctaatttttgtatttttcgtagagacgagggtttcatcatgttggccaggctggcctcgaactcctgacttcagattatccacccgccttggcctcccagagtgctgggattacaggcgtgagccactgtgctgggcgaaactgaccttttttgaaatgacacaagggttggccgttttgcctagatgttacaatagaaataatcactatgacaacaaatgccaaatttactcaatccgtatttcctgagagcctgctctgcactgtgtaagtgatgcagggcagatgaaccccaaaactggggcttagtctggcttcaccgaggaaagaactcaaggacagcggcagcagagatactgctccctacagaccatggctacccaccagcagtgcgcccaggctagggctgcaggcatatttatacccacctttaattatatgcaaattaagaggcagtttatgcagaaatgtctaggtgggtggtaacttccaggtcattgccatggaaaggggtggtaacttccgggtattgccatggcgatggtaaactgacatggtgccgtggtggccctgtcttatggaaagccgcctctgcccgaccctgtttagctagttctcaatctggtccggtacccgagtccccgcctccagagtcagtttcaccttctgcctcataaggccctgagctgggcgctgttgcatataaaaataaggcaatgagaggactaaatgacccggcttcactgtagctgagacagtttgttctcctctccccatgacaatcctgaggaaaataaaactgctggaatatctgcccaggccaacatcttaaagtagcagtgtctttccaacagctgatgtctgttttagatcaacaaaaagttcagcaaacatgaaggtcttattggatagacccctggagctgatttcccaggaaaaataagaagcagactggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggtgacagagcgagactccgtctcaaaaaaaaaaaaaaaaaaaaaaaaaaaaaaaagccgacctgttgtggaaaggtcaggctagtactagaggtctgggtgatctccccaaaagtctaccatccgcaacctggaatggcacttacaagttcatgaattcatctcagatctttactcatgatctgattttccttccttttctacaaccttactctgaccttagcaaaggaggccaagtttggacttcttactcaagtggaccctggtaagaattgcgtaggggtcaaaaggcctactgtataaacttgggcaagtcacttcacctctctgaccctcagtctcttcatctattaaatagagctgatgcctagctcacagtgttgtctggggggttacatgagataatgtatgtgaatgtgactagctcaataaatgtcactttctgttgccacctttgagctttctcatccttttttttttttttttttttttttgaggcagagtctcactctgtcgcccaggctggagtatggagtacagtggcacaatctcggctcaccacaacctccgcctcccggattcaagtgattctcccacctcatcctcctgagtagctgtgattacaggcatgtgccaccatgcctggctaatttttgtatttttagtaaagacagtttcgccatgttggctaggctggtctggaactcctgacctcatgtgatcgcctacctgggcctccaaaagtgctaggattataggggtgagccaccacgcctggccttcatccttaataacaaatgacatttcttggccttaacaactcatgaatttaacaggaatatgaaacatataatatgtcatgttggtgcctttaagattaatatgaatcaacaagaatttggctttaagaatttcacatctaagatgactagagatcccagggatgtcccagagactgcaaatcaagacaacagcaaaggatatttgttccttattatcttttggtcctattagcattgaagtaagaataatttggggacttggccgagcatggtggctcacacctgtaatcccagcactttgggaggctgaggcaggcagatcacgaggtcaggagattgagaccatcctagctaacacagtgaaaccccatttctactaaaaatacaaaaaattagccgggcatggtggcaggtgcctgtagtcccagctactcgggaggctgaggcaggagaatggcgtgaacctgggaggcagagcttgcagtgagccgagatggcgccactgcgctccagcctgggtgacagagcaagactctgtctcaaaaaaaaaaaaaaaaaaaaaaaaaaaagaataattcggggactttttttatagtttttttaaaaagccttacaatttaggtttaaataaaatttggctctgggttgtggtttagctagacatttatgagtgatcgttcaggtaatacatctaagaaaagacaattttaagggattatatatatttgatatggatttgaaattgcaattttctgaatgaggaagcctagagttggagtgtttttccatttttttcttagtcatagattaactttgatatttggctctgacatatcctgtgcgatcctgtttcctgcaaaaacacagctctcaagtcgggaactgctgtgatgtggagctggtgtttgacgacggctttgagcatctcagctagaacacactatgcaaacatggaatattatttctcatctcttaccctaagaagggagagacaggagcttaatccccagatgccaccagggtttcagagagaacaaagaagtgaccagaaaacctcgcagccccttagagaacgagatagaggtttgggctctggctgctcagctgggcactgctgactctgccacttgcaaatgtcctgtggcttgtgccattctaaacccacagaggtcctggtctacagggcacagccagctctgtggtgaacacacatcctggcaggaattgggtgggctgggcatggtggctcctgcctgtaatcccaacactttgggaggccaaagcaggaggatcatttgaggctaggagtttgaaaccagcccgatcaacatagggagtcccctgtctgtacaaaaaataagaaaaattagccaggcatggtggtgcatacctgtagtcatagctactagggaggctgaggttggaagatggtttgagcccaggaggttgaaactgcaatgagctatgatcacaccacggcactccagcctgggcgacagagtgagaccctgtctaaaaacaacagaaaagaaactggatgagccctctgatgggaatctcagggagaacgctctgtgattccctgtctgatagcagaaggacactaaggttgtgaagaatgctctctcacccttgcaaagcaatgcagcagctggagatcagtgactcgtccaagttgtacagctagtaaagcacagtcctagtgtggagctcagggcttgtgagtggagtccagtgtgctttctcttttgaggccaccagtgttagcagtattgaccacaagtcccacctagcctctttttctttactggttaggagcaactgagtctgctctagatccctttaaaatcctcctcaaggatctgaaggcagcccgcattcatgatctccttccttcctgccccagcacctttccacaggcagttccatctttggccagccttccttccccacgcaaccctgccccactcagaagccttcttttttttttttttttttttttttttttttttttgagatggagtcttgctctgtcaccaggctggagtgcagcggcacgatctcggctccgcctcccaggttcaagagattctcctgcctcagcctcctgagtagctgggactacaggcgtgtgccaccatgcccagctaatttttgtatttttagtagagacggggtttcaccatgttggccaggatggtctcgatctcttgacctcgtgatctgcccgccttggcctcccaaagtgctggaattacaggcatgagccaccgcgcccagccctcagactgcttcttaccctgcatgtttagtctaaatgtcgtctccatggaaatgccttccctgtctactccactgttctgtatcccatacccaaactgtctcctttacagcaactgtcaggaggtgtgggtatttgttagtttactggtttatcatctgagtcagccccaggataagaggttgaggcagctgtgctcagtgctagtacatgccttgcatatttgatgaatgaatgaactctttgaaaacagtgagccccataaaccactatctctgttttatctctggtcacagctgttaatcctgctgttgaaggtcaggtaagcaacacaaatctttctgacttaaaaatacctccccctgaggcttgccctagttctcttagaacaatttataaagctggtatttgtttgctgcagttttgcaatttgcaacaagacagaagtgctagaattttagtcatcccccatcctcctttgcaggatagaactgggtgtaggtaaagaccttcggtgcctgtagaaggaaggaaactggatccaagaagcaggtgatttcatttccatcaatctttaggttccagatggaggagctgtgcatttgggctcattagctgtgctcactaaagatggacctggagcatgacagcacagccctagctggtctgcccaagtctgtgcctgtccccagtgctcttagctatgtgcttgcagcgtgctgcagctgcatagccacccaggttcttcccaggatcagctgagaacattttagttgcaagtgacagaaaacctcacataaactaacactagcaaaaagagaacttattagctttcacaatcggaaaagtccagggacagggctggctttacctgcagcttcatgctgggcccctgctatattcccaggacctggttcctctctgggagtctctgggcttcctgtcctctgtgttgattccattctcatccataccctcccccggaagcaggatgtctacatcaactccagactcaaaatgcttcctataagccaggcgcagtggctcacacctgtaatctcagcactttgggagactgaggcaggtggatcacttgacctcaggagctgcagaccagcctgggcaatgtggcaaaactctgtctctacaaaaaatacaataattagctgggcatggtggtgcactcctgtagtcccagatacttgggaggctgaggtgggaggatcacttgagcctgggaggcagagatgcagtgagccgagatcacactactgcaccccagcctggacaaaagagcgagactctgtctcaaacaaaacaaaacaaaacaaaacaaaacaaaacaaaacatttcctgtgtgcaagttcatcagggtaagagtgtcccacctcttttccagtggtctcagaagccctgtggtgtcttgccaactctgatttggttgcctgttgtccctgaaaatcacagtgggcaggtctgagaggcaggcctggagcagaaggatgcatcagctcccccaaaagctgatggactgagagtggagtgaggttgttccacaaaaggaaactggggttctgttaccaagagaaaggcaggtgaattcaaggcaacagacatagcacgtgtcctttttatctcctaatctgatttcctcctctttacataaagatctcttggtggccaggcgtggtggctcacgcctgtaatcctagcactttgggaagccgaggcgggtggatcacttgaggtcaggaattcgagaccagcctgaccgacatggcaaaaccccatctgtactaaaaatacaaaaattagccaggcttggtggcacatcccatctaccggagaggctggggcaggagaatggcttgaacccaggaagcggaggttgcagtgagcagagatcgcgccactgcactccagcctgggcgacagagtgagactccattaaaaagaaaaaaaagaaaagaaaaaaaaaagatctcttggtgtgcccctccttcccgtggccttgccgaagcagaggatgaccaaaggcctgtgtccctgtggcgcattcctcatctcataattctcccattgttcatcacggcacttggacacagtacagtatgattttttgtataattcccccgacttttattcatgtatttacttatttattttgaaacagggccttgctctgtctccaaggctggaatgcagtggtgcaatcacaggtgcctgcagccttgaacacccaggctcaagtgatcctcccacttcagcctccaaagtagttgggaccacagacacacaactacacccagctaatttttgttgttgtttaatttttgaagagatggggtttccctgtgttgcccaggctggtctcaaactcttgggctgaagcgacccacctgcctcagccttccagagtgcagggggttacagatgtgagccaccttgcccagctccctcttgggggagggatggctttaacagatattttactgttacttatatattttactatttagatatttactcatttattttactgtttagatatttactaacatattgtaagtaataggatatcctattacttagatatttactaaaatatcgtaataagatatcctattacttagatatttactaaaatatcgtaataggatatcctattacttagatatttactaaaatatcgaataggatatcctattacttagatatttactaaaatatcgtaagtaataggatacctattacctagatatttactaaaatatagcaataagatatcgtattacttagatattttactattgcttatattttattattacttttaacagatatttcactgtattttactgtttgccttttaacaggtgttttgctattaaggccaaacagtttttctgttctatcattgttttttttgttttctctctttgatggagaggagatgaaatgagctgctgtttagcctgagtacaccattgtgctttatatctatcagcaccagaaatacccctgagagctgaaccgtagaaagctttctagaaacaaatgaacttatgaagcattttaagctacaggttttcccactgcagtgcatcatggggagaggtaaaagcgtggaggatctggcttcaggcagaccttagcttaaagcccattaaggccaccaggctgcacatctcctgggggcccccttcacagcagactcagtgtgcagggcacctctggagtagtggctgcatggatgacccagccatgtgcagcagccttgaatcccgtttccctcactgactagctgtgtggccttggacaggtatttgaactctctaagcgctggttgcctcatctaatacagcattaataaatatttattatattttagtccggttgtggtggctcacgcctgtaatcccaacactttgggaggctaaggcaggtggattacctgaagtcaggagttcaagaccagcctggccaaaacggtgaaaccccgtctctattaaaaatacaaaaattagctgggcgtgatggtggatgcctgtaataccagctactaaggaggctgaggcaggagaatcgcttgaaccctggaggcagaggttgcagtgagccaagattgcgccactgtactccagcctgggcaacaagagcgaaactccatctcaaaaaaaaagaaaaagaaaagaaacctaggctgggcgcagtggctcatgcctgtaatcccagcacattgggaggctgaggcgggcagatcacctggtcaggagttcgagaccagcctgaccaacatgacaaaaccccaaacaaacctcaggaaactagtaatagaaggaatcctccttaatctaataaaggatatttacaaaaacccccaacacctaacataaacacttaatggtgaacaactaaatgctttcccccaaagttcaagaacaaggcaaggatatcctacttaacataatactactcagtaattttttttttggaacatagactcacagcagagacaagtgaacatttatttttgtgcctttcttcctatgtgtatttcaagtctttttcaaacaaaggccccaggaatctccagattcaattatgtccctggggttggtcgactgctacaggagtcttagggagccttggacaaatgctagagttactcatttaccaccattaaactctaggatagaagatgcagcaaagcaggactccttcctccatggaatgtgctgatttcagacgaggcggcagccaatgtagaaaacgctggaattggccgggcgcggtggctcacgcctgtaatcccagtactttgggaggccgaggcgggcggatcacctgaggtcaggaggtcgagaccatcctggccaacacggtgaaaccccatctctactaaaaatacaaaaaaaattagctgggcatggtggcaggcgcctgtagtcccagctacttgggagactgaggtgggagaactggcttgaacccgggaggcggaggttgcagtgagccaagactgtgccactgcacttccagcctgggcaacagagtgagactccgtctcaaaaaacaaaaaaagaaaacactggaattttttccttggaactggactgtgatgagaggtgcttgccatgaacataagctactgtcttttcttttttctttctttctttttttttttttttttgagacagagttttgctcttattgcccaggctggagtgcaatggcgcaatcttggctcaccgcaacctccacctccagggttctagcaattctcctgcctcagcctccctagtagctgggattacaagcatgtgccaccatgcccggctaatttttgtatttttagtagagatggggtttctccatgttggtcaggctggtctcaaactcctgacctcaggtgatctgcccacctcggcctcccaaagtgctgggattacaggcgtgagccaccgcacccggccagctactgtcttttctttgacccttcctttccattttttgaagataaagcaggaaataatcttctctgaagatacttgataaaaattccccaaaatacaaaaacacatgcttccacttcattgataaaaatttactgcagtttggcacctgggtctagttcagctggcagatgagctgattgatgcattcaccctgatagccaggtatgcccatctccttgaggaagcccactctatttttggtagcatgacgggccactgagaggtggaaagggcacaagaaccacgagatctcctggaaatgcttctccaggtgctcctcaatcactgtgttgtctgtcagagggatggtcttattcgtgaccttgacttgtccacgtttcaaaatgagttcccagacagacttcagatttggaaatccctaggtcacataagtttccactatacgcagcatttttaggttctggggggtgacttttacaaagacaccactaaaaattttctttgggcaaagtctcgcaatggttctctgcaccagtaaactcacgccatcaatcctttcgatgcgtacaacaaaggccaaggaatgtttatctggcaattccaaggtgtggtttcacttctagtcgtctgagacgtaccttgtcacgtttctgtcaccaggaatcttgtaggaatgattccagttgtttaaacctgagcccttttctttttctctgctccttctttgccaaaagtgcctgctttgcctgggtggctttgagggcttgataagctgtcctcattttcaggagattttctggaaccaaagggatttatctttgctcttgctctgccatctttctagtgttgcagctactactactcagtaattaaggcaaggaaaagcagtcaaagttattcagattggaaaggaagaaataaaacgctccacttgcaaatgacataattgtctatgtagaaaatctacagaaaagatcccaaaattaagtgaggtaagccaggtcacaggacatacggtcaaaatgcaaaagtagattgtatatttagatactaacaatgaacgactggaattttaaaaattaaatgactttttttttttttttttgagatacagtctagctctgtcatccagagccaagctctgtcatccaggctggagtgcagtggcgcgatctcagctcactgcaacctccgcccccaagttcaagcggttctcctacctcagcctcctgagtagctgggattacaggcacccaccatcatgcccggctaatttttgtagagacagggtttcaccatgttggccaggctgatcatgaactcctgacttcaggtgatccacccgccttggcctgccaaagtgctgggattacaggcgtgagccactgcccctggcctatttaggtataaatctaactaaatatgtgcaatgcctgtaagcctaaaactgcaaaacactaacaaaacaacaacaacaaaaaatcaagacctaagtaaatggagacataaataatattcctgggccaggagaatctatattatgatgccagttctcaccaaactaatctgtatattcaaatcaatcacaattaaaatcttggcaggatatcttatagatagccacaagcagattcaaaaatttgcctaaagctataataaccaagacagtgtgatattgtcaaaaagacagatgcacagggccgggcgccgtggctcacacctgtagtcccagcattttgggaggccaaggtggctggatcacttgaggtcaggagttcgagaccagcctggccaacatagtgaaaccctgtctctactaaaaacacaaaaattagccgggcgtggtggcacatgcctataatcccagctacttgggaggctgaagcatgagaattacttgaacctgggaggtggaagttgcagtgagacgagatcccaccactgcactccagcctgggcgatagagtgagactctgtctcgaaaaaaaaaaaaaaaaagaaagaaaaaagaaagacagatacacagatcagtgaaacagaacagtccagaatggacccatgcacatacacagttaactacattttgacaaatgtacaaaggaagttccgtggataatgtttagtcttctccacaaaaggtgctgacaattggacactcacatgcaaaagaaaatgaacttcaacccattcctgcacctttataaaagattaatggaaaatggatcttagacttaagtcgaggctggtgggccacgaggtcaagagatcgagaccatcctggccaacatggtgaaaccccatctctactaaaaatacaaaaatcagctgggcatggtggtgtgcacctgtagtctcagctactcgggagcctgagccaggggaatcgcttgaacccaggaggcagaggttgcagtgagccgagactgtgcgactgcactccagcctggcgacagagcaagactctgtctcaaaaaacaaacaaacaaaaaactacaaaatttctagcagaaagcatacgagaaaatcttcgtgaccctgtgttaagcaaagatttcttagatatgacacaatccataaacaataaaactgataaaatgaacttttagaatttctgacttgtgaaagacattagtaaaaggaaaaaaagactgagagaagatgtttgtaaatcaaatatttgacaaaccacttttattcagaatgtataaagaactctaaaaactcagtaagaaaacaaacaacttgattaaacattatgcacttcaccagataagatacatggatggcagataaacacatgaagatattcatgattagtcattaggaaaatgcatattaaaaagcacaatgaatctgggctcaatggctcatacctgtaattcctacactttgggaggtgaggcaggagaattgcttgagcctaggggttcaagaccagtctgggcaacataggcagacttcatttctacaaagcaaaacaattagccgggtgtggtggtatacacctgtggtcccagctacttgggagcctgaggcaggagcagaaggatcacttgagcccaggaggttgaggctgtagtgaatcatgatgtcaccatagcactccagcctgggaaaaagaacaagatcctgtctcaaattaaaaaaacaaaacaaaacaaaaaacaaacatgaagaatctaaatgcattgctaagtaaagaagtcagaattgaaatgttatgttgattccatttacatgacattctagaaaagctgaaattatagaaacagaacaaatcagggatttccaagggctggaaatgcaggaggggttgattacaaaagggcagcacctgggaaatattttgggcaaaaaaactgttttggcatcttaatgcctgcagttattatacagctatttgcattaataactgtaaaccaaagagtgaattttattgtaagtaaatttttacgaagtgcataaagtggaattgaaacaaaccacaaatgctactgtaagtgagttccctccaagatctctgagactcagacctaccaatgatagtaagagtctccttagcaggagacaaattattcctaggaaggagattatatttgttcttcgaaattggaagaggaggaagaaaaaaagagaagcccatgagcaccaagtaaacatggtgaatactttattattgggctcttaaattgtcagtttcatatgcgtgatttcccataaatatcatgccattggccgggcacggtggctcacacctgtaatcccagcactttgggaggccgaggcgggcagatcatgaggtcaggagatcgagagcatcctggctaacacggtgaaaccccgtctccactaaaaaat

SEQ ID NO: 2535 - DNA, 11965 bp, Homo sapiens
atggcgtgaacccgggaggcggagcttgcagtgagccgagatcccgccactgcactccagcctgggtgacagagcgagactccgtctcaaaaaaaaaaaaaaaaaaaaaaaaaaaaaaaagccgacctgttgtggaaaggtcaggctagtactagaggtctgggtgatctccccaaaagtctaccatccgcaacctggaatggcacttacaagttcatgaattcatctcagatctttactcatgatctgattttccttccttttctacaaccttactctgaccttagcaaaggaggccaagtttggacttcttactcaagtggaccctggtaagaattgcgtaggggtcaaaaggcctactgtataaacttgggcaagtcacttcacctctctgaccctcagtctcttcatctattaaatagagctgatgcctagctcacagtgttgtctggggggttacatgagataatgtatgtgaatgtgactagctcaataaatgtcactttctgttgccacctttgagctttctcatccttttttttttttttttttttttttgaggcagagtctcactctgtcgcccaggctggagtatggagtacagtggcacaatctcggctcaccacaacctccgcctcccggattcaagtgattctcccacctcatcctcctgagtagctgtgattacaggcatgtgccaccatgcctggctaatttttgtatttttagtaaagacagtttcgccatgttggctaggctggtctggaactcctgacctcatgtgatcgcctacctgggcctccaaaagtgctaggattataggggtgagccaccacgcctggccttcatccttaataacaaatgacatttcttggccttaacaactcatgaatttaacaggaatatgaaacatataatatgtcatgttggtgcctttaagattaatatgaatcaacaagaatttggctttaagaatttcacatctaagatgactagagatcccagggatgtcccagagactgcaaatcaagacaacagcaaaggatatttgttccttattatcttttggtcctattagcattgaagtaagaataatttggggacttggccgagcatggtggctcacacctgtaatcccagcactttgggaggctgaggcaggcagatcacgaggtcaggagattgagaccatcctagctaacacagtgaaaccccatttctactaaaaatacaaaaaattagccgggcatggtggcaggtgcctgtagtcccagctactcgggaggctgaggcaggagaatggcgtgaacctgggaggcagagcttgcagtgagccgagatggcgccactgcgctccagcctgggtgacagagcaagactctgtctcaaaaaaaaaaaaaaaaaaaaaaaaaaaagaataattcggggactttttttatagtttttttaaaaagccttacaatttaggtttaaataaaatttggctctgggttgtggtttagctagacatttatgagtgatcgttcaggtaatacatctaagaaaagacaattttaagggattatatatatttgatatggatttgaaattgcaattttctgaatgaggaagcctagagttggagtgtttttccatttttttcttagtcatagattaactttgatatttggctctgacatatcctgtgcgatcctgtttcctgcaaaaacacagctctcaagtcgggaactgctgtgatgtggagctggtgtttgacgacggctttgagcatctcagctagaacacactatgcaaacatggaatattatttctcatctcttaccctaagaagggagagacaggagcttaatccccagatgccaccagggtttcagagagaacaaagaagtgaccagaaaacctcgcagccccttagagaacgagatagaggtttgggctctggctgctcagctgggcactgctgactctgccacttgcaaatgtcctgtggcttgtgccattctaaacccacagaggtcctggtctacagggcacagccagctctgtggtgaacacacatcctggcaggaattgggtgggctgggcatggtggctcctgcctgtaatcccaacactttgggaggccaaagcaggaggatcatttgaggctaggagtttgaaaccagcccgatcaacatagggagtcccctgtctgtacaaaaaataagaaaaattagccaggcatggtggtgcatacctgtagtcatagctactagggaggctgaggttggaagatggtttgagcccaggaggttgaaactgcaatgagctatgatcacaccacggcactccagcctgggcgacagagtgagaccctgtctaaaaacaacagaaaagaaactggatgagccctctgatgggaatctcagggagaacgctctgtgattccctgtctgatagcagaaggacactaaggttgtgaagaatgctctctcacccttgcaaagcaatgcagcagctggagatcagtgactcgtccaagttgtacagctagtaaagcacagtcctagtgtggagctcagggcttgtgagtggagtccagtgtgctttctcttttgaggccaccagtgttagcagtattgaccacaagtcccacctagcctctttttctttactggttaggagcaactgagtctgctctagatccctttaaaatcctcctcaaggatctgaaggcagcccgcattcatgatctccttccttcctgccccagcacctttccacaggcagttccatctttggccagccttccttccccacgcaaccctgccccactcagaagccttcttttttttttttttttttttttttttttttttttgagatggagtcttgctctgtcaccaggctggagtgcagcggcacgatctcggctccgcctcccaggttcaagagattctcctgcctcagcctcctgagtagctgggactacaggcgtgtgccaccatgcccagctaatttttgtatttttagtagagacggggtttcaccatgttggccaggatggtctcgatctcttgacctcgtgatctgcccgccttggcctcccaaagtgctggaattacaggcatgagccaccgcgcccagccctcagactgcttcttaccctgcatgtttagtctaaatgtcgtctccatggaaatgccttccctgtctactccactgttctgtatcccatacccaaactgtctcctttacagcaactgtcaggaggtgtgggtatttgttagtttactggtttatcatctgagtcagccccaggataagaggttgaggcagctgtgctcagtgctagtacatgccttgcatatttgatgaatgaatgaactctttgaaaacagtgagccccataaaccactatctctgttttatctctggtcacagctgttaatcctgctgttgaaggtcaggtaagcaacacaaatctttctgacttaaaaatacctccccctgaggcttgccctagttctcttagaacaatttataaagctggtatttgtttgctgcagttttgcaatttgcaacaagacagaagtgctagaattttagtcatcccccatcctcctttgcaggatagaactgggtgtaggtaaagaccttcggtgcctgtagaaggaaggaaactggatccaagaagcaggtgatttcatttccatcaatctttaggttccagatggaggagctgtgcatttgggctcattagctgtgctcactaaagatggacctggagcatgacagcacagccctagctggtctgcccaagtctgtgcctgtccccagtgctcttagctatgtgcttgcagcgtgctgcagctgcatagccacccaggttcttcccaggatcagctgagaacattttagttgcaagtgacagaaaacctcacataaactaacactagcaaaaagagaacttattagctttcacaatcggaaaagtccagggacagggctggctttacctgcagcttcatgctgggcccctgctatattcccaggacctggttcctctctgggagtctctgggcttcctgtcctctgtgttgattccattctcatccataccctcccccggaagcaggatgtctacatcaactccagactcaaaatgcttcctataagccaggcgcagtggctcacacctgtaatctcagcactttgggagactgaggcaggtggatcacttgacctcaggagctgcagaccagcctgggcaatgtggcaaaactctgtctctacaaaaaatacaataattagctgggcatggtggtgcactcctgtagtcccagatacttgggaggctgaggtgggaggatcacttgagcctgggaggcagagatgcagtgagccgagatcacactactgcaccccagcctggacaaaagagcgagactctgtctcaaacaaaacaaaacaaaacaaaacaaaacaaaacaaaacatttcctgtgtgcaagttcatcagggtaagagtgtcccacctcttttccagtggtctcagaagccctgtggtgtcttgccaactctgatttggttgcctgttgtccctgaaaatcacagtgggcaggtctgagaggcaggcctggagcagaaggatgcatcagctcccccaaaagctgatggactgagagtggagtgaggttgttccacaaaaggaaactggggttctgttaccaagagaaaggcaggtgaattcaaggcaacagacatagcacgtgtcctttttatctcctaatctgatttcctcctctttacataaagatctcttggtggccaggcgtggtggctcacgcctgtaatcctagcactttgggaagccgaggcgggtggatcacttgaggtcaggaattcgagaccagcctgaccgacatggcaaaaccccatctgtactaaaaatacaaaaattagccaggcttggtggcacatcccatctaccggagaggctggggcaggagaatggcttgaacccaggaagcggaggttgcagtgagcagagatcgcgccactgcactccagcctgggcgacagagtgagactccattaaaaagaaaaaaaagaaaagaaaaaaaaaagatctcttggtgtgcccctccttcccgtggccttgccgaagcagaggatgaccaaaggcctgtgtccctgtggcgcattcctcatctcataattctcccattgttcatcacggcacttggacacagtacagtatgattttttgtataattcccccgacttttattcatgtatttacttatttattttgaaacagggccttgctctgtctccaaggctggaatgcagtggtgcaatcacaggtgcctgcagccttgaacacccaggctcaagtgatcctcccacttcagcctccaaagtagttgggaccacagacacacaactacacccagctaatttttgttgttgtttaatttttgaagagatggggtttccctgtgttgcccaggctggtctcaaactcttgggctgaagcgacccacctgcctcagccttccagagtgcagggggttacagatgtgagccaccttgcccagctccctcttgggggagggatggctttaacagatattttactgttacttatatattttactatttagatatttactcatttattttactgtttagatatttactaacatattgtaagtaataggatatcctattacttagatatttactaaaatatcgtaataagatatcctattacttagatatttactaaaatatcgtaataggatatcctattacttagatatttactaaaatatcgaataggatatcctattacttagatatttactaaaatatcgtaagtaataggatacctattacctagatatttactaaaatatagcaataagatatcgtattacttagatattttactattgcttatattttattattacttttaacagatatttcactgtattttactgtttgccttttaacaggtgttttgctattaaggccaaacagtttttctgttctatcattgttttttttgttttctctctttgatggagaggagatgaaatgagctgctgtttagcctgagtacaccattgtgctttatatctatcagcaccagaaatacccctgagagctgaaccgtagaaagctttctagaaacaaatgaacttatgaagcattttaagctacaggttttcccactgcagtgcatcatggggagaggtaaaagcgtggaggatctggcttcaggcagaccttagcttaaagcccattaaggccaccaggctgcacatctcctgggggcccccttcacagcagactcagtgtgcagggcacctctggagtagtggctgcatggatgacccagccatgtgcagcagccttgaatcccgtttccctcactgactagctgtgtggccttggacaggtatttgaactctctaagcgctggttgcctcatctaatacagcattaataaatatttattatattttagtccggttgtggtggctcacgcctgtaatcccaacactttgggaggctaaggcaggtggattacctgaagtcaggagttcaagaccagcctggccaaaacggtgaaaccccgtctctattaaaaatacaaaaattagctgggcgtgatggtggatgcctgtaataccagctactaaggaggctgaggcaggagaatcgcttgaaccctggaggcagaggttgcagtgagccaagattgcgccactgtactccagcctgggcaacaagagcgaaactccatctcaaaaaaaaagaaaaagaaaagaaacctaggctgggcgcagtggctcatgcctgtaatcccagcacattgggaggctgaggcgggcagatcacctggtcaggagttcgagaccagcctgaccaacatgacaaaaccccaaacaaacctcaggaaactagtaatagaaggaatcctccttaatctaataaaggatatttacaaaaacccccaacacctaacataaacacttaatggtgaacaactaaatgctttcccccaaagttcaagaacaaggcaaggatatcctacttaacataatactactcagtaattttttttttggaacatagactcacagcagagacaagtgaacatttatttttgtgcctttcttcctatgtgtatttcaagtctttttcaaacaaaggccccaggaatctccagattcaattatgtccctggggttggtcgactgctacaggagtcttagggagccttggacaaatgctagagttactcatttaccaccattaaactctaggatagaagatgcagcaaagcaggactccttcctccatggaatgtgctgatttcagacgaggcggcagccaatgtagaaaacgctggaattggccgggcgcggtggctcacgcctgtaatcccagtactttgggaggccgaggcgggcggatcacctgaggtcaggaggtcgagaccatcctggccaacacggtgaaaccccatctctactaaaaatacaaaaaaaattagctgggcatggtggcaggcgcctgtagtcccagctacttgggagactgaggtgggagaactggcttgaacccgggaggcggaggttgcagtgagccaagactgtgccactgcacttccagcctgggcaacagagtgagactccgtctcaaaaaacaaaaaaagaaaacactggaattttttccttggaactggactgtgatgagaggtgcttgccatgaacataagctactgtcttttcttttttctttctttctttttttttttttttttgagacagagttttgctcttattgcccaggctggagtgcaatggcgcaatcttggctcaccgcaacctccacctccagggttctagcaattctcctgcctcagcctccctagtagctgggattacaagcatgtgccaccatgcccggctaatttttgtatttttagtagagatggggtttctccatgttggtcaggctggtctcaaactcctgacctcaggtgatctgcccacctcggcctcccaaagtgctgggattacaggcgtgagccaccgcacccggccagctactgtcttttctttgacccttcctttccattttttgaagataaagcaggaaataatcttctctgaagatacttgataaaaattccccaaaatacaaaaacacatgcttccacttcattgataaaaatttactgcagtttggcacctgggtctagttcagctggcagatgagctgattgatgcattcaccctgatagccaggtatgcccatctccttgaggaagcccactctatttttggtagcatgacgggccactgagaggtggaaagggcacaagaaccacgagatctcctggaaatgcttctccaggtgctcctcaatcactgtgttgtctgtcagagggatggtcttattcgtgaccttgacttgtccacgtttcaaaatgagttcccagacagacttcagatttggaaatccctaggtcacataagtttccactatacgcagcatttttaggttctggggggtgacttttacaaagacaccactaaaaattttctttgggcaaagtctcgcaatggttctctgcaccagtaaactcacgccatcaatcctttcgatgcgtacaacaaaggccaaggaatgtttatctggcaattccaaggtgtggtttcacttctagtcgtctgagacgtaccttgtcacgtttctgtcaccaggaatcttgtaggaatgattccagttgtttaaacctgagcccttttctttttctctgctccttctttgccaaaagtgcctgctttgcctgggtggctttgagggcttgataagctgtcctcattttcaggagattttctggaaccaaagggatttatctttgctcttgctctgccatctttctagtgttgcagctactactactcagtaattaaggcaaggaaaagcagtcaaagttattcagattggaaaggaagaaataaaacgctccacttgcaaatgacataattgtctatgtagaaaatctacagaaaagatcccaaaattaagtgaggtaagccaggtcacaggacatacggtcaaaatgcaaaagtagattgtatatttagatactaacaatgaacgactggaattttaaaaattaaatgactttttttttttttttttgagatacagtctagctctgtcatccagagccaagctctgtcatccaggctggagtgcagtggcgcgatctcagctcactgcaacctccgcccccaagttcaagcggttctcctacctcagcctcctgagtagctgggattacaggcacccaccatcatgcccggctaatttttgtagagacagggtttcaccatgttggccaggctgatcatgaactcctgacttcaggtgatccacccgccttggcctgccaaagtgctgggattacaggcgtgagccactgcccctggcctatttaggtataaatctaactaaatatgtgcaatgcctgtaagcctaaaactgcaaaacactaacaaaacaacaacaacaaaaaatcaagacctaagtaaatggagacataaataatattcctgggccaggagaatctatattatgatgccagttctcaccaaactaatctgtatattcaaatcaatcacaattaaaatcttggcaggatatcttatagatagccacaagcagattcaaaaatttgcctaaagctataataaccaagacagtgtgatattgtcaaaaagacagatgcacagggccgggcgccgtggctcacacctgtagtcccagcattttgggaggccaaggtggctggatcacttgaggtcaggagttcgagaccagcctggccaacatagtgaaaccctgtctctactaaaaacacaaaaattagccgggcgtggtggcacatgcctataatcccagctacttgggaggctgaagcatgagaattacttgaacctgggaggtggaagttgcagtgagacgagatcccaccactgcactccagcctgggcgatagagtgagactctgtctcgaaaaaaaaaaaaaaaaagaaagaaaaaagaaagacagatacacagatcagtgaaacagaacagtccagaatggacccatgcacatacacagttaactacattttgacaaatgtacaaaggaagttccgtggataatgtttagtcttctccacaaaaggtgctgacaattggacactcacatgcaaaagaaaatgaacttcaacccattcctgcacctttataaaagattaatggaaaatggatcttagacttaagtcgaggctggtgggccacgaggtcaagagatcgagaccatcctggccaacatggtgaaaccccatctctactaaaaatacaaaaatcagctgggcatggtggtgtgcacctgtagtctcagctactcgggagcctgagccaggggaatcgcttgaacccaggaggcagaggttgcagtgagccgagactgtgcgactgcactccagcctggcgacagagcaagactctgtctcaaaaaacaaacaaacaaaaaactacaaaatttctagcagaaagcatacgagaaaatcttcgtgaccctgtgttaagcaaagatttcttagatatgacacaatccataaacaataaaactgataaaatgaacttttagaatttctgacttgtgaaagacattagtaaaaggaaaaaaagactgagagaagatgtttgtaaatcaaatatttgacaaaccacttttattcagaatgtataaagaactctaaaaactcagtaagaaaacaaacaacttgattaaacattatgcacttcaccagataagatacatggatggcagataaacacatgaagatattcatgattagtcattaggaaaatgcatattaaaaagcacaatgaatctgggctcaatggctcatacctgtaattcctacactttgggaggtgaggcaggagaattgcttgagcctaggggttcaagaccagtctgggcaacataggcagacttcatttctacaaagcaaaacaattagccgggtgtggtggtatacacctgtggtcccagctacttgggagcctgaggcaggagcagaaggatcacttgagcccaggaggttgaggctgtagtgaatcatgatgtcaccatagcactccagcctgggaaaaagaacaagatcctgtctcaaattaaaaaaacaaaacaaaacaaaaaacaaacatgaagaatctaaatgcattgctaagtaaagaagtcagaattgaaatgttatgttgattccatttacatgacattctagaaaagctgaaattatagaaacagaacaaatcagggatttccaagggctggaaatgcaggaggggttgattacaaaagggcagcacctgggaaatattttgggcaaaaaaactgttttggcatcttaatgcctgcagttattatacagctatttgcattaataactgtaaaccaaagagtgaattttattgtaagtaaatttttacgaagtgcataaagtggaattgaaacaaaccacaaatgctactgtaagtgagttccctccaagatctctgagactcagacctaccaatgatagtaagagtctccttagcaggagacaaattattcctaggaaggagattatatttgttcttcgaaattggaagaggaggaagaaaaaaagagaagcccatgagcaccaagtaaacatggtgaatactttattattgggctcttaaattgtcagtttcatatgcgtgatttcccataaatatcatgccattggccgggcacggtggctcacacctgtaatcccagcactttgggaggccgaggcgggcagatcatgaggtcaggagatcgagagcatcctggctaacacggtgaaaccccgtctccactaaaaaat

SEQ ID NO: 2536 - DNA, 12937 bp, Homo sapiens
aaaatacaaaagttagctgggtatggtggcaggtacctgtaatcccagctactcgggaggctcaggcaggagaatcactgaaacccaggaggtggaggttgtggtgagctgagattgtgccattgcactccagcttgggaaacaagcgcaaaactgtgcctcaaaaaaaaagttatttccttctgaaattgttcttcaaatgtttcttgtcacatacatgcagcagtaatttggtagaaacatgagaaattgtgatcctctgtcttgctcagcttggctcccctccccaaccagcattatctgcccgcacccccaatccccaacaactgatgtgtccttatctccctgccccctaccgcgcccccgtagcataattgtatgccacatatgggcacaccatcacatatggctaaaatgggatcactccgtaatgaatgaatatatatatatatatattttttttttttgagatggagtctcgctcttgttgcccaggctggagtgcaatggcgtgatcggggctcactgcaacctccgcctcccgggttcaagcgattctcctatctcagcctcccgagtagctgggactataggcgcacaccaccatgcccagctaatttttgtattttttagtagagacggtgtttcaccatattggtcaggctggtcttgaacttctgaccttaggtgatccacctgccttggcctcccaaagtgctgggattacaggcataagctaccgtgcctggccaatgctaggcactttttatgggccagggactgatctaagtacttttcatgcacactgcttttcttttctttttttctgagatggagtctcactctgttgcccaggctggagtgcagtggcgcgatctcgactcactgcaacttctgcccacagagttctagcgattctcctgcctcaacctcccgagtagctgggattacaggcgcccgccaccgcacccagctaattttttgtatttttagtggagacggggtttcaccatcttgggcaggctggtcttgaactcctgacctcgtgatccacccgccttggcctcccaaagtgctgggattacaggtgtgagccaccatgacccacctcatgcacgctgcttttctaatttagtgtcttataattgtggagctatgtcttgtgaaaaggtatttccaacaagattctctgagatagttttcccatgtgctttcagtgcctcaggggtggggtagtccataggagcccctgttacccattcaggagtgggtgaggggagaccccagggaccaatgccagcaggaagaggtggggtggttgggaggatggagattgcacatgcttggggacagcttggaggtgcgtgttagaatttttctgagaggggttaaggtgctgttttgtgaagcacaacgagttagtgagtgctaaatctccatgacccctgccgtctatatggcttggatacgtcatgtcaacctgacataaagccatgggtgaacattctctgggaccccacctgtgtgtggggaaaagcaagagagatcagattgttactgtgtctgtatagaaagaagtagacataggagactccattttgttctgtactaagaaaaattcttctgccttgagattctgttaatctatgaccttatccccaaccccgtgctctctgaaacatgcgctgtgtcaactcagggtgaaatggattaagggttgtgcaggatgtgctttgttaaacaaatgcttgaaggcagcatgctccttaagagtcatcaccactccctaatctcaagtacccagggacacaaacactgcggaaggccgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtataagaggaaggcatgcctcttgcagttgagacaagaggaaggcatctgtctcctgcccctccctgggcaatggaatgtctcggtataaaacccgattgtacgttccatctactgagatagggaaaaaccgccttagggctggaggtgggacatgcgggcagcaatactgctttgtaaagcattgagatgtttatgtgtatgcatatctaaaagcacagcacttaatcctttaccttgtctatgatgcaaagacctttgttaacgtgtttgtctgctgaccctctccccactattgtcttgtgaccctgacacatccccctctcagagaaacacccacaaatgatgaataaatattaagggaactcagaggctggcgggatcctccatatgctgaacgctggttccccgggtccccttatttctttctctatactttgtctctgtgtctttttcttttccaagtctctcgttccaccttacgagaaacacccacaggtgtggaggggcaacccaccccttcacatgtgtgattaaatagttgaagttttggcatccttttacaatgagagaatagcacaggatttacatacaatttttggacatccaagttcaccacaatacccatattgtctgaaattatgtgccatggccctgaggggagtcatgatccctcccccaaagatggttgtggctgtcaggacacagcaagtacccacaattccctcctggtgaagagtgcctctgtcctacccagcctgtgcctcactcctgagcaaatccgctgtcagcagtgtgaatgcaggagacacccttggtcccccaaagaatctgaggaacctaggggcatccagtcctgggacaaggatctatgtagacatcatacaagtttagcaccacccatagtggagtgctgggctaagcctacttagacagatatcaccctcctcacccagtttcccctgtccttgtgaaaaggaagaaaatgatggttcctggtctgtcttgtgctcaaatctgacccggctcccaaccagctgtggctctggatgagtcccttaccttctttgatcctcattcctcctcccagggtctggttgcaattcagaggatctgaaaacctagagtgtgtgtgaaaccatctctaaagtgtgtgtggaggtgagtgggaactcgggaaacaccgagtttcatatattgaactgttcctcccacttgcatgatggtttcacaacacagtttagtggctaaagaatatgtgacttggagccaggtctgtgggttggatcccagctctgttacttaagagatgagaccttggccaggcacagtggctcacgcctgtaatcccagcactttgggaggtcgaggctggcagatcatctgaggtcgggagttagagaccagcctgaccaacatggagtaaccccctccttactaaaaatacaaaattagccgggcgtggtggcgcatgcctgtaatcccagctgctcgggaggctgaggcaggagaatcacctgaacctgggaagtggagataatgttgagccaagatggcaccattgcactccagcctgggcaacaacagtgaaactccgtctcaaaaaaagagactagaccttggcaaataacagggacactatgctctcctcattttagtatgggaacagtagtattttgataggattaccatgaggattaaattagtaaatacaaagagcatacaaatgtttacagaagtcacagggctgttagaagtcagaatggccacccttgggtgcagacaggagaggtggtctgagagtgatcagagggagcagcaaagacacttcaagatcccagaaactggcccggtgcggtagctcacgcctgtaatcccagcactttgggaggccgaggcgggcgggtcacctgagatcaggagtccgagatcagcccgggcaacatggttaaaccccgtctctactaaaaatacaaaaattagtcgggcgtggtggtgggaacctgtagtcccagctactccggaggctcaggtaggagaatcgcttgaacctgagaggcggaggttgcagtgagcccagatcacaccattgcactccagcctggggaacaagagcgagactcaggctcaaaaaaaaaaaaaaaagtcatactaaacaatgtcataaatttatatgagaccgaccctggccggacgcccccgctccgcccttcctgcgggtccgggagtcgatcccccaccgtgctccccaacccccgcaggccacccgggggcagagagtgggcgcaaggggtgaacgttcgctgcctccgatcccgggggaaacggagcgccgagaacgtcgacgcccttccgcgcccgtcgggcctgggactgatacccggtctggcccggaaccccccaggcgcgcccctagctggggccctggcgaccgccgcgccgcaggggctagaagccgtcgagacgcgagcgccatcgaggcgcgcggtcctccaggcctcccagagcggcgcagcggccgtttccgggggcggggaaggaaccggagcctgagagccgggcgccgtgcgctcctccccgcgctgtctcggcggcccagggtgagtcggccgcggccgcggggcggggactgggaggggcgcggtcctccgagcccggcctggtggaggctgtagcccccgcagtgggcgcgcggagctcggcagggagcggacccgcagccgtcactgtcgcctccgctcgccttgggttccgaacccttatcggggcgaagggccctgcgccccggtccatgctggctgtggtcgggggcgtgcggccgggcccccgagacccgctccgccgagccggacggttgcgcagagatgaggctgcaggcggggaggcctggcgaggtggggctgctccggggaggaccaggctctgcccctcgcttccgtccgatggcgggctcttcccggcagcctcgctccccggcggacgccgtttcccgcagcgttcatttaccctgcgcagttttgccccctccccgggttggggcatttattggaccaacagtcatttcgtaaatagctgttgggtatttaactgtgagcgttccggtgctggggaccccgcagtgagcgaacagcccgcctcgcctccaggagcatgaattgtaatagaggtgaggcgttagtgtaacaggcaataacgcagcaaaataacttctggttttgacaagggcctcgcacagaataaaccaaggaaataaaattgtgagagttagggggttagggtagccttggcggtcaggggaggctctgtaaggagttaacatttggccgtgcgcaatggctcacgcctgtaatcccagcactttgggaggccgaggcgggcggatcacgaggtcaggagatcgagaccatcctggctaacacggtgaaaccctgtctctactaaaaatacaaaaaattagccgggcgtggtggcgggcgcctgtagtcccagctactcgggaggctgaggcaggagaatggcgtgaacccgggaggcggagcttgcagtgagccgagatcgcgccactggtctccaggctgggcaacagagggagactctgtcgcaaacaacagcaacaacaaaaaagagttaacatttgaactgaaacctgctggaggagagaagcagccacagatccctgaggagaaactcccaggcgggggaacagagagaaggctggcatggctgcggcgtagtgagccgggtgccccaggtccccgaggaacagggcttattctgcgtatggaaggaggtgacccctcctagtcttccagaccccagttaaatgagttcccccagtaacatttcttggtggtccttcatctaaaattagcaccctcctccccttgacattttctgtctcagcaacagcttgatctgttgtcatcatatcactgctccattatttttagctcagtgctgtttaatctgattgaaggtttacttcctaattccgaagatagaactaaaagcaggtttttttcccctctaaccaggtagcccctccctgaggacatgcactccctagacatgagcaaacacaaagcagcagtaacttaccgctcctagtccaagtcctaccctagtcctgggttgcagttcttaccagagtggagggtggtatgtgttgaggggtcggggatcaagtcttctggcagcctcataccctgagatactctggttgccttgttggggtgaggacaacacgtgtggccatcgcagtggcccaggtgggtcctgccacagactgccctggacagacagtgagtgggggctgggtgggggtggtgtggccctgctcttccatgcgtttgcagtctgtgccctctgtgcaggggtgattcacgaatctgtctgatccacccccatcgcccttcgtaccctaacatgtcaaaagggctctgctgccaaatgtcacttcatagcattgtgaccaagcagccctcctgcctctaaacgcactctttatttttatttgagagagaacctcactctgtcgcccaggctggagtgcagcggggcacacttggctcactgcaacctctgtctactcaagcagttctcctgcctcagcctcccaagtagctgggattacaggtgcgtaccagcacactcggctaatttttgtatttttcgtagagaagggtttcaccatgttggccaggctggtcacgaactcctgacttcaaatgatccgccctcatcggcctcctaaagtgctggaattacaggcatgagtcactgtgcctggcctctaaacacatgctttttgttaactgatgcctaaagggaaacatctctttacaaagtggcagctacttagacggctccagctctacagaaatggatagccccggagaccttcacccaaacacaagagctcaagtgtctgttgaagggaagagtgaggagaacagggcctcatgcctactctgtatacgtctgcttagagcaaaattattgttttgttttgtttgagacagagtctcactctgtcgcccaggctggagttggtggcatgatctcggttcactgcaacctctgcctcctgggcttaagggatcctcccaggatgaccaaggttgcaccattgcactcccgcctgggcaacaagagcgagttgtcggagtctcactctgtcacccaggctggagtgcggtggcgcgatctcagctcactgcaagctccgcctcccaggttcacgccattctcctgcctcagcctccctagtagctgagactacaggtgcctgccaccatgcccggctaattttttgtatttttagtggagatggggtttcaccgtgttagccaggatggtctctgtctccaccgcacctggccaaaaaagtgttaaattagaaaaatagaaagaggccgggtgtggtggctcacacctgtaatcccagcactttgggagaccgaggcaagagatcacttgggtccaggagttcaagaccagcctgggcaacatagtaagacctcatcaataataaaaacttttaaaaattagctgggtgtggtggcatgcgcctgtagttccagctactcgggaggctgaggtgggaggattgcttgagcccaggaagttgaggctgcagtgagctgagatcacaccactgcgctccagcctgggtcacgcattgagaccctgtctcaaaaaaaggaaagaaaaataggagaaaaagaggaaccactcataattctatgacgcagagagagctagagttttatgctaccagctttatttttctgcttacagtctgcttgtttcatgtagtaaaatgcaagaatgttttctgatgttcccacaacatggttttattggttgcagagtcacccattgttcatttcataatgagcaatgttgcccaggccggagtgcaatggtgcaaccttggccatcctgggaggaaatcttaagcccaggaggcagaggttgcagtgaaccaagatcacaccaccaactccagcctgggcgacagagcgaaaccccgtctcaaacaaaacaaaacaataattttgctctaaccagtcacgctttgttcatttcataaatcctttctgagcacatgctgtgtgccaagcccttcctcaggccctaggggtacagaccagaggccttgtctaattggggaaggcagataaggagcaaggaagttaacttgtcttatgtcagatggcatagtgctatggagaaaaataaagcaaggagcgaggataaggaattcccaggcaggaggggaggtggcagtttaaaaaatggtggtcacagaaggcctcccagcaaggtgagagccaaaaaacattggaaggagtgggtgttcccatggagaagcttggatacacctccttgggacgtgaaggaggcggctgatgtgattgccctagcactttaccctctcctgctcccttctggatctggaggggccttctggggggctggagggccttaggcctgggctctttccactcatggctctatgttccctcagaattcactgtctgtagcatctgctcctccacagagggaccctggaatggcgatggcactcccgatgcctggacctcaggtgagcaccccctgagcccgtccattgccccaggagactgcttcgcccctagcctcagcttttcagccctgagaaccttacagcttgcctcacacccacccacatcacaggatggagtctgcaagccgaggacagcctcctcgctctatggccaggcctcacacatggctctgccaaatccttccagcctttgggcagaagtgggcttcctgcggcctcctctggcccctgagcttctatggtcagccattgagggcagggtccctgtccttccccagtgcctgcctccttcctggtgtgaatggtcagcccatcctccctctcctgatgctgactcactgctggtgttagaaattgagacccagagggtggggatgctccccacagtgcaggtgctccttccccaaatccctgatagcctgtggagagggcgaggccaaggttgggacccccttcctggtaaatctctctccctcccccaagttcagtttttccctcttcctctctggggcttctgctgagaatgaggccgctcactcggggggtgttgggctgccctttctctgctgggccctgtggatgcagcagtgggcagcaaggagagaggcctctagcagatcatgcaaatgtttctcatctgctgggttctcaccgagcccttgactgcctggatagcagagtatgtggttgcaggaggcggttgtgttcgaggatgtggctgtgtacttcacaaggatagagtggagttgcctggcccccgaccagcaggcactctacagggacgtgatgctggagaactatgggaacctggcctcactaggtgagggcttctgcctttggtcctggggccgggaggtgcgtctgtgttagcttcaaaggaagttggttccattgcagattcaaggtctgacacatttttgaggggaagctggaggctccccaaggagcccctctctgcttcctgttgggcacccactgccagcgtcagcctgcctgaggcttctctcctggggcaggccccccatctccccctggccacctagctgcccccttctgggatagtgaatgttcctgacccactccaagcactctgtgccctgatggcctccagccaggcacctgggcgtcccttctccctcctgtactgatacgtgctgctttccttctctgagcttaggctttcttgttgccaaaccagcactgatctccctattggagcaaggagaggagccgggggccttgattctgcaggtggctgaacagagcgtggccaaagccagcctgtgcacaggtgagtacaaagcacccacagggcgtgtcctgtgctgccaatgtggcctggcctccgggcagctctgcaggtcccttcttctacagtgggaggtgtgtatgtttagctcctcacagcagggccagatttcctactaactgccttgcttgtaggtctaaggtcaaaactaacttatgcaggaagacccaagtgcgagagttttccattttggtgtccccaaggtgtcaggggccgggtctgtgctcacagtgccattacccttgggttgtgtagggaccagccctacagggtctgtgggtttttctcctcatgtgcagagacgagagatcatagaaataaagacacaagacaaagagatagaagaaaagacagctgggcctgggggaccactgccaccaagacatggagactggtagtggtcctgaatgcctggctgcgctgttatttattggatacaaggcgaaaggggcagggtaaagagtgtgagtcatttccaatgattgataaggtcatgtgagtcacatgttcaccggacagggggtccttccctgtttgacagccgaggcggagagagagacaggacagcttacgccattatttcttctatgcattttaatgacttttagtactttcactaattctgttactgctgtctagaaggcagagccaggtgtacagggtggaacatgaaagtgaaacaggagcatgaccactgaaacacagcatcacagggagacggtcaggcctcagcatggctgtgggcgagtttgactgatgtcaggccttccacaagaggtggtggagcagagtcttctctaactaccctggggaaaggaagactccctttccaggtctgctatgtaactagtgccttcccaggcactggggttactgctagaccaaggtcaactaagtaacgggcgtcttcccaggcactggcgttaccgctagaccaaggagccctctagtggccctgtccgggcgtgacagaggctcacactcttgtcttctggtcacttctcactgtgtcccttcagctcctatctctgtatggcctggtttttcctaggttataattgtagaacagagattattattattattatttttgagatggagtctcgctctgtcgcccaggctggagagcagtggcgcgatctcagctcactgcaagctccgcctcccgggttcacgccattctcctgcctcagcctcccaagtagctgggactacaggcgcccgccaccatgcccggctaattttttgtatttttagtagagacgaggtttcaccgtgtgagccaggatggtctcgatctcctgaccttgtgatccaccgcctcggcctcccagagtgctgggattacaggcgtgagccaccgcgcctggccattatttttttttttgagacggagtctcgcactttggcccaggctggcgcgttctcggctcactgcaagctccacctcccgggttcacgccattcttctgcctcagcctcccgagtagctgggactacagacgcccaccaccacgcccagccaatttttttttttgtatttttaatagagacgaggtttcaccatgttagcgaggatggtctcgatctcctgaccttgtgatccgccgcctcggcctcccagagtgctgggattacaggcgtgagccaccacgcctggccagaacagagattattataatattagaataaagagtaatgctacaagctgatgactaatactattcatatatcatcatatctataatctctttctagtataactattcttattttatatattttctttattacactggaacagcttgtgccctcggtctcttgccttggcacttgggaggcttgcttgcccacaggttgctttggtttcctggttccctatggcccatgtgccagggactgagctcagggcagtggaggctgcagaaagaaccttgagctggggaggaggcccccagtcccagaggtctgcgcaggcacctgctctacgcacctgcccagacatgtttgctgagtgcaggaactgtgggtgaactctgaaggagagaggagtaaagaacatggctgtggggtgaggtacaacttgcacctcatgcctggcctgtcttccctgccagaccttgggcctctcctatgggctccccttgagctagcctcccacagtgctggagccattattagcctttttgttcccttctcacccgaaccctgattttattttatttttatttttattatttttttgagacaagagttttgcttttgtcgcccaggctggagtgcagtggtgcggtcttggctcactgcaacctccgcttcttgggttcaagcgattctcctgcctcagcctcctgagtagctgggactacaggcgctcgccaccgcacacagataatttttgtatttttagtagagatggggtttcaccgtgttggccaagctggttttgaactcctgacctcaggtgatcggcccacctcggcctcccaaagtgctgagattagaggcgtgagccactggacctggcctgaaaccctgattttaaaacctctggcaataatttctcaaacctccctacacgtctaacaaagactctgtcttcacttgattgtggtatcatttcacagtgtagatgtttattgaatcatgttgtacaccaaaaatatatacaagttttgttttaagacagtctcactctttcgcccaggctggagtgcaatggctcgatctcggctcactacaacctctgtctctgggttcaagcaattctcctgcctcagcctcctgtatacaagttttatttgtcatttatacctcagtaaagctgggtgttgggggaagacttgggaataaaaaggttatgtcttcaaacaagaagttcgtttgtgagtgtagaggctggatcatccttccgttttctgttccttctctcagattccaggatggaggctgggatcatggagtctcctctgcagagaaagctctccaggcaggcaggactgccgggcaccgtgtgggggtgcctcccctgggggcaccctgtgggggg

SEQ ID NO: 2537 - DNA, 17974 bp, Homo sapiens
tagtagtgtagatatctcttggacatactgatttcctttcttttgtgtacatatacagctttgggattgctggatcataaggtggcctgatttttagttttctgaggaatgttcaaattgttctccatagtggttgtactaatttaaattccaatcaacagtgtacgagatttcccttttctccacatcctcatcatcacaaattaaaaatttataaatacacatttataacactgatacaatggtagacttaaaagtcattcaaaaccttttttaaaacttgaaaaattatttcctgaacatggataaatgaaactacatcaaaattaaaaacttctgtgtctcaaagatacaatcaaaagagttaaaaaggcaatcttaaaaatggaagaaaatatttgcaaataatacatctaataaggggtaatggccagaatctataaggaacttctacaatcaacaacaaaaagcatttaacttaatttaaaaagggaaaagatttgaatagacatttatttaaagaagacatacaaatgaccaactagtatatttctatggtctgaatgttcctcctaaattcttatgctgaaatcctaacactgaagtgatggtattagaaggtaggcattttggcagcagattaaaccatgagggcagatccctcattaatgggattagcacccttataaaagagaccccagagagccaactttccttccagcatgtgaggatacctcaagaagacaccatcatttgagccaagaaatgggccctcagtggattcagaatctgcaggggccttgatgttggactttccagcttccagaactgtaagaaataaatttctcttatttgtgaattaccaagttgatggtacttgttatagcagctctaacagactaaggcacatatggaaagatgctcaacctcactaactgttaggggatacaaatcaaaatcacaatgagatatcacttcacatccatcagggtggttagtactttaaaaaacaccccaaataacaagagttggcatgatgtagagaaatggaaagacttgtgccctgtttgtgggaatataaaatgatgtagcatagttgtaatggaaaacagtgtgatgttccttaaaaacttaaaaatagaattactatataatccaaaatttccacttctgggtatatatcccaaacaatttttcaaagcagggtttgaagaaatatttatataccatgtttataaaagctttctttactgtagccaaaaggtagaagtaatccaagtgctcatcaatggatggatgaatagataaataaaatgtagtgtatacatataatggaatattattaagccttatatgcattccattaaacacatcatggaatattattcagctttttacaatggagtattatttttcataatattattcagtaaaatgtggtatatacatataatgaaatgttattcaatcttattctgacacatgctgcaacatggatgaaccttgagtacattatgctaagtgaaataagccagtcacaaaatagcaaatactgtatgattgcacctatatgaagtatctagagtagtcaaattcataaaaacagatagtagaatagtggttgccagaggcttagggatggcaggagctggaaggagtggagagatgttatttaaggagcatagaatttcagttttgcaagatggaaaagtctggagattagttccataatgctgtgaatgcagttaatactactgaactgtataccaaaaaatggttaaggtggtaaattttctgctaactgtactttatcttaattttaaaaataggtaacaagggcaacattattccttggaaaacaatgctaaaatataacttagctaaattcagcccagccaagcagtgattaaaggatgaggtagaggggaatcaacattggagaagggatgtagaccaaaagcagcagatgggcatgggctcgaggaaaagtcatcattcctggtctaggggttggctttcagatttgattattctaggcttcagagttaagaaggacataaccaagtcacaagagtttatatacagaaaggtaaatttttgaaagtacagtattctctgtggataataggtaagtgttaattgcactaagttctttcctagtggattaatatatccagaagatcaataatttccttgttgtgactgtcacaaaaagcaaggaaatacatgatttcaaacaatgcttctcccacattgtttaacttaacagaattaaataacgagaatagtgttaatacgaagaatgaaatagctaaattctagaaaatgtttattgtcagtcacacattgttaacacttacaaattaatcctcatttcacctcatgaggaatacctgcatttttcatatttattgaatgtgtaccagtggccaattccatttagtccctatagatatcagtgtctctgatggttaattttaggtgtaaacttgattgcattaggaatacctagcaattttggtcaagcattattttggggtgtatcccagggtgtttccagaggagattagcatatgtgtcttaatgggctaagtggggaagatccaccttcagtgtgggtgggcaccatgtgatctgctgggaatctagagagaacgaaactgataaaagacagatgcgtggatctatccactgaaaccatgatgcactctttctcccctgtccttcaacaacaagtccaagctccccgatctttggactccagggcttaaaccagaagcccttcggttctcaggactttggcctgggactgagaatttcattatccacttcccttattctgaggccttcagacttgaactgagccacactaccagcatcctagggtctccatatttattatatgtaattattatatatatttattacatctatatacatatatatactgattttgtcttgctggagaaccgtgagtagcacagtgaccaaagcggacagtggtaagttatattattattcctatttacagaagaaaatacagaagtatagggagttattgaattgtggagccactgttggaatgcagaaaatctgactctgaatcctcagctcttacatgctcttgggacatgttttggtcaaaagaaccagaggtgatttctagactgatcaatgcttttccagtagagtcctgcctaaggaataaaaaagtcattctcttcagctgttatgcttcttcactgtaaagtcccatttgcttatgccagatgtgtttcataatgaatatattgagccctattttacttacacatgttctatcctagttttgtctccttgagaatttatctttataaattcaaatacatttgaaaaataatttgttcatcccagtaatatacacaacataatcatggtacaattattcaaacaaataaattaacattgatattatattaccatctaaactttagatttcatccgtttttttcattaacattatttttctgtttcaagaatcaatccaggatcccacactgcatttatttgttttatttctttagtctcctccaatctataacacatgctcagtctttcctagtctttcattatcttgaggcttttaaataaaattgatcagctgttttgtagaatgtccatcaatttggatatgtgtggtattttctcatgataacattgaatttacagatttaagagaagcataccccatcattgccaagatcttggcctgcctgcctatgtgtacaaacatgtatgacctacccaggcacagagacaaaagaagctctttcccctggtcccagagtgcacattcagttcatttgtgcatatacccatgtctaggtgtcttgatggctattgagggagttggtgtggtaccctagtgctattagtgcaggacacagcttgcttaacatggaatcacagcaacccttttaaaaggcataggtggaatttccattcacataaggtttgtgtttgcatgtgtttttgactttttaaagacttaattgtcacaagtttcatgattaactgtcacaggctgctatataacaaaactttagctactcacattcatgcctaatagttctaatatattatttatctaggtttgatatccttgtttcatggaccctgttagagcaaactaaatacagcttgagaaggactccatacttctatatttaagtccttgtggatgaactgcaacctaatttaataggtagacaagattgaaaacctaacttaagaatatgagtctgtatcaatagctgagtcttgaccaatcccagcagccatacctcaaccagtcatacactgctgagtgttcaaactgtgttcaaataaggcaaatgccaagctgtaaccaatctagctgtttttgtagctcacttctgatttctgtacgtcattttactttttttgtctataaatttgttctgactacaaggcaaccctggtgtctttctgaatctgctgtgattctgggggctacccaattcatgaatcgttcgttgctcaattaaactcctttcaatttaatttggctgaagtttttcttttaacaaccttaatcctcaggaagggtttctaattctaaatgtaactacttagtgcaaagtgcaccaactggaaagaaaataaagataattaaagtgtcattgtcttctcaactaagttaaatgaatgaattttgcaaaggtctttgctgcattcgaaattgtgatcttgcaatgtctacattaatcacatctttccttatgggagatacctgcctttatgtcttctgttcaggtgttgtttcattttgttttgtttttaaacgaagtctccattgtgaccagaattcatgagatgtcttggatttcattggccctatgaataatttttcctgcactgtgataacttactgagtcctagggaggaaacagaattttacagctgacactggaataacccttgcccctttcaatactctcagtctgctgtggtatcagggtaacctatgctgaagacactgatgttggccacatctccatgaggaaactctgtgctcttagcaaccactttaatcttctctcctaattgcaatgatctgaacagttgacttagtgctcccactggaattgttccagctcttgagtaccttcttcaagttaatgttgtgagctttagatttttaaacaaatgagagccctgggtcttctgcagtctcttcaagtggaattagaatttggaaacttttgaatagaagcacagatgagtttttgcattcctaccagctctttgggtgcagatctgtgggcagggtgctttccactaaccatggttgtgctgaattggacttccttgggttgtaacccttgtagctcatgaatcacctggcaggaaggagaagcaaagccatgctcaccccttgccctgaggcttcagaaacttggctgtctccagctggtgctgcatagtgattgatccttagccaagtcttcctgtgcaccagggggctctccatgccctttttaggtttactagatgcactttacctggggtgggggtggaggaagtaaagtgaagttcgcagcaggacctgggggcaagggtcagccacctcagtgctcatgcactccattgcactccctgcccaggttcctccagatttgccactcagttccccaatactgtagcatatataacatgtaaattataaacataaaattataaggcccccaaaccacctgaatgaacttcctcctctgacagggtattcttaaaatttaacctgaaagactggttcaggcatgacagttggacatgcttcattggaactctccctggcattaacatcaacacagaacttaagtctcataagaagcttttacaatctattctctctgaagcctgctacctggaagcttcatctgcataaaattttggtctctacaacttattgcaacccaggctttcctttctattaataataactctttcaaccaattaccagtcagaaaaattttaaatctacctataacctggaagcccccatgcttcgacctgtcccacctttctggactgaaccaatgtatttcttaaatgtatttgattaaagtctcatgtctccttaaaatatataaaaccaagctgcaccccaacctcctcgggtatatgttcttgggatctcctgagccaagtgtcacaggcaatggtcactcatatttggctcagaataaatctcttcaaatattttatgaaatttgactcttttcattgacaatagctccaggatataaaaaatatatggctgtagcttactgttccaggacaagatatcagtgtggagccaagtcataaaaaatttgcatccagaaaatataatgaaagtaagttacattaaaaaaacaacagcaaccaaataatggaaggggttatcacatttgaaatgtgttagggaatcacaattgaaaggtgttagggaatcacaaagacagagtcaggtttatcaaaaaatatgcatgtcaccctgctcctatcctggtttcccaacaagtgattgaagaggaaagaaaagataggaacaaacattgtttaatatgtaaatcagagcactctaacccatcaataggagaaaaggaatttaaaattgggtctctaatctgaggtagagatttgagcgatctctgcgaagttgaaaccctgcgttactgtctggggaattcacacctgggcaatttacacacacttactgattaacttcttcagttaacaattttgagcagattacctcagtatgcttcaattctacccaaataggtagcaaacaggtgtcaattgggagtcattatagtctctgaaatctctttacttatggcagtgctctaactcagagtcaaggtggaattgatccaagctcatttgttattcaaagtgagagtgagaattttctcatgatagtaaagtcaagggacagaatctgagaataggaaagaatttctaaaactgacaacttacttgtaagaaagagctaatgtgccttcaaatgagattttttttcctgatttccattggagttctgcacccagattggctggctgtactgattccttatataacagaatacatagagggagggatggaacaggaggcccttggaggctggccaggctggaggtaaggaacacatcctgacccttttttccccacatagccatccattgccaaaaaaagttaaaatgtgcctgaggctgggagtattttctctaagatacaaacattaagaaaaagtgcttattcccatactggggtcagttcctgacaggaaagagcctctttttaactctgaaatgaaatctcctgccagggacacacttctgcataagcagaaaagctgctcctcacagacttggccgctgtcttggtgcattttggtcatcggtggctctcttttcctgtaaatgttttaacagcctcagagtaaaatggagcctattgtggaagactgagtgctggtggcatggggctcaaaggatttaccaagacagttgtaggtaaaggaaggcagaaaatttattaggaaaatatgttgccagagagacaacaggcagccagtggaagagaagctgactgccaggagagaaaggcttgctggagattttataggataaaatctatgctgtctgttgaagagggctttgtgtggtattgataacacaaaggttgcagtgagctaacttgcagatgtctactgatagctgggtacagaaatattatgaatgatttgagcaggaggactgtgtgtcccagactataaagaaaagcaagcttgttttctacctgcttcctctttttgctttctcctgctcccaccagccctactcttttttccgaattaagactccacagaacctgccttttatttcccctttgcaaagctactgttacatcattataaaagggacattccctctttttccagaaatattcctaagaaaagaaaaacagcctgttatataagagtgtctgaaaaaactagaactttcactcaaggtcggctttaatttgcagttttgtattcataaggggaaagtgatgggcaaaccccacaagagaacagaaatcagctgtgtgaataggcactgcaggctaatgaagagtgaagaggagagcacagtgggaatttctagaggaagagaaaggaatctaatgtgatatgggagtgaaaaatgggatccagaaaagcagagaggaaatggggaagtggaccaggtctcagaaccagcaaaggctactatgtatatttcacttagtttaggagactaacttcatatgggagcgtatgctggaattctgagagccagaaaaggaacgtgccaggtgccagaatcagttaataggcattatgtgtcttctgcatttcaatctacatgctgcttcttttctttcaggtattcatacaaaccaacatttcctgactgaatgcaaataggacacttctttgaaatgaggagcgacaaatttttaacctttctagaattcatgacagaatactgttttttttttttttttaacgctgtctccattgaaagtcagttactgaatggtaggacacaattcttatgaattttgtagaaagacaaataatattctcatctacaactgtgtgaagaaaaatagaaaaatacttgccatgtgttaaatccttacactatggagaatactatgcaaactgctttcaactgcctgcgttcatttaagaatcacaacaactatgtaagtatttctaatcctttctatttataagaaactgaggctcagagatattaagtgctttttttcaacatcacacatacatgcaaacagagtgaaatttcaatgttaaattttttattgttatttacaactaatgtgtaagctttgtattgggaatttctgcaataattttaactctcttttgattcctggattatacacaactctctcctgctctctgtatatccttggttcatgttgtattttcggctgattttgaccaatcttttattttattttgtatttttatttattatttacttattttttgaggcagagtctcactctgtcacccaggctggagtgcagtgacgctatctgggctcactgcaagctccgcttccagggttcacgccattctcctgcctcagcctcccaagtagctgggactacagaaacccgccactacgcccggctaatttttttgtatttttagtagagaaggggtttcactgcgttagccaggatggtctcgatctcctgacctcatgatccgcccacctcggcctcccaaaatgctgggattgcaggcgtgagccaccgcgcctgggccctatgttttgttttgttttgttttttattattatactttaagttctgggatacatgtgcagaatgtgcaggtttgttacataggtatacatgggccatggtgatttgctgcacccatcaactcgtcgtctccattaggtatttctcctaatgctatccttcccctagcccccacccccaacaggctccagtgtgtgatgtttcccttcctgcgtccacgtgttctcattgttcaactcctatttatgagtgacaacatgtggtgtttggttttctgttcctgtgttaatttgctgagaatgatggtttccagcttcatccatgtccctgtaaaagacatgaactcatcctttttatggctgcatagtattccatggtgtataggtgccacattttctttatgcagtctatcattgatgggcgtttgggttggttccaagcctttgctattgtgaacagtgttgcaataaacgtatgtgtgcatgtgtctttatagtagaatgatttataatcctttgggtatatacccagtaacgggattgctgggtcaaatggtatttctggttctaggtccttgaggaatccccacactgtcttccacaatgtttgacctaatttacactcccaccaacagtgtaaaagtgttcctatttctccacaccctctccagcatctgttgtttcctgacttttttaatgattgccattctaactggcgtgagattgtatctcactgtggttttgatatgcatttctctactgaccagtgctgatgagcttttttttcatgtgtctgttggctgcataaatgtcttcttttgcgaagtgtgtgttcatatccttcaccccctttttggtgttttttttttttttttttttttttttttgtaaatttgtttaagttccttgtagattctggatattagctctttgtcagatgaatggattgcaacagttttctcccattctgcaggttgcctgttcactctgatgatagtttcttttgctgtgcagaagctctttagtttaattagatcccatttgtcagttttggcctctgttgccattgcttttgatgttttagtcttgaagtctttgtccatgcctatgtcctgaatggtatcgcctaggttttcttctagggtttttttggttttaggtcttacatttaagtctttaatcgatcttgagttaatttttgtacaaggtgtaaagaaggggtccagtttcagttttctgcatatggctagcaagttttcccaacacaatgtattaaatagggaatcctttccccatttattgtttttgtcaggtttgtcaaagatcagatggttgtagatgtgtggtattatttctgaggcctctgttctgttccatggttctatttatctgttttggtaccagtaccatgctgttttggttactgtagccttgaagtatagtttgaagttaggtagtgtggtgcctccagatttgttctttttgcttaggattgtcttgactatatgggctcttttttggttccataagaaatttaaagtagttttttctaattatgtgaacaaagtgaaaggtagcttgatggggatagcatctataaattaccttgggcagtatggccattttcacactattgattcttcctatccatgagcatggaatgtttttccacttgtttgtttcctgtcttattttgttgagcagtggtttgtagttcttgacgaggtcctttccacttgtttgtttcctctcctatttccttgagcagtggtttgtagttctccttgaagaggtccttcacatccattgtaagttgtattcctaggcactttattctctttgtagcaattgtgaatgagagttcagtcatgatttggctctctattattggtgtataggagtgcttgtaatttttgcacattgattttgtatcctgcgactttgctgaagttgcttatcagcttaaggagattttggactgagacaatagggttttctaaatatatactcgtgtcttctgcaaatagagaccatttgacttcctctcttcctatttgaacactctttatttctttctcttgcctgattgccctggacagaacttccaatactatgttgaataggagtgatgagagagagcattcttgtcttgtgccagttttcaaaaggaatgcttccagcttttgcccattccatatgatattgactgtgggtttgtcatgaatagctctcattattttgagatgcattccaccaatacctagtttattgagagtttttagcatgaaggggtgttgaattttatcaaggccttttctgcatctattgagataatcatgtggtttttgtcgttggttctgtttatgtgatggattacgtttattgatttgcatatgttgaaccagccttgcatcccaggaatgaagccgacttggtcttggtggataagctctttgatgtgttgctggatttggtttcccagtattttattgaggatttttgcattgatgttcatcagagatattgacttgacatttctttttttttgatgtgtctctgccagtttttggtattaggatgatgctgacctcataaaatgagttagggaggagcccttctttttctattgtttggcatagtttcagaaggaatggtaccagctcctctttgtacctctggtacaatttggctgtgaatccgtcttgtcctggactttttttgttggtaatctattaattactgcctcaatttcagaagttgttattggtctactcagggattcgacttcttttttttttcaattttttttttattatactttaagttctagggtacatgtgcacaatgtgcaggtttgttacatatgtatacatgtgctatgttggtgtgctgcacccattaactcgccatttacattaagtatatctcctaatgctatccctccccactcccccaaccccacaacaggccccagtatgtgatgttccccttcctgtgtccaagtgttctcgttgttcaattcccacctatgagtgagaacatgcagagtttggttttctgtcctagcgatagtttgctgagaatgatggtttacagcgtcatccatgtccctacaaatgacatgaactcctccttttttatgactgcatagtattccatggtgtatatatgccacattttcttaatccagtctatcattgatggacatttgggttggctctaagtctttgctattgtgaatagtgccacaataaacataagtgtgcatgtgtctttgtaacagcatgatttataatcctttgggtatatacccagtaatgggatggctggttcaaatggtatttctagctctgatcgccatgctgccctccgcaatggttgaactagtttacagccccaccaacagtataaaagtattcctatttctccaaatcctcaccagcacctgttgcttcctgactttttaatgatcgccattctaactggtgtgagatggtatctcattttggttttgatttgcatttctctgatggccagtgatgatgagcattttgtcatgtgtttgttggctgcataaatgtctttttttgagaagcgtctgttcctatcctttgcccactttttgatggggttgtttgatttttttcttgtaaatttgcttaagttctttgtagattcttgatattagccctttgtcagatgggtagattgcaaaaattttctcccattctgtaggttgcctgttcaatctgatggtagtttcttttgctgtgcagaagctctttagtttaattagatcccatttgtcaattttgacttttgttgccattgcttttggtgttgtagtcatgaagtccttgcccatgcctatgtcctgtatggtattgcctaggttttcttctggggtttttatggttttaggtctaacatttaagtctttaattcatcttgaattaatttttgttctgccctctcttaccactcctattcaacataatgttggaagttctggccagggaaatcaggcaggagaaagaaataaagggtattcaattaggaaaagaggaagtcaaatcgtctctgtttgcagaagacatgattgcatatttagaaaacccaaacacttcagcccaaaatctccttaagctgataagcaacttaagcagtctcaggatacaaaatcaatgtgcaaaaatcacaagcattcctgtacaccagtaacagacagagagccaaatcatgagtgaactcccattcacaattgcttcaaagagaataaaatacctaggaatccaacttacaagggatgtgaagcacctcttcaaggagaactgcaaaccactgcttaatgaaataaaagaggatacaaacaaatggaagaacattccatgctcatgggtaggaagaatcaatatcgtgaaaatggccatactgcccaaggtaatttatagattcaatgccatccccatcaagctactgatgactttcttcacataattggaaaaaactactttaaagttcatatggaaccagaaaagagcccgcattgccaagccaatcctaagtcaaaagaacaaagctggaggcatcacgctacctgacttcaaactatacttcaaggctacagtaaccaaaacagcatggtactggtaccaaaatagagatatagaccaatggaacagaacagagccctcagaaataataccacacatctacaaccatctgatctttgacaaacctgacgaaaacaagaaatggagaaaggattccctgtttaataaatggtgctaggaaaactggctagccatatgtagaaagctgaaatgggattcaacttcttcctagtttagtcttgggagggtgtgtgtgtccaggaatttatccatttcttctagattttctagtttatttgcacagaggtgtttatagtattctctgatggtagtttgtatttctgtgggatcagtgatgatatcctctttatcattttttattgtgtctatttgattcttctctcttttcttctttgttagtctggccagcggtctatctattttgttaatctgtccaaaaaaccagctcctggatttactgattctttgaagggtttttcgtgtctctatctccttcagttacactctgatcttagttatttgttgttttctgctagcatttgaatttgtttgctcctgtttctctagttcttttaattgtgatgttagggtgtcgattttagatccttcctgctttctcctgtgggcatttagtgctataaattttcctctaaacactgttttagccgtgtttcagagattctggtacactgtgtctttgttctaattggtttcaaagaacttatgtacttctgccttaatttcattatttatccagtagccattcaggagcaggttgttcagtttccatgtagttgtggggttttgagtgagtttcttaatcccgagttctaacttgattgcattgtggtctgagagactgtttgttttgatttccattcttttgcgtttactgaggagtgttttatttccaattatgtggtcaattttagaataagtgtgacgtgatgctgagaagaatgtgtattctgttaatttggggtggaaagttctgcagatgtctattaggtctgcttggtccagagctgagttcaagtcctgaatatccttgttaattttctgtcttgttgatctgtctaatattgacagtggggtgttaaattctcccactattattgtgtgggagtctaaacctctttgtaggtctctaagaacttgctttatgaatctgggtgctccagtattgggtgcatatatagttagaatagttagctcttcttgttgcattgatccctttaacattatgtaaagcccttctttgtcttctttttctttttgatctttgttggtttaaagtctgttttatcagagaccagaattgcaaccccagctttttttttttttttttttttttttttgctttccatttgcttggtaaatattcctccatccctttattttgagtttatgtgtctttgcatgtgagatgggtctcctgaatacagcacaccgatgggtcttgactctatccaatttgccagtctgtgtcttttaattggggcatttttcccatttacatttaaggttaatattgttatgtgtgcatttgatcctgtcataatgatgctagctggttattttgcccattagttgatgcagtttcttcatagtttcaatggtcttcacaatttgatatgtttttgtagtgactggtactggtttttccttttcatatttagtgcttccttcaggagctcttgtagggcaggcctagtggtgacaaaatctctcagcatttgcttttctgtaatgaattttatttctcctttgcttatgaagcttagattgactgaatatgaaattctgggttgaaaattcttttaagaatgttgaatattgggccccactctttactggcttgtagagtttctgcagagagatgcactgttgatctgatgggcttctctttttgggtaatccgacctttctctctggctgccctcaacattttttccttcatttcagccttggtgaatctgacgattatgtgtattgagtttgcttttctcaaggagtacctttgtggtgttctctgtgtttcctgaatttgaatgttgacctgtcttgccaggttggggaagttctcctgggtaatatcctgaagagtgtttcccaacttggttccattctccccttcacttttaggtacacgaatcaaacgtacgtttggtcttttcacgtagtcccatatttcttagagtctgttcatttcttttcattcttttttctctaatcttgccttcacactttatttcattaagttgatcttcaatctctgatatcgtttcttccacttgattgatttggctattgatacttgtgaccaatctttttttgttttcttaaagcgttgagaaagcgattctttcatccagttttccattttattttatgaaggaagtttgtcaggttttactgacaattaacatagtactaatcaaaattataattattgcaactttatatgttataatttgatattataaaatattaagtatattaacagcttttcaatgcatgaaatcaatctgcagacatatatattttcaaacggataaaccatgcaggtaaaatgaaatgtgatccactttttttttcatgtctaaccttatttctttcctttatcttaaagggaaacctctcacaactatttcttatctattttgtcacagatttcccttctttgattcatgcttccacctactgcaatacggtttatagtgattaattctaccaatgcagctctcactaagatctccactgccatttatttttctgatgtagtggacagttttaatccatatttcccccaagtctattgattcttcttctaaatacatttattttcaagacacacatttatcaccattaagtctttccttcactaatgtacagttttccacccttgcttcctttgtgtctcttatatcccctctctttaaaggtggaaggtcctcagaatcaattttaggttcttttttcctttacttttctttttcctctccacatgactgcctctatttttgggctttccattgccagttatgaaccttcaggcattgtatttcttgaaaattgcaaattcatatatctgactggaaatacacatttgcaattgtatgtttagaagtcaatttattgaggatattgcttcttttatttttatttctggaatgcctaaatccatcctcttctatgagaaattcattgttttttttttcctatctcacattatagcatttaacataactgatatcaattgagaacgattattgtttataagtttctttcctcacaaaaatcaaaggtacatgagaacaggaaatgtatttgttttttcaattttatatcctgaaggcaacatacaacatacaatctggtatagaaaaatctattttgacttataaccaataataggtaactgaatcgtataatctattttttaatcaggttaaataatcaggcttggagtttcattttaaagaataaacaaatacaaggagttttccatagtaaaaatttaatgaaaaaagcaaagtaatatattgactaaatataaagaacatgtattgttatattaaccacaaagtaaaaatacatgatacatgaaaagaagattttaaatagtataaatagttaaataattatttagacaaatagataaacagatccatcagcatgatcatccgtaaggaactagtgcctgtacagctgaacatgatgctgcttaacattcctgaaaacattttaaaattttgattcaactcatgtcatggatatagcaaaaatgagaaatggcagaattcatgaacgtgtgagatgatgtattaatcatggaaatgtttctcatttccatgttgaaccagttttcattccttcctccttaatctttcctgcaagttcgttcataaagagaaggatctcatgatttctgctctgacagcctcccaggaacaagggctatac

SEQ ID NO: 2538 - DNA, 7480 bp, Homo sapiens
tgcccagtggaggcagggcagaagcctggggtcctcttggtccttacatctcctgatgtggaacaacttccagtcagctggagcaagggtgattatggcaccacccttctcagcatgccatgccaaggtagagtctccattccaaaagtaggggctgggtgaaagaatggagcccccattacctcatggcacttgctcagaacttggaaaggggtaacaggagaagattgcaaggggacaaaagaaaacctttgggtgattatgtcaattgtggtgatggtttaatagaggtatactaaaacttaacaaaaatcctatacatcaataaaactgccaaaattgcagaacataacttagggggagatatttctaatataataaagagttagtataagaaaagttcataccaaaggaagggagaaacaagatactaaaataggaataaattcagtcatgaactcaggtatcttccatctgtatctctagatagaaatcttggttgcagaggaggtagaataatggcagaatgcctggcagagagcttagcattcaccatgtacttgttaatgtttattgagtaaatgtttgttgagtttgttgcccttgggaagttactttcacacccatcactcccctagggtcagtttccctctaacaccaccatgataaacagcctttgatcacaacaggaagtcatattgcattagactcaagagtcattcagcacatcttccttacattgccttcgtcataataacgaagaatgccgacccattacatagacacaatatagcaataatatttagcgccttatctttttttaaatctgaccatctcaaaatggagatgataggttccatataccttccatgtatttccagttttaagaagctttaagaagtcgagaataatttttaaagaaattacattagttaataattttccatgacttggctcctactggagcctttcaattctacatgcgtcttttttctcagccaggctggtctctgtgttgctctaaccatgcctcattatagtaatagccgtcatttcacataatctaatgaacaccatgcacatcatacacacttcacatatgtcagcaaaaatcctcacatccaccctcaaaggcattaattattccccattttacaaatgtgaaaattggtgatcagagaaattaactaacttgcccaaactctctcagcaagtaaaaagtttctgtctgaccctccaaacgtataccattgggctctctctctgtctgatgttcagatttttgtctctgcctttttcctcctgccatttccttagtttggatcttcctttctctctttctttcaaggtcctgccttcagcacaaacccttctccaacagtccaggccccaggctcctccaagtacagcttgccaattccttgtctggcaagggaaaaggagggagagagagagagaaatgggggtcagaagtgaagccattagatgccaggcatagtggctcacacctataatcccagcactttgggaggctgaggtgggcagaaaatcacctgagataaggagttcgagaccaacctgggcaacatggcaaaaccccgtctctactaaaaatacaaaaattagccagtcatggtggtacatgccggtaatcccagctactagggtggctgaggcaggaaaattgcttgaacccaggaagtggaggttgcaatgatctgagatcatgccactgcaccccagcctgagtgacagagtgagactccaaaaaaaaaaaaaaaaaaagaagaagtaaggccattaagaaagccaggaggtgaggagtaggggatgaagagccaatctcaagaaaaggagatgaaactttgtctcctctgcctttcaaaatgctgtagcctgatcttgcttttgagagcaggtaaggaagatgggcaagcagaggaaggaaacgtgttgggtggaagattcttcttcacccagaaatggcttcagcactcaccaggaccagaacccaggctttgtagggcaggaatgaagggcgctagccaatttccttagcctctgcttcacacagctgtgggattactgatttctttgtccattttgttaattaaactaaaaataatttgccatcatccatcatgctttcaagagatagtctttagctatgagcatctgatttggagtagcagaggaaatgcacactctgttaatcaaatttcaaaaaccagaatccagtgggacctttgggccagcaaagtggggctaaagcatatatgccctgttgctgcacttaggtagtgaaccacttgaggaaaagaactgctttgaaaatctttatttcctgaatctgcagaggaggccaggagaactttctagggatgagggtgatgttctatatcttgatagaggtggtgtttacacagatatatagctgtcaagtcatcaaattgtacacttaagatctgtactttttactgcaggtaaattctaccttattatggctaatggaaagaaagaaggaaagtagaagggaaggaagagggagggagggaaggaaggaaggaaggaagaaaggaaggaaggaagaggagggagggaaaagaaaggaacagaaaggaagaggaggggaagggaagggagaggggaagggaggggaggggaagaaaggggaggggagagaaaaagaatcctcccacttctgtaaacgtaggtttgctgtattagaaatcctggttcccattgggcagtgcttctgtccaggagccaagtaaggattctgctgcacctgcagctgcaaatgccacatgggcactttgggctgctcttacctgtgagcccacacgtggtgaaaagactaactgcatgatggactaattgaccctgactgtcatgagaagatggtgctgccacaagtgtgaatgggaggagaagatctggaatgcagggagtcagtggacctctcttgaggcttctgtgtggcaaacaagaaattgcagccattctgagcttcaatgagagtaggtagaaaggggttgctgtgctggatagtgaaaagccaagatgaccatctgaaggtcagtcaaaggcttcttgtcaagaagcttccaggtttcctgatgagatgtagcttgagagtcacttcctttccaatggacaaagtgatggaacaagtgacctattgtagaattagtctgagggtttcacctacatttgccattatcctggcacaccctctccatctcagggctgcgccacctttttgtgtctgtctgatacaggctaattgctctctgtgtacataggcagaacaggttactgtaacaagtagagactgctatggagatttcattaaggttgacacattcatttcaactggccaggagcgtcagaccatatcccagaacactcaggcattctcaagtactaacaaataatccctgtaaatcactcacttccacaaaagtttaaaataaaaatagaggtagaggaatctttctccaactttttcctgatgctcttttctattctagtgtgatcctgctctatgttttccaatctcatcattcttgttcattgctggtccactcagtccttttaagtcaacagttataagtgtgcttacattctattagaatgagatctgatgacagggcttatctaaggctgaagtccctcaaggacttcccttccccaatctctctcacacatcaataagagccgcaggagtggctttattatgtgaatttattgtgccttctcttgaagaatatcatccaatgctgttttaaaattgtatctttcaaatgccatttgaaatggttataaggcatagaacaatataagctatggcatttgctaataagcattagcatggagccatatgctcccaaaatatattacactttccacaaagaagtcagagacagagtttatcaaggatagataccatacttctttattccctaatagctatagctatatccttagggttctatgctatttttattttgaaactcttaaatatgcagtctatttcatcccataaacatattaaagactaaatttaccacaggttgtcagactagaaaaagatgaatgagactctctaaaggcaggcaagctcactaaaaaaatattacccaaatgaaaactctgggcaacagaatagtaaagcaacactctttaatgttacttgatcatttggtcactaattccagaggatatttggtaaaatgttcaacagataatctgttaaatgagatgaaagcctgggtttgagaaataaaagtgctctctaaagttgtttgagtggaaactgtagggaaataatgagagagagagagagaagaagaagaagaaaagaagaagaagaaggagaaggagaaggagaagaagaagaagaagaagaagaagaagaagaagaagaagaagaagaagaagaagaagaagaagaagaaggagaaaaagaagaaaaagaggagaagaagaagaagtagcagaggaggggaggaggagaaggaagaggcagaggaggaagaggcggaggaggaggaagaggagggggaggaagaagaggagggggaggaagaggaggaggaggaggagaaagagattacatgcctgtaatcctagcactttgggaggccgaggcgggtggactgcctgagctcaggagtttgagaccagcctaggcaacacggtgaaaccccgtctctactaaaatacaaaaaaattagccgggcatggcggtgtgcacctgtaatcccagttacttgggaggctgaggcaggagaattgcttgaacccaggaagcggaggttgcagtaagccaagattgcgccattgcacttcagcctgggcaacagagcaagactccgtctcaaaaaaaaaaaaaaattgaatattttacctcgtcttaagagtttcatgtcaatctggcctttatccctttaaaaagggtctttctttttttttttttaacttctctctgggagtttccagaaacctcttttttcctttggtgctcataaatttaatgagcatgtatatcagttggggccatttctcattcactgcactcaggaatcagcatgccctttcaataggggattcatatcattcagccctgggaatttcctttaattttttaagaaatataattttgggccaggagtagcggcttatgcctgtaatcccaacactttgggaggtcgagataggtggatcacttgagggcaggagttcgagaccagcctggccaacatggcaaaacctgtctctactaaaaatacaaaaattagctgggcatggtggcaggtgcctgtgatcccagctactcaggaggctgagacaggagaatcccttgaacccaggaggcggaggttgcagtgagccaatatcacgccattgcactccagcctgggtgacaggagcaaaactccatctcaacaaaaaataaataaataaatataattttgttctcttaattttctctgttcactctttctgaaaagcctgatgaattggttttctatacttcctttgcttctctaatattttccttctttttgctctgactctaaggagctcattggattttccaggccttctattgaaattttttttaaatcctaatttttctttattaaagatctcagtttttttgtcacatttttgtaacatcttgctcttgttatctagatatgtttccaaaatctcttttaattcatcaattaaggggatttttaatgtcttcggattctcttcttcttttgctgtcagtttttctgttgcttgtcttggttttatgccttttatatcaaggcacataaaaggcataaaaccaagacaagcaacaaaaaaaggattgatcacagaagtttctccttatgtgccaattggtcttcagttgctcagttctagttaaatcaaaagaccagggtggctggtgtggtttcctctgctgttgagaacattagtctgttttccatcagtctcaccactgaatgggaattcttgctggatgctctgggcagggcagggcatgacagggcaaatagactggtgggctttctttgggtaagcagaaaaggaactggcattgacactgggctctccaagagtcaaaatgagaaagacatggtacacagactcccagactagaatacatattattttccaattatgttttagcataatttctttaaaacagagccctctgttctttggtgggagtagcatcctatccaattttattattgccattgaaaagaaatataattttaaataagtagttatcattgctattctaatttgtaggtaacacagtataatagaattagctatctaatttacaagttactgaataatatgatttttaaaaggaaacatatcaaaagatgtgaaagaaaagaaagaaaattttaaaataaagcaacataaacagaaaacataaaataagactgaataaatagataacacatatgagttatcataataattataaatgggttaaattcatctaacatgattcaaaacaattttagaattatccatcttgggttcaaaaccaaagtttgtcgacaagtattttacttaaatttactatactatctgttaggctactgtctcccagcttcaagcccatccttctaccttcagtatatgaggctggggcaggagctctgcaaacacatttatgctctatcaatagaaggcactaaagggatgactgaagcctggagtagaaagaaaaaaatgttttactttttcattctgagagtgtaatttgttccaccataagtagtttgttcctgaatgttctcccaacattccccaaaccagtctcactcccctgtaaaacacagacacagacacacacacacacacacacacacacacacacacacactttgaaatgccagcatttgttcttttgttttctgcatcaggtccctaaaatggcatttaaaagataagctgggcagacacctctcctcagaggtctaggccccagactcaaggggtcccctcctctgagattttaagttttaagaagtgcagcttctttcctttgttttccaggttctatgggtggtagctgcttccagcacttgttacttccatgatacttagagttctctttgtttcctttcaattacctgataaactttattcctacttaacaagacagtgctgtcttatcttctaaatgtcattgtagggacctgatgcagaaaaccaaagaacaaagactcaagtaacttccagcttcctatgtgtagaagtgaaagaggtgaataagtagactaatccagagatatgaatttgcaggctgggagcagggattgatcccagaagtttaacatgatagagagtattgatatgatacattatgtggcttgaacaggatagaaaagaagtaaatcaaagccaagaatcagctgacagactggagaaaacttcaggagtttagggt

SEQ ID NO: 2539 - DNA, 276006 bp, Homo sapiens
  misc_feature (13341)..(113340): n is a, c, g, or t
gagggggctcttgtctaaacacaaaatccatttatgtttcatatgcatgttatacacatgatctgaaggtaattttatatattttaacgattttgtgcataaaacaaagttttgactgcattttgactgtgacctttcgcatgaggtcaagacaagagttccttgttcttcctcaacaaacagagtcctccaacacacaccacccttcgtatcattatagtttgttcctgctcttgacaagtcggtagaaatatggaatatcaatctttaggattgttgaggactatcataacaatgacaagaacattctgaggacttactaagaaccaagccctatgcccaattcttgatttaaaatcattcattttattttcccagaaaaccagaaagttaatacaggttgagtatcttatatctgaaatgcctgggactggacgtatttcaaacattttattttttcagattttgttatattcgtatatttaatgagctatcttgggattgagctcttgtctaaatgcaaaattcgtttatgcttcataggcatctttttttttttttttttgagatggagtctccctttgtcgcccaggctggagtgcagtggtgtgatctcagctcactgcaagctccaccttctaggttcaagctattctcctgcctcagcctcccagtagctggaattacaggcacgtgccaccacacccggctaattttttgaatttttagtagagacggggtttcaccatgttggtcaggctggtctcgaatccctgacctcaaatgatttcacccgcctcggcatcccaaaatcctgggattacaagtgtaagccaccacgcgcagcctcatatgcatcttacacagatgacctgaaggtaattttaaacattttaacaattttgtgcataaaacaaggttttgactgcattttgactgtgacctttcacataaggtcaagagttcgttgtccttcatcaacgaacaaagagtcctcccaacacacaccaccttagtatcactgtaattttccacttatggtaccatgctgctgctcacatagtttcagattttggagcatttcaggttttggacttccagatgaggaatggccaacctgtattatcattcctgcattttatagaagagggaactaggggccgggtgcggtggctcatgcctgtcatcccagcactttgggagtccaaggcgggtggatcagaaggtcaagagatcaagaccatcctggctaacatggtgaaaccccatctctaatgaaaatacaaaaattagccgggcatggtggtgcgcgcctgtagtcccagctacttgggaagctgaggcaggagaatcacttgaacctgggaggcggaggttgcagtgagccaagatcacgccactgcagtccagcctggtgacagagcaagactctgtcaaaaaaaaaaaggaggaggaggaggaggaggagaggaaggagaggaaggaggagaggaagaggaagaagaagaaaagggaactagaaagagagcgtgaacggagactcgttcctttcatggctttttgagatacatggaagattcaaacacaaagagtctcaccttagacccgggtgcctcctaccatccataagctcaaacaatagacaaagacccttctcccaattctcagcctacatctgctgagggccacgtagtgtctgctaagggcttgctctctctctgcttcaaagatggtgccttctttgtgttctcccatggcagaggggcagaaggagcaagcagaatttctcaagctcatgtatgagggcagtcatcctacctcctgatgacccacacctcctaacaccattatcttgggggttaagttccaacacgtgaatttggcagacgcaccatcattgagattatagccacgtccttgtatctgattcaaagtctggagtacatgcatttgagtaatgtgagctacgtcataggtcagtaccttagaagactgaagactgccatttttctttcttgggaggagccaggaggttcttccccatgcaggactcttccagtgggatttctccaaactcaggcctgctgtctaatgctagaccactaggaccagaaaaaaggaggattgctcacaccatcactaactggacagaggggagggagcaaccagggatgcctgttgggtttgaaattttttacgtctctactgcaaagcagggaaagatgaattgcaccagcaccaacaatgaaaggagattctggaggagaggatctcattttgtgaggtgctcctgctgcatcccgatatttccactactctgtgtttacctcacttctcaaggcattcacaaggcagaagccacttgttgttgctatggatacattgatcaaaaagacagagcaaacccacaacaggcaaagtaaaatttccatggtctgaaactcatgatgctggcgagaggcagagaatgcatcgtttccacttcagatctgcttttctgatagtttctatgaaaatgatggttttggttgcatggtttcaggaatgctatggtttggatgtttgtacccctccaaacgtcgtgctgaaatttcatccccagtgctgaaggtggggactaatgggaggtgtttgggtcatgggagtggattcctcacgcacagattagtgcccatccttgagagtaagtgagttatctctcttatgagttattatgaaagctggctgttaaaaagagcctggcacctccccacacacactctctctctcttgcttcctgtctctacatgtggtctctgcacatgcagctccccttcctctctgtgtccccacccaaatctatggtttggctctatgtccccacccaaatctcatcttctagctcccataattcccatgtgttgtgggagggacccagtgggagatgattgaattatgggggcaggtctttctcatgtggttctcatgataatggatgggtctcatgagatctgctgccatccacgtaaaatgtgatttgctcctccttgccttccaccatgatagtgagacttccccagacatgtggacctgtacatccaaaaaacctcagtctcaggtatgtctttatcagcagtgtgaaaacagattaatacactctctcactctgagtggaagcagcccgaggcccttaccagatgcaaatgtccaatcctgaactttccagccaccagaatcatgagccaaataaacctcttttctttacaaattatccagcctcagagattccttcatagaaacacaaaacagactcagacagagagtttgtttggagcaagtgaattaggtcagagtgacatggggctcctaggagttggggatttaccacacacacctgagtggaggtaatggttggagattagcctgaaaacccagaaggtctgtcctgttgggataaaacctcccctcctggagctcagtcttgatgtaaatgacacatgatgtgtcccagacacaagatgcaaataaaaatggcctgggggttaaaattagtctgtgctttggggtgagatccatgcaggttggagtcagtgcttagctggtatatgactcctgcctgactttgcagatgaggctgatctccaatctctgactttccctctgtgaggattaaatccgatacgcatagttcaggaagcattagctgttctagtgataaaagggaatgaaaatatgaaaattgctatcatttctattgcagctcaggtttcttctgcaaagccagaggtgatatgtctacattggaggacaggggagccaggaatggtgggattctaacactaacacaattgaacactctcaggcaagcgcatcaaacatgtttattgctgcctctgcaggtagttagttctcaaaaaacatgacctgatgctcttccttgaacacactctttcttagaaactccttgcatataagccgggcgcggtggctcatgcctgtaatcccagcactttgggaggccaaggtgggtggatcacctgaggttaggagttcgagaccggcctgaccaatatggtaaaaccccatctctactaaaaatgcaaaaattgaccaggcgtggtggcaggtgcctgcagtcccagctacttgggaggctggggcaggagaattgcttgaacccgggaggcggaggttgcagtgagccaagatggcaccactggactccagcctgggtgacagagcaagattccatctaaaacaataaacaaacaaacaaaattctttgcatatgagcctgtaatggaagacaaactccatgggcaaccttcatatcttccccaacagcaggctgaaagctgtcactttgatgtcaaggggataactcctattatcacattgtccaaaaaggctcaaactcaagtctcagtaaggttggctctaggggagaagctattcttttgccttttgcagcttttagagctgtattcctttcatttcttggcctgtcgcccgttcctccaccttcaaagccagcaacatcgtacctcgttttagttctgacatcgcgtactctcttgctagtccagtctccctctgcctccttcttagaaagatgcttctgatgacattgaggatccacctcaataatccgatatcatcctcccatctcaagatcattaactgaaatgcatctttaaagtctgttaccatataatgtaacctattcgtgtttttattgttgttgtttgtttgtttatttttgtttttgagatgaagtcttgctctgttgcccaggctggagtgcagtggcgtgatctcagctcactgcaacctccacttcccaggttcaagtgagtctcctgcctcggcgtcctgagtagtcaggattacaggcccgtgccaccacatccagctaatttttattttattattatttttttgagacggagtctcactctgtcacccaggctggagtacagtggcaagacctcggctcactgcaagctccgcctcccaggttcacgccattctcctgcctcagcctcccgagtagccgggactacaggcacccaccactgcacccagctaattttttttttttttgtatttttagtaaagacggggtttcactgtgttagccaggatggtctcgatctcctgaccttgtgatccgcccgcctcagcctcccaaagtgctgggatgacaggcgtgagccaccatgcccggccaatttttgtatttttagtagagacggggtgtcgccatgtgggccaggctggtcttgaactcctgacctcaggtgatccacccacctcggcctcattacaggctattcatgggttttaaggataaggacctgtgtatgactgggggctgttattcagcatcccgcagcattgttttgtggatgcactctggctacaattccaagaaggcagcatgagaaatttcacagccaccctccagcagggagttgacaggcacagtccagcccggggcatcctactggcaggggagctgttgttgtgttgacttctgtcagatcaacataagtgacacagcttcctccgcacacaccgagggggacatgcttaagaatgtcattaggaggcccgggagatcacagcactagcttagctaaatggggtttcggcaatgagagtctggtgccaacaatatggatattatttaagatttttaataaagcaggggaaacaaagagaactgagaaggaggaataaagtgctgaaaaacatttatctgctcttaagcaatttcatttaaaggagaaagaaacggaggctcaaaccaaagatgaatattgacaatgatgttttttgttttgagacgtagtctcgcactgttgcccaggctggagtgcaatggcgcgatctcggctcactgcaacatccgcctcctgggttcgaacgattctcctgcctcagcctcctgagtagctgggactagagacgcctgccatcacactcagctaatttttgtatttttagtagacacggggtttcaccatgttggccaggctggtctcgaactcctgaccttgtgatctgcccacctcggcctcccaaagtgctgggattacaggcgtgagccaccaggcccggccctaacaatgatgtttaaataggcagaaaagtaaggctggttttggcaaagcagaaagcattaaaaggccctgggctcggtgtgtagagctttgactacaaagggaaaaagtcacagggaaactggtttatttacattatgaatacaaaatgctaaactggtggactgattaaacttatcagcaaaagactaaagaaagacattttctggaagcatttgcaagggttgggtaagccacatggtcactgggcagtgttcaaagcaactgctccttggagacctctgacctgagtatatcttgagggtttttccaggatggggttcagggaagtgtattaaggatccaaacatcattttggtttacaaaaaatcattatgaagagttcaaaatatacaaaaaaaaaaaaaaaaaaaaaaaaaaaaaaaaacagtcaaagagtaaaaacaaaccctcatggaaaaaaagaaaaaaattgtctctatttgacgatgatataattgtcttgatagaaaatatcaaataatctggaaaaaactttctagaactaataaatgagctcaataagttcacaggatgcaagataaatgtataaaaatcaattgtatttctatacagtgacaatggacaaggggaaaccaaaatataaactataatactattttaggccgggtgtggtggctcacgcctgtaatcccagcactttgggaggccgaggggggcgtggatcacctgaggtcaggagtttgagaccagcctggccaacatggtgaaacccagtctctacaaaaaatacaaaaaaattagctgggcgaggtggcaggtgcctgtagtcccagctactcgggaggctaaggcaggagaatcacttgaactcgggaggtagaggttgcagagagccaagatcgtgtcatcgtattccagcctgggctatagaacgagactctgtctcaaagaaaaaaaaaaaaaaaactattttaaattgctccaaagagaacgaaatacttatatataaatctcaccaagcatatgtagttctgtatgataaaaattataaaattctgatgaaaaatatcaacgaagatccaattaaggaaaggcatactgagttcctggagcacaatcactatagtaaagatgtaagttctccttaaactgatttacagagttaacacaattcaggctgagtgcagtggctcgcgcctctaatcccagcacttcaggaggctgaggcgggtggatcacctgaggccaggagtttgagaccagcctggccaacatgatgaaaccatgtctctaataaaaatacaaaaattgcctgggtgtggtggagggcacctgtaattccagctactcgggaggctgaggcagaagaattgcttgaacccaggaggtggaggttgcagtgagctaagattgtgtcagtaaactccagcctgggcgacagagcaagactccatctcaaaaaacaaacaaacaaacaaaattcacataaaaatcccagcattttaaaaatatacctagaaaaaattttaaaaatagacatagaaaagattattataacatttataaagtaatggaaaagctctgtaagagttgaaaccattttgagaaagaattaagtgacagaaatcacacactctttgggattactatattgctgggataaaatggagagagtatggcactgaacaaagataagacacataaataaatggaacagcatagagaacccagaaacagatacctgcaatgatgtccgactaatgtttgagaatggagcaaaagtaatttaatggaagaggaatatccatttcactgaaatttctggagcaaggagacatgacgaacaacatcaaaaaatgaatcgcaacctaaacctcatagcttttatacaaattaactcaaaataaatcatggacttaaatgtaaaccacaaaaccatggtgtgctgttgcatctatgatctcaaaaagaatgatggattgcatttaacgatgatatcttctacaggaggccaagcgactaagacaattcttttttatttttattttttgagatggagtcgcactcttgtcgcccaggctggagtgcagtggcgccatctcggctcactgcaacctccactgcccgggttcaagcgattctcctgcctcagccttccgagtatctgggactacaggcacctaccaccatgccaggctaattttttattttattttttgtacttttagtagagacggggtttcaccatattggccaggctggtcttgaactcctgaccttgtgatccacccgccttggcctaccaacgtgttgggattacaggtgttgggccaccacgcccagccaacgagtctttttttcatggtcaaaaccaaaatctagattgcaaaattcagataaagcaattttacggcttataaggtacctacataggcctgatgttttgcagtgagggaggaaaagtcgcaaaaaaaaaaaaaaaagaaatactctgaagaaagtgaaaagacaagccacagaatgtaagaaactattgggaagacatatatctcctaaaggacttgtggccaacatttaggaagcatagttacaagtcatacgaagatggcacctgacccgataaaaattaggaaatagagctgaaaggacttgtcagtaaataagacgtataagtggcaaaataagtctatgaagcgggtctgtgtttcttggggggttctggaatgcagacaccgagacagagttagaaacgcaaaggtggggcatggtggctcacgcctgacatcccagcactatgggaggccgaggtgggtggatcacctgaggtcaggagttcgagaccagcctggccaacgtgatgaaaccccgtctctactagaaatacaaaaattagctgtgcatggtggcaggtccaggaatcccagctacctgggagtctgagaaaggagaattgcttgaacccaggaagcagaggctgcggttagccaagattgcaccattgaactccagcctgggtaacaagagcaaaactccgtctcaaaatataaataaataaataaaatttaaaaagggaaacatttccggccaggcgcagtggctcacacctttaatcccagcactttgggaggccaagacgagtggatcacctgagaccaggagttcaagaccagcctggccaacatagtgaaatcccgtctctactaaaattacaaaaaattagctgggcgtggtggtgtgtgcctgtaatctcagctacttgggaggggaggctgaggcaggagaattgcttgaacctaggaagcagaggctgcagtgagccaagattgcaccactgcactccagcctggataacaagagcaaaactgcgtctcaaaaaaaaaaaaagaaagaaagaaagaaagatttccggccagcctcagtggctcacacctttaatcccagcactttgggaggccaagacgagtggatcacctgaggccaggagttcaagaccagcctggccaacatagtgaaatcccatcactactaaaattacaaaagattagccgggcatggtggcgggtgcctgtaatctcagctacctgggaggctgaggcaggagaatcacttgaacccaggaagcagaggctgcagtgagccaagatcacgccactgcactccagcctgggagacaaagcgagacactatctcaataaataaataaaaatgaatagaaggatgagaaaaacagacactagggatttcaaaaggagtgtggatggagagcagtaagggttcaaaaactaccaactggggggtacgctgactacctgggtgttgggattattagaagcccaaacctcagcatcacacaatatacctaagtcacacccctgcacacacaccccttcatctgaaatttaaaacgggggcgggtgcagtggctcatgtctgtcatcccaggactttgggaggctgaggcaggaggatcacttgagcacaggagttcgagaccagcctgagcaagatacggtagacctcattgctatgaaaacatttttttaaacactagctgggtgcggtggtgcgcaccggtattcccagctacttgggaggccgaggcaggagaattgcttgagctcaggagttcaagggtgcagggagctatgatcacgccactgccctccagcctgggtgacagagcaagaccttatctcaaaatgaataaataaattaattcaattttaacataaaatacaaaacatctataatataatcatttttaaaagttaaacaatgtctaaaaaaggagttgtatttttctatatgtatacctgtagaaataaatatatatatttcctgtgtctgtgtatatataaaatatttttctaatataacatatataaacattatatatgtaatatattatataatataatatacaatatataacataagcaatattaaaaattatatataatatatattatattatatattatattatattatatattatattatattatatattacattatatattatattatattatatattatattatatattatattatatgttatataatatataatacatatttatttatatattaatatacattatacattaatatatatttttatatatttattaatatataaatatataatatgtttatatattatatatgtatactatataaaatatataatataaatatatatgtattgtataatataaattatatataaatatataaatatataatataaattatatataaatatatttatataaatatattatagaatatataatatattaatagtatgtaatataatattaatatattataaataaatatattataaatataatatataatacatatgtaatataaatatatataatacatatgtaatataatatacatattttatagttaatttattaactataactattattatatatgcataatatattaaatatattttatatatatttgtaatatttatatataatgtacacacaggaaatatatattttatattatgaatataaaatatttataattttttattttctattattttatgtatatatatgccatgcgaactctaacgcgtacgttctttaatcacgtttttcgtgtcttgttttacggttccatctggacttggagctgccctttgaaaaagccacagctgctgtgtcaagtctggtgaacgtgacatcctgactaaattctcgaaaggaaagagatgaaactcagggacatgtacctgggtcacctggagaaccagcaatgggcaccgtctgtggttggttgcctttgtaacctccgtgtatgtatatatatatatatatatacatatatatatatatatatatatatatatatatatatgcacacatagcatgtacatcgctcaaagcccaggtttttggacatcagtgtaactgacctgctgattagcgtatggtgaggactgccagccggaacacaccagggaaaggataaaaaaagtgggcagagcgaggagctattttagtcctggtccagggtccaccaccatgtggctgcattttaatgacacacgcgcttcaccctcccagatgctgaattcacctgcaacatcacactcctcaaggagacgtttagcagacattatctgagggctccgtgcagagcagagcctggtcactgactgttttctcaggaaaagataggtgcagaaggtaggggaaggacctgagtcccaggggaatcagccactaagaattcagcatctggccaagttgctcaaagaaattgttcttgtttagcctctctcttgaatcagtggatgtttactggaacctggaaggaaagggaagacagccagaagctatggtgtatgtgtgtgtggctgagcagggaaaggaaagaggtggagagaaggagggagagaagaaggaataagacaggggaggaggagaggggaggaagaaagaggaggagaaggaggagggggagaaggaggaggagtaaaaagagaagtggtaggagagggtagaaggaggaggaggagagggaggaggaagagaaaaggagaggaggaggaggggaggaggagatgggaggaggaggaggaaaggagagaaggaggaagagggggaggaggaggaggaaaggagagaaggaggaagagggggaggaggagagagaaggaggggagacaggaggaggaggggagaggggaggaggaggggagaggggaggaggaggggagaggggaggaagaggggagaggggaggaggagggaggggaggaggagacaggaggaggaggaggagaaggagaagggaggaggaggaagagaggggaggaggaggaagaggagggggaggagagggtagaaggaggagggaggaggaggacaaggacagacagtgggaggaggagaaatagtaaatgaagaaggagaacaagaaaagatgaaaaaagagagggagtagaaggaaaaggagaaggaggaagaggagaagaaggagtatcaaatggtacaatttctaaaatccaatctgaccaagtctagaccttctccaaaagaaatcgccaagtaagcagtaacaagtaaaatgaaagagaggatagtctttaagagacaaacctagtaggtcagattttttttttttaaggaagcttagtttttattggatacactttcatctttatagctcattgattgtgaaaaggcttatggaataatataattaccaaacaacaaaataaataaacagttgtagacttatgctacacaataaatgacaaaaccgcacacacacaaaaaaggaggggaatatttaaaacttagttacgtttccttcgacacatttttcactgggtggaaggaaaagcccagcatcaaatactttctttgaagtctctaaaagctttctcagtgatgagattaaacttgcaaaagctttcttgctgtggggaggcaacaacgacagctctaattacaggggttctgcactcagggtgttatggttctctgaaacaaggaagagaggcgtgcatacattaatccaaggatacgtcccagccagtaatgagccaccgcttgcagtggaaagcagggagttgtgagcttgtgtcatagaatatacaatttccttgtggtgtcccacaaaaagctatctcccattcagattgttcctacgtagttgtgccagtcataacaagaaccaagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccttccaggatggtccttctcctgaaggttaatccataggcagatgaatcggatattgattcctgttcttggaataatctagaggatctttagaatccattgggattcataatcacagctatgccgatgccatcatcaccggcttagccctttctgaaaacacagtcatcatctacccccattggaatcacgatgcaaaaaacctgtcccaaagcggtggtttcctatgtgattcttgcatccaggacaaatgacagtcagcagagaggcgccctgttccatcttttggtttgatccagttaaaggcacacacgtgagcacccaacgtttgccaactcagcactgggcagagcctggcctctgaggaaattggcatcttcgtaatcaatatattattatgttttattgaaatgtaagtcattgccgattcagtggctcatgcctgtaatcccaacattttgggaggccaaagagaggggattgcttgagtccaggagtttgagacaagcctgggcaacacagtgagacctcatgtctattaaaaaacaattagatgtggtggcatgtacctgaagtccaacctactatggaggctgaggtgggaggatccctcgagcccaggaggtagaggctgcggtaagctgggattgcaccactgcattccagcttgggcaacagagggagaccctatctcaaaaaaataaaaaggaaatataagtcacataacataaaatgaaccattttaggccgggcgcggtggctgacgtctgtaatcccagcactttgggaggccgaggcaggtggatcacaaggccaggagttcgagaccatcctggccaacatggtgaaaccctgtgtctactaaaatacaaaaaaaaaaaattagccgggaatggtggtgcgtgcctgtaatcccagctactcgggaggctgaggcaggggaatcacttgaatccgggaggtggaggttgcagtgagccgagatcgtgcctctgcactccaggcctggtgacataccaagactctgtctcaaaaaaaaaaaaaaaaaaattaaccatttaatgtgtacaattctgtgacattcaggatgttcaccatgttgggcaaccatcatcactcttgagttccaaaacattttcatcaccccaaaagaaacgccatatacaacagcagccactcccattccccgggccctattccacggcaaccactaatctagtttctgtctctttgaactgaactattctgctactttacagacctggaatcatacaggtgacctattgcgtctggcttctttcacttacgataatactttttgaggttcatctgtgtggtggcatgtatccacacttcattccttttttatggctaagtaatattccatcgcatggatgtaaaatgatgcattgtttttttagagaccagttcttgctctgtggaccaggctggagtgcaatggcatgatcatagctcactgcagcctccacttcctgagctcaaacgatcctcccacctcagcctcctgagtagctgggattataggtgcacatcttcacatccagccaactatttttatgttttgtagagatgggatcttgctatgctgcccaggctggtctcaaactcctggcctcaagcaatcctcccacctcagcctcctgaagcactgggattacaggtgtaagctactgagtctggcatatatatatgtgtgtgtgtatatatatatgtatatatatgtgtatatatatatatggatatataggatatagatagatagatagatagagatagatatatatttttttgagacagtgtcactctgtcacccaggctggagtgcagtggtgcaatctcagctcactgcaacctccacctccagggttcaagcgattctcctgcctcagcctcccaagtagctgggactacaggtgtgcaccaccacacctggctaattcttgtattttcagtagagacgaggtttcaccatgttggccagagtggtctcgaattcctggactcagtgatccacccaccacggcctcccaaagtgctgggattacaggtgtgagccactgtgcaaggccccaaaatgtatttttaattcccgctttactcttctaaaaaatgaaatcatccttactatcaccctaagaaaatttaataatatcctaatatccacatcatgcaaattataataaaggaatatgtggccgggcgcggtggctcacgcctgtaatcccagaagtttgggaggccgaggcgggcggatcacctgtggtcgggagtttgagaccagcctgaccaacatggcaaaaccccgtctctactaaaaaaaaatatatatatagatatatatatgtgtgtgtgtgtatatatatatgtatgtatgtgtatatatatgtgtgtgtgtatatatatgtatgtgtgtatacatatgtatgtatgtgtatgtgtgtgtgtgtatatatatatatatgtatgtatgtatgtatgtatataaaattagccaggcgtggtggtgggcgcctgtaatcccagctactcaggaggctgaggcaggagaatcacttgaactcaggaagcgtaggaagcgtaggttgcggtgagccgagattgtgccattgcactccagcctgggcaacaagagcaaaattccgtctcaaaaaataaataaataaataaataataaagcaacatgcattggtacatctcaacttttgggcttacctctaccctggaaataacgaggcagtaatatgcgtcgtgcctctatgtgttgaatccacaagatgatatgatcatcatctaccccattagacgactgggtggccgacggcaatcacaggccgccctggcctggtgtcctggtaactcgaacaccatgagtcctctcctgtcctctgatttccccaaatggtgatgaaacgcagccagtccaatcgtctctctgttaacgcagtgttttttttttttgactggaaaatcaatcctttgtatttatgtgtaagccgagttaagtgctacgctcaggtgaatcgtaaacaggttttttgtctttgtggccatctgggtcccacactcatgagtcatgtgggtcaggggtgtgttctctgctaggtagcattgccctgtactctgcgacgagtcgaaatcccaggcttcccccaaccaaatgccagtggaggcacttgattcttttgcccacccagcaacccacccacccccaacttcccatatgctctgcagagaacagccagcccccctcaccacatatcgagaaaaaacaccagatcatcaggacaatttcatggaaccaaacctcccactgcagccaaactcacatagaaaacatcctttgcagcctgaaaacccttttaggacctttctgtcactgagtcttataaacctataaagattcattgaacagaaccagagactcaggctcccggaaaagcttgacaaagtcacgcagtgcattagtccattcttgcattgctataaagaaatatccgaggctaggtaatttatttttaattttttggagagagaatcttgctctgttgcctaggctggagtgcaatggcacgatcttggctcactgcaacctccgtttcccagattcaagcgattctcctgcctcagcctcctgagtagctgcaattacaggtgcccaccaccacacccagctaattttttggtatttttactagagttggggtttcaccatgttggccaggctggtctccaaatcctgaccttggatgatccacccgtctcagcctcccaaagtgctgggattataggcgtgagccaccacacccggcccaagtcttataaacctatgaatattcactgaacagaaccagagactcaggctcctggagaagcttgacaaagttacgcagtgtaatatgccattcttgcattgctataaagaaatatctgaggctgggtaatttgttttttattttttggagatggagtcttgctctgtcacccaggctggagtgcagtggtgcgatctcagttcactgcaacttccgcctcctgggttcaagcgattctcctgcctcagcctcccaagtagctgcgattacaggtgcccgccaccacgccaggctaatttttcatatttttagtagagacatagtttcaccatgttgtccaggctggtctcgaactcctgagctcaggcaatctaccccgtgaggctaatttataaagaagagaggtttcattggcttggctgatagttctgcaggctatacacgaagcatggtgccagcatgtgctcagcctctggtgaggtatgaggaagcttacagtcatggcggaaggcaacgtgggagaaggcatgtcacgtggtgagtgtgggagctggatatgggggagaggtgctacacactttattttatttttatgtatttatgagacggagtctcactctgttgcccaggcttgaatgcagtggagcaatcttggctcactcccggattcaagcgattctcctgcctcagcctcccaagtagctgggattacaggcaccagccaccacgcctggctaatttttgtatttttggtagagacggtgtttcaccatgttggccaggctggtctcgaacttctgacctcaggtgatccacctgcctcggcctcccaaagtgctgggattacaggcacctgccaccatgcccagctgatttttgtatttttagtagagaccgggtttcaccatgttggccaggctggtctcgaacttctgacctcaggtgatccacctgcctcggcctcccaaagtgctgggattacaggcacctgccaccatgcccagctgatttttgtatttttagtagagaccgggtttcaccatgttggccaggctggtctcaaacttctgacctcaggtgatccgcctgcctcggcctcccaaagtgctgggattacaggcgtaagccaccgtgctcccagcctttaaacaaccagatcccgagagaactgactcactaccgcaagatcagcaccaaaccatgagggatctgcctctcagatccaacatctctcaccaggctcccagctttgaggatgacaagtgaacacgagattggagccgggacagatatcagaacttttatcatgccgtcagccacagacaagcttctgttgttgttttattttcctaaacaaatcacatgtccctcctacgatgccacagacttttattttattattgttattatttatttatttatttatttattgagatggattgttgctctgtcgcccaggctggagtgcagtggcgcgatctcggctcactgcaacctcggcctcccgggttcaagccattctcctgcctcagcctcctgagtagctgggactacaggcgcccgccaccacgcccggctaattttttgtattttttagtggagatggggtttcaccgtgttagccaggatggtctcaatctcctgacctcatgatctgcctgcctcagccttccaaactgctgggatgacaggtgtgagccaccacgcccagcttttattattattattattttgagatggagtcttgttctgtcacccaggctggagtgcagtggtgcgacctcggtttactacaacctccgcctcccaggttaaagcaattctcctgcctcagccccctgagtagctgggattacaggcgtgtgccaccacacctggctaatttttatatttttactagagacgaggtttcaccatgtcgctcaggctggtctcgaactcccgacctcaggtgatccgcctgcctcggcctcctaaagtgctgggatgacaggtgtaagctaccgcgcccggccctctgtctgcttttatcctagctgtgctggcagctgatcaaatgatgcctgtccagatggagggtgggtctgtctagccctgtccactgactcaaatgttaatctcctttatcaacaacctcccaggaacacctatgatcaatactttgcttcaattcagtcaggttgacactcaatagtaaccatcacagtaaagaaacagcaaaacggaatgccgaccccgtgggctgggcacagtggctcatgcctgtcatcccagcactttgggaggccgaggcaggtggataacctgaggtcaggagttcaagaccagcctggccaacatgcggaaaccacctctctactaaaaatacgaaaattagccaggagtggtggcaggtgcctgtaatcccagctactcgggaggctgaggcagaagaatcgcttgaaccggggaggtggagcttgcagtgagctgagagtgcaccactgcactccagcctgggagacagggtgagactccttcaaaaaaacaaagaaaagaaaagaaaagaaaagaaaagaaaagaaaggaaaggaaagggaaagggaaagggaaagggaaagggaaagggaaagggaaaggaagaagggaatacagaccgtgtaaggattgttgctgtgctctgtcagccacctcctcccaaatactccagagctgaaattgcagaaaacaaaactatgtggtgtgggagtggcagaagtcaaggtcctttcttgtggggaaggatggtgttgatgttggttatcttggtggggggatgttagtttgggagtaaattaaagggaaccagtggaaagggaaatagatgaaagaacaatcaggaagagaaactgaacaaatggaacaaaaacatcggctgggcgcggtggctcacgcctgtaatcccagcagtttgggaggccgaggcaggcagatcacatgaggtcaggagttcgaggccagcctgaccaacatgatgaaaccccgtctctactaaaaatacaaaaattagccaggcctggtggcgggtccctgtaatcccagctactcaggaggctgaggcaggagaatcgtttgaaccggggaggcggaggttgcagtgagctgagatcacgcctctgcactccagcctgggaaacagagcgagactccatctcaaaaaaaaaaaacaaaaaaaacttcatccattgaagcaggaactgtgtgtgtgtgtgtgtgtgcgtgtgtgtgtgtgtgtgtgcgtgtgttggttgacaatagtcaccctattgtgctatgtcttatttattctttccaatttttgtacctattaaccatccccacctcccccactccaaccccctttgtaaccgcaaggataaatgcttgaggagatggacaccctattctccatgatgtgctttttacacattgcatgcctgtatcaaaacatctcatgtaagctacaaatatatacacacctactatggacccacaacaattttttaaaataattcaatttttttttttggttgaaactgagtcttgtgctgtcacccaggctggagtgcaatggcgtgaccttggctcactgtaacctccacctcccgggttcaagtgattctcctgcctcagcctcccgcatagctgggattacaggcacctgccactatgcccagctaatttttgtatttttagtagagacagggtttcaccatgttggtcaggctggtctcgaactccagaccttgtgattcgcctgcctcggtctccccaaagtgcaaaaatttttttttaattgcatacgatgaaatacttgcaaacacacccacacccacatacaactaaaagagaaaatctgaaaaggcggccgggtgcggtggctcaggcctgtattccccagcactttgggaggccaaggcaggcggatcacgatgtcaagagatcgagaccatcctggccaacatggtgaaaccccatctctactaaaaatacgaaaattagcctggcatggtggggctcacctgtagtcccagctactcagcaggctgaggtaagagaatcgcttgaacccgggaagcggaggttgcagggagccgagatctcgccaccacactccagcttggtgatggagtgagactccatctgaagaaaaaaaaaaaagaaaagaaaatctgaagaagcaggtcagattgtatcaatgtctgtatctggttgagcgatttactggagttttgcaagatgttctaattgcaggaaggttggtaaaggtacatgggatgactctgtactacctcttacaactgcatgtgaatttacacatctttgcatacaatttatgtgttagttcaggctgctgggataaaacaccatagagtcggaagcttaaactgttaacattcctgtatcccacttctggaggctggaggtctgagacaagggtgccagtatggttggttcctggtgagaactctcttcttggcctcctttttctttgtttttaattttttttttattatactttaagttctggggtacatgtgcagaacgtgcaggtttgttacgtaggtatacacgtgccatggtggtttgctgcacccatcaacctgtcatctacattaggtatttctcctaatgctctccctcccctatccccccaccccccgacaggccctggtgtgtgatgttcccctccttgtgtccatgtgttctcattgttcaacttccactgatgagtgagaacatgccgtgtttggttttctgttcttgtgttagtttgctgagaatgatggtttccagcttcatccctgtccctgcaaaggacatgaactcattcttttttctggctgcatagtattccatagtgcatatgtgccacattttctttatccagtctatcattgatgggcatttgggttggtcccaagtctttgctattgtgaacagttggctgcctttttcctgtgtgctcacaaggcagtgggacagtgagctcactctgagctcatcatccttttataagggcaggaatctcatgcatgaggctccatccctcattaggctccaccctcatgacaccatcacctcccaaagcctccacttcctaacgccatccccttgggggggtgacaatttctacaaaagaatttggaaggacaccaatgttcggtcgatagcatagtcaataaaaataggagatgatataaaaagatgttaatatctaattgtcagtggatttgtgaactatctgatggtaaatatcagataaaagatagttaaggatagaacatcaaagaaccaaagctaaatctatttttttttttttgagacagagtttcgctcttgttgcccaggctggagtgcagtggtgtgatctcagcccaccgcaacctctacctcccaggttcatgcgattctcctgcctcagcctcccaaggagctgggatgctaaatcttttacagtaataataataaaataacaaactaataaaagaagcattacaccaagaagacagtataatcatgaacctgtaggtctctagtactgcagccctaaaatatctaaagcagagagtgacagagatttccagaactctctctacaaaagacaggataaatacattacatttcataacatgattaaaatttcaatttatagaaatttcaatttatagaaacataagtctataaaaccataagtctgtaaaaccaggagatcgtgaccatcctggctaacacggtgaaaccccatctctactaaaaatacaaaaaaattagccgggcatggtggcaggtgcctgtagtccccactactcgggagggtgaggcaggagaatggcatgaacccagaggcggagcttgcagtgagctgatatcgtgccactgctctccagctttagggagagagcaaggctctgtctcaaaaaaaataaataaataaaaaataaaaaggcaaaaaaaaaatcactaattttaattctacacctttggaaatattaaaataccctcttcatccattggtcaaatcaggcaaaatgaaaacaacgacttcattctaagtctatgaaatgcagccccaggggtcaggaaaaaaatgagttcacaatacatttgttacgattagaaggaagaaaacaaacaaacaaaaaaagatggcatgtatcgaggcaagaaaatagacaacatattccagaatgaaggcaaagaattataagaggataaaacagcagtaactaaaaatgataagtaagcgataaacacaatgatgagtaaaatgtctactcctgaatccgagacggtgcttcacaaagacagcttcagaggccacaattccaaagcttttttctacgtacagatattctccccgatgcctgggttaatggcgcccgaactgcagaaaacataacctcaaccgagttttctgcttcaatgacaaatgacaccagagccccaccaccaaaccatggctggcatctatttagttctgagcactgctctgacagaatgcatcagtcttgctttgctctcagcaaaactgggtgcagaggggacggctgttagcctggtcgttgctaatgaggagatgaggagttggaaagatagagacgcaatggcttaactacggcacctgatgcaagacttgctacctccccagttccagcccaaatggagaaatgggtatgatgcaccttctgtgatctggggatcagttctgatgtctgcggtccagccccccaacctgtcctgcctttgaaaatgtggtgtgtcccttctatgacagtttctcctaacagccaagatgagagataccacatgttcatgacaaagacactctcaaaatcaaggtggcgtccagacacacatctagactgtgatgtgttccccacacaccagcctttgttgactgcacacattcccgctaaaagacacacaccagcctttgctgactgcacatgttcctgctaaaagtcccacaccagtctttgttgacgcacacattcctgctaaaagtccctgtgactacatgagacaatactgccagtttccaggctgttaggacctgctatctttggggacttcctctgttgactacagcctccagctcctttaggacacaagccctgttcttccgacttcgagtcccagtatttgggtataacacttaacacttatttactgaaaacatgactacatggatgaatggatggatggatgaatggatggatggatggatggatggacagatgcatggatggatggatagatgaatgaatgaatgagatggtcccatccattgctggacctgaataaaacctattcatggctactggaagggcataaaagagtagcttcactgggacatccatgcactctaggtccaagtattgaatcaaggtttgccaaagaaaagaaactcattcctcctggttcgtacagagctctaatggcacacatgctactcacccaacaatccacgcggtttcccctgctgggaagtgtctccaggaaattgcacagtgtccaggaaatggcacaatcaggtatcaaggaacacaggcgaacttctccagaattatgctcttggtttccctgggaggaacggtcacataagggttaccatgaaacacagaggaatagtgtgaggctggagtcgtacaacattcggatcgctctcacagctcatctgtcagcctggggaatgcggtgtctgtcattttccagagtgcttgttcagtcagcggtatcaattgtcagctttaggagataggagacatcctgtcaccccatccagagcctgtacttggaactacctttatgacgatgatgaagagcagctgcggccgggcgtggtggcttacgcctctaatcccggcactttgggaggcagagacggggtgatcacttgaggccaggagttcgagaccagcctggccaacttggcgaaactccgtctctactaaaaatacaaaaaaaaaaaaaaatagctgggcgtaggggtgggcgcctgtaatcccagctactcaggaggctgaggcgacagaatcacttgaacctgcgaggtgagggttgcagtgagctgagattgtgccactgcactccagcctgggtgaaacagtcagaatcctctaaaaaataaataaaataaaaaattaaaaataaaagagcagctggcacttcttgcaagagcttcaagctgcaaaaggctcttggatgatgtgcaactgtacagaggtggagatatttttagaactgaagatttggtgcatagtcctggctgtttggaaacacttttcagatgaacgcatgctgcgatcctggtttaatggaggaagtcactcccattcagaaacacatctgtctgggctccacggcttagcagaacctctgggaagtacaaggtgtttgaaatgatcctgtatgaaagacgccagaggtgtagatgctgagggctggaaactgcagttgacatttgcctggctcagggaatctcaaacttggctgaacaacaacaaaaaaacatgacctggtgccgggcgcagtggctcatgcctgtcatcccagcattttgggaggccaaggcaggtggatcgctttgagctcaggagttcaagaccagcctgggcaacatggcaaaaccgtgtctctattaaaaaaatacagatggtcagacgtggtggtgcacgcctctggtcccagctacttgagaggctgaggcaggagagttgcttgagcctagacggtcgaggctgcagtgagcagagattgcatcactgcactacagcctgggtaacatagtgagaccctgttgaaagaaaaaaaaaatggaagaaagaaaaaaaggaaagaagaaacagagaaagaagagagaaggagagagagagagagagagagagaaagaaagaaaggaaggaaggaaggagagagagagagaaagggagggaggagggaaggaagggagggagggagggataacagaaggaaataaggaagggaaggagggagagatgaaggaaggaagggagggagggagataaaggaaggaaaggaaagaagggaagggaaggaaagaagcaaggaagggaaggaggaagtaaggaaaggaaaggaagaaggaagggaaggaggaaggaagggaagggaaggaggaaggaagggaaggaggaaggaaaggaaaggaagaaggaagggaaggaggaaggaagggaagggaaggaggaaggaagggaaggaggaaggaaggaaggaggaaggaaggaaggagggaggaaggaaggagggaggaagggaaggaggaaggaagggaaggaggaaggaagggaggaaggaagggaaggaggaaggaagggaagggaaggaagaaggaagggaaggaggaagtaaggaaaggaaaggaagaaggaagggaaggaggaaggaagggaaggaggaaggaagggaaggaggaaggaagggaaggaggaaggaaggaaggaggaaggaaggaaggaggaaggaaggaaggaggaaggaagggaaggaggaaggaaggaaggaggaaggaaggaaggaggaaggaagggaaggaggaaggaagggaaggaggaaggaagggaaggaggaaggaaggaaggaggaaggaaggaaggaggaaggaagggaaggaggaaggaagggaaggaggaaggaagggaggaaggaagggaaggaggaaggaagggaagggaaggaagaaggaagggaaggaggaagtaaggaaaggaaaggaagaaggaaaggaaggaggaaggaagggaagggaaggaggaaggaagggaaggaggaaggaagggaaggaggaaggaagggaaggaggaaggaaggaggaaggaagggaaggaggaaggaagggaaggaggaaggaagggaaggaggaaggaaggaaggaggaaggaagggaaggaggaaggaagggaggaaggaaggaaggaaggaggaaggaagggaaggaggaaggaaggaaggaggaaggaagggaaggaggaaggaagggaaggaggaaggaagggaaggaggaaggaagggaaggaggaaggaagggaaggaggaaggaagggaggaaggaaggaagggaaggaggaaggaagggaaggaggaaggaaggaggaaggaagggaaggaggaaggaagggaaggaggaaggaagggaaggaggaaggaaggaaggaggaaggaagggaaggaggaaggaagggaaggaggaaggaagggaaggaggaaggaaggaagggaggaaggaagggaaggaggaaggaaggaaggaggaaggaagggaaggaggaaggaagggaaggaggaaggaaggaagggaaggaggaaggaagggaaggaggaaggaaggagaaagggagaaagagagaaagaagaaaaaacgaggaaggaaaataaagagaatgaaagaaggaagaaaggagagaaagaaagaaaggaagaaagcaaaagaaaaagaaaagaaagaaaaagaaaggagaaagaaagatggagaaagagagaaaaagaaagtaaggaaaagaaagcaaaacaacttggggaattcaaaacaaatgctgatgaccagaagaattgactgcggaactttctcgcggatggggctgaccgtcagtcattttcagaggttggcccagtgagcatcaaaagcccactagctttcctggatatttggggagaccgtcacagatagtgagaggcctgagctcaccagtggttttacacaaggctcactggggattggggatgtccagtttcagacctgctgcctgtccttgaagagggaagacgcatgaacagagatggctacaccaattgcaagctcagcgcaaaatgagaagaaggactccttgttcaaacctaattaacaatttccaggcgggggcagcagacagttaaagcaatatggcgcccttccgtgcgtggggaccctgtgtgagttacgcaaggtgcggactcatgaaacttgaggtgtagataacagaagctatccacctccgaggctttccgggtctctagaaatggaaagaatattttccgcactcacatggcatctggtccctgtggccaatagtagattgaatactgtctcccaaaaagatatgactaaggcctaatccctggtatccgtgaatgggaccttattcacagaaagggtcttgccaggtgtcattgagtaaaggatcttgaaatgagatcatctggattatccaggtgggccataaatccaatatcaagtgtccttattagaaacaggaagagacacagatacagggagaaggccacgtggagatggaggcagagagtgcagtgatgcggccacaagcctagggatgcctgcagcccccaggagctgggagaggcagaaaagatcctctcctagagcctctggagggaactgcacccaattgtagtggactgaactgtggtctcccaaaaagatctatctataccctaatacccagagcctgggaatgagaagttatttggaaataaggatctttgaagatgcagtgaattaaagatcttgagatgagatcatcctggagtagggtaggccctaaatccaatgacaggtgtccttctaagagacagaagacacacagacacagaggagaaggccacgtggagacagaggcagagactgcagtgatgcggccacaagctcagggacacctggagaccccaggagctgggagaggcaggaaggatcctctcctagagcctctggatggaactggacacaattgtagtggactgaactgtggtctcccacaaagatctgtctatatcctaatatccagagcctgggaatgagacttcatttgggaataaggatctttgaaggtgcaatgagttaaagatcttgagacgagatcatcctggagtagggtgggccctaaatccaatgagagatgtcttttttttcttttgagacggagtctcactctttcgcccaggccggactgcagtggtgctatctcggctcactgcaagctctgcctcccaggttcacgccattctcctgtctcagcttcctgggtagctgggactacaggtgcctgcaaccgtgcctggctaattttttgtatttttagtagaaatggggtttcaccatgttagccaggatggtctcgatctcccgacctcgtgatccacccgcctcggcctcccaaagtgctgggattacaggtgtgagccaccgtgcccggctgagaggtgtccttctaagagacagaagacacacagacacagaggagaagaccatgtggagacagaggcagagactggagtgatgtggccacaagcccaaggaatgtctggagcccccaggagatgggaggggcaggaatgttcttctcttagagcctctggagggaactggacacaattgtagtggactgaactgtggtctcccaaaaagatctgtctataccctaatacccagagcctgggaatgagaacttatttggaaataaggatctttgaagatgcagtgaattaaagatcttgagatgagatcatcctggagtagggtaggccctaaatccaatgacaggtgtccttctaagagacagaagaagacacacagacacagaggagaaggccacgtggagacagaggcagagactacagtgatgcgggcacaagctcagggacacctggagaccccaggagctgggagaggcaggaagcatcctctcctagagcctctggatggaactggacacaattgtagtggactgaactgtggtctcccacaaagatctgtctatatcctaatatccagagcctgggaatgagacttcatttggaaataaggatttttttttgagacagagtttcactcttgttgcccaggctgggttgcgatggcgagatctcggctcaccgcaacctccacctcctgggttcaagcaattctcctgtctcagtctcccgagtagctgtgattacaggcatgtgacaccatgtctggctaattttgtatttttacaaaattacagaattttgtaatgatggggttaaaaatttttgtaatgatggggtagagatggggtttctccatgttggtcaggctggtgtcgaactcctgacctcaggtgatttgcccacctcaccctcccaaagtgctgagattacaggtgtgagccactgtgcctggctggaaataaggatctttgaagatgcaatgagttaagatcttgagatgagatcattctggagtagggtgggccctaaatccaatgacaggcttccttctaagagacagaagaagacacacacacacagaggagaaggccacgtggagacagaggcagagactgcagtgatgcggccacaagcccagggatgcctggagcccccaggagctgggagaggcaggaaggatcctctcctcgagcctctggatggaactggacgcaactgtagtggactgaactgtggtctcccaaaaagatctgcctatatcataatacccagagcctgggaataagactttatttggaaataaggattttttttttttttttgagacggagtttcactcgtttcccaggctggattgcaatggcgtgatctcggctcaccgcaacctccacctcctgggttcaagcaattctcctgtctcagcctcccaagtagctgggattacacgcatgtgacactggagtcatgcaaccacaagtcaaagggatgcctggagcccctaggaactaagagaggcaggaattgatccttccttagaacctccggatggagcagagccctgagacatcttgatctcaatcttctggtctccagagctgggagaggagaaataattccttttgtcatgaggtccctagttgtggttacttgttacagcaggcctggaaaactgatcaatgtcataacctgcaatgggctgtctgaacacacagccatctcatgggaccatctacatcatcttcacacagagacctaagccccatgggaagcttggcagatgtgatgttggggcctctacagatccagatgtgggggtttagtcaggctggtggggaaaattttagttatagtagacacaaaccctctgggaaggcctgagcgtttgtataacttcagtaataaacctggctgaaggcagcctagtccccttacctttagttaaataaattagagtagaagcaaaggaatgtggggaatgtctctaactaacttgtttactcatgtggtcctaagactaaccttttatgtatcgcaggtgcttcattgctttctacttagggaagtccgcaatgtcaatttccctctagtggtgttgactcacaacctttgtcaattaatctttactgaataaatgcaagtcttgctgactgatcgaggccacggctgctactaagtggcttggatgctcagccaaactggcaaagcagaatagctgtgtgtcaatgtacttcattcacccatcacttggtcagggtctgtgggacagacccctgcaccataaatcttgttgcaagttttcaccgttgggcttcacgtctccctgcagcaccatgaatccagctacactagggaggtgaatatcatgcatgtttcctgcaagtttcattgttccttgtaacctctggcaacctctccttcccggaggctgtttcctggcctgttagtctggttgtatcattcatggttttcctatgaagggtctcaggatataagcagacattctgcacagagactgcatctttctgcagaaggggcttgagctcattctttctgcactgagagtcctgggtattgaggtctgagctctgcccgaaacagaagcataccgattgttagggtcaccccaaccagaccgttcccttccccttccacaggccttacaatacagtcccttgcactctccacacagctcccccagggctaaagacaaacgccccccgccttcactgacccctccagtaactgtttgtccagacagttacaggatgtggttagcatgtctgtgaaccttgcataacaaagctggtgaaaaacatctccaggatgcggtcaagacacttgcaccccctactcagctcccccaccccaacccaatcctcctgcaccctcgactcagctcccccaccccgacctggttctggccctataaaaccctgctatagtctgtaagtggggctgcctccactaactgtggtggagcagccaagcagctcagtaaagtttgcttgcctgactttaggtctcctcatcctctctctcggctgaccttacaccgatgatgtagtaagcatctaacgtgaatatcccagggaacaaatccacatttcttatccttttgtaccaaggaaggtcccctgtctagtgggtccatgacataaaattcctggttttctgtaaaggaacaacagaaatccaggcatcctggttatctaccaaggaaaatcaccatctgtggtgacaaacccattcccggaggatgaatgattttttttttaaagaggccaaacaatacatttattattttcatttaagttgcttatcagggcaaccttccccatctgggaacaatctagcagtcatgtaagaagcacatgcccccacaattagtttgaactccatcctggaattgcagctggttgtgattctaaggtacaggcatgccaggagcctggatttgaatagtcagtgggattttgtcacttagtggaatggataataagccaaccaatggtcatcagtctcacacataaggagtgcaggctcgtagggtatacacagtactttctcaaaagcattgcaaatgactgatttctctatgttgaaatttgaaaacccaacatctatctctctaacaccaaaggattgagccttccttgcctggctggtgagtaagagtgagcctctataccaaggatgtaccctttggctgtgtgaggttttcagaagtatcagaagctgtatacatttcctgtggttgctgtaacaagtgactaccaatttgttggagccttaaaacaagaaagatttattctctctccgttctggggaccagaagtctaaagtcaagacgtcagaggggccaagattgctctgaggggtataagggagaatccttcctgcctgtcccagctcctggtggctccaggcattgcttggcttgtggtggcatcactccagtctctgtctgcatcatcacacgaatatcttgtcttctgtactcaaatctccctctacctgtctctgataagaaccctcgtgatggcattaggttcactgggatgatccataatgacccatctcaaaattcttaattctatctgcaaagattcttttccaaataaagtaatatttataggttctgagggttagggcatgaacatatcttttgagggctaccatttgatccatagctgttcagcggtttacattctcggatttgacagtggcatgcttcacttgtgactgtgccattctggaatgaggttgaccagatggtgctgctggccacgtcaaactcatcctacaggctgtagcaagcaaggctcacacctccccatgtctgacacctgtgaatcacagctgggtctctggaaaaatgagtgagtgcaggaacaaaatcaaacaggagacctcatccaccactaggtctcagagaggacattgcagcccctgaaaagagagcatctctcttggaacttttgtactcagttgtattaacgcggcaaggaaaatggcacatttatgttggaaaatgtaattatttatggcacctgtgacaactgggcactttggaatcacaaagtttatggttgaagaccacttggggtgattatcctccaaaatgtttatttggcttcttgaagttctgcagaggttgaggcagctgtctcaaaactagaggacagagccctgtgggcaggtgggtgtgagaaactcaaacaccgcagtcttcacagacccacaagctattggcaggtgcaatgtgtttcttggggcagcagctatcctgagacaggatatcacagggtcacatcaaggaccccagtcatctcacaactcttagaccacagctgctgctgcagtttctggttgtaggtgacgtggagggacttggtctctttctcgttgtataggtaatggccaccaactccttccagctctggggtgactgctgcgtagatggaagtccacgctccttcatcgggggtctggtggaagaagaaaagaaggctacgatgagtcaaatttctgagcaggaaacaggagtctcaggactcacatggatgctgcagggacaggtggaatatactcatcagctgcactgagaaatgtatgcaaaaagcgaggttgggtgatcaatctgaaccacagcttttctgctgttgggtttctttacaacaggcactgacaataacgtacccaagtgggttgcatttcagtggtgggttaatccatctcactaggcagatgcatattaaaatccctgatgtacgtatttaatcacgcactctttatgggaccgaaatgcttattaattgactagaagcagatgagtgagtgcttggcttctgtatttaataaacaatatttagcaattagatgaaacatcaggacatcaaaaagattcttgttttcaattcagcaaggcatgctacatcggagaattgaggcatttatgagctgtgatcgtatgtttcatggaaacagacgtttcaaaaaggaacttgagatgcagaaaaaggtttttcaaagactggggattttaccctagtggaaggcgataatcttgaaacacagcacaccctggttttctgcagtgggagttggcccttggtcatggtcagtgggatggaagaaatgtaggattctcagaggaattagaagttgtgggacctgagaaccttcagagctaggatgcaataatccaggaaccaacacagtgcatcttaacttctgtcacaatgaagatgtttcagaagttgtctcttgtaataagcttctgggaatctggtgaacgtatccaccatgtggggacacagtaatgaggcaccgtctgtgaaccagaaagcaggtcccttccagacacagaatctgccatgcattgatcttgaacttccagcctccagaactgtgagcaacaaatgtttaccggttgcccagcctatgttgttttgtgatagcaacacaaacagactaagacatttgatgtccagagtttttactggggtctcattgcataggtatgattaagtcattggccacataatcagattcaacctccagttcctctttcctccccagaggtcaggctggcctgaaattccaacctcctaatgacatggttggtgtttctggtggccagccccatcttgaagccatttaggaaacagcaaatatcacctcattatacaaccagggaattgctagcatttgtgaaattgcgagagttttagaagctcctccttgttacagaaccaggaataaagaccagatattgcctttgttatgtcccctctagtcttctgggagtgatgatccatttgcccgaactgatttcacctctcaccagtgcccctagcactgcagtggctcaggcctgtaatcccagtgctttgggagaacaaggcaggaggactgcttgagtccaggagttcaagatgagtgtgggccacatggcaaaacctagcactggtgagagttcaggcacacaccctccaaaaaggaaaagggtggactctgtggggtggcctgtgacacccagtcacttcagaaattctgctgctgtcagttcactgcctcctggtcttgacttcagcagccagtgtgacgtggaaaggcatggtagacaatccagtgtgcccaccagcccatcctctgggtgccgagcaaggggaacaggaaggctggaccccagtagaggaacagagctgccagactcctgagattgtttcccactgacttgcctctgctcttctgctgcctaaaaagaaatggatggagctagagaacttcccaagtctggaaatcacctaggggtgcccagagatcttgcaaacccaaagtgtcctgggagatttggaggctgatacggtttggctgtgtccccacccaaatttcatcttgaactgtagctcccataattcccatgtgtcaagggagggagccagtgggaggtaattgaatcatgggagatctttctcgtgctgttctcatgataatgaataagtcccatgacatctgatggttttataaaaggccgctcccctgcacacactctcttgcctgctgccatgtaagacatgcctttgctcctccttcaccttccgccatgattgtcaggcctccccagccacatggaactgagtccattaagcctctttcctctataaatcacccagtcttgggcatgtctttattagcagcatgagaacagactaatagagagactgtatctgaaaacatctcgggggcggatgcaggcgccatggcttggctcttgcaggggagccctgtgtcccgtgtcttgccctgggcatctaaagaccaaaagtaaaggcgaaagggatggaaagaggaagggaggaaggacagaacagagcaggaggaaagggagagggaaggcaggggccaagtgaaggcacccatggtgtttgagggtctttctctggggcagccttcaacgcagaaagaggttttattgatctgtttcatgcttctctcttttgcggctgtgttctgcccaatttccaggcaggatctgctcccaaagccggcattcttcttccttctccatcatcttgtagctggaaaatacggagtctttctggggcccagcccacttccatataaaaggcagggacaccaagcactgcagctgtgaatccaacatggtgccccttcccacactgctgctctggacaaagtgatcagagaggccagatgggggccaccctgggtccccaggagagaccatggttcctgctgcgcagaaatgagcatttacacctcacgctggtgcctgagatgttcacccacactgtgttatatttagtgctgtgccttctttgcaaacaaatccttaaatcagctcctggaacaagttttgtgttgttgtctgccatcattgacactgaggattcaggggctcatgccccaaatacccgacctgtgtcttgaccatgtagtatgatgcctccacccggagaggcccctgtgttctgcagctgcagcttaggccgctcctgggttctcctgcatcgtccctattgttgaacaaactcagcactctctggaaggaggcttcctctttgtggttcccctgtgggcagtgtctgggggcttctgtttctaccatattttgaaaaatcctcttatctgagtaagagttcttgggctatgcatattcaattgcgacacaagtactaccgttttagggggcaagataccacctgtgctatgttgaaaatgagcttgtgatttctagaagacagcaagcgcattgtgctgaaaatgtaggtatttctggggacacagagatgacgacgtgatgaagttctattggatgattttttttctgtaagaaaaacacacgcacacacatattcatgtgcgcatggtcacttacatgctgacatgcacacatacattcgtatgtactcacatgcacacaaatatatatacacatatggacacacacatactcatgcatacgcacacacacatgcacacttacttgcacatgcatactcacactcattcacatgcacacatgctcatttacatgtacacaaactcacatgaacacatgctcacatatactcattcacatgcacacaaattcgcatgcacacagctcacacgcacacatgctcacactcgcacacacacacgtacacacacattcacatgcactcattcacatgtacacagctcacacacatgctcacattcacatgcacactaattcacatgcacacacacatgctcacactcattcacatgcacacagctcacattcacacatgcattcacatttacatattcacatgcactcacatgctcactcattcacatgcacacagctcacacacatgcacacactcattcacatgcactcattcacatgtacacacattcacatgcactcacacacgcacacagctcacacatgcacacatttgcatgcacattcacatgtacacacattcacatgcagtcacacatgctcacactcattcacatgcacacagctcacacacatgcactttcacatgtacacacattcacatgcacacatacacatgcacgcaccctcattcacaagtacgcacatacacatgcacacatgctcacactcattcacatgcacacatgctcatccacgtgtacattcacatactcattcacatgcatacttatacacatgcaaacatgcttatatattcatttgcatgcacacactcatacacatgcacagattatttatcctaatattgcaaaatatgaaaccaaggagagaggcctcaggaggaaccagccctgcccacaccttgatcttagacctccagcctccaggactgtgggagaatcaatgtatgtcgtttctaagccacccagtctatggtattctgtgacagcagccagaactggactaagacatgtcataagaaaaggagatgaggacacagacacacacagagggacaaccctgtgaggacacagggaaaagacggcgtctccaagcccaggagagagacctcaggaggaaccagccctgcccacaccttgatgtcagacttccagcctccaggactgtgggagagtcaacgtctgttgtttataagccacccagtctatggtattctgtgatagcagcctgaaatggactgagacagctcataagaagaggagatgaggagaaaacagacatgcacagagggacgaccctgtgaggacacagtgagaagacagcatctacaacccaaggagagaggcctcgggaggagcccgcccagcccacaccttcatcttggacttccagcctccaggacggtgggaaaatcagtgtctgttgtctaagctgcccagtctatgggacgtcaggctggcaaccccggcagatggagaccaagcccaggtgacttctctcctgactgggattggcgcaggctgctgtgtgcatatgtcaagaaagcctcttttccaggaaacaggcaattatacccacacttacctgctacctcaagagtcagggaggggagagacttcaggagcatgagcaattactcgagttcccctcccaagtcatttcaatctcctgttggttacctggctcattcagtctgccccacagctctattgcaaacagagccctctgtgttcatgggactgttcaagaacaccaagggttcctgccagcatttgtctctctaatgccacgttctgcaaagcagaccttggactggcccagccctttgtgatctttttccccaaagaaaacacaggcgcggtagctcacgcctgtcaccccagcactttgggaggccgaggcaggcggatcgcgaggtcaggagatcaagaccatcctggctaacacagtgaaaccccgtctctactaaaaaacacaaaaaattagccgggcatggtggcgagcgcctgtagtcccagctactcgggaggcaggagaatggcgtgaacccgggaggcggggcttgcagtgagccgagatggcgccactgcactccagcctgggcgacagagcgagatgccatctcaaaaaaaaaagaaagaaaaaaaagaaaacacccagaccatgggcacggtttctcgtgttagggcagcacagagaatgtgacaggtagggaaaacagcaaagcaactcatcgttctcagagtcgcttttgttagaggggaagctctgggacctgtctcagagctgctgcagaataagaagggttcgagtcagccttcctcctgctgacaatgaatacctcagttttccctccggaggcagccccttttcctcctaactccatgaaatgtctttccggaaggtgcagctggagcaccctgcacctgcaccccagccagccctgcacccacatctgtacatgccaggcagtgctgagaaccgggcaggaagggaggggacagacgtgtctgcacagaatcctgcacctgctgggaacaactcagtgtcatcagctatggcctgggtcaaagcacctttgttttgggtattcaaaggtcagtgaagggttgagtgaaagggaaggagaaagacagagaaacaaaaaaaatcaatggaaggaagaaagagaaggagaaagaaaaagaggaagaagaaaggaggaaatagagaaaggaattaaggaaggaaagaaggaagcataatgggagggaaggaaggagtgacacagagagagagggagggaggcagtaagaaaggaaggaagcagagaacaagacagaaaagagggaaggaaggagagagaaaggaagcagagaagaaaggagggaggaagaaaaaagggagaaaggagggaagaagggaggaagggaaggatgaaaaaagaaaaaaaaacaggaaggaagcaaagaaggaagggaggcaggaagcaaagaaggaaaggaggaaggaaggaaaagagacagaaagaaaaaaaaagaagagaaacaaagaaccaaagagaaggaaggatgggagggagggagggagggaaggatgggaaggaggaaggaagggagggagggaggggggaagggaggggggaagggagggagggaagggagggagggagggagggagagagggagggagagagggagggagagagggagggagggagggagggagagagggagggagggagggagggagggagggagggaagggagggagggaggaagggagggagggaggaagggagggagggagggaagggagggagggagggagggaagggagggagggagggagggaagggagggagggagggagggagggagggaggaaggggggaagggagggagggagggagggaggaagggagaggggaagggagggagggaaggagggaggaagggagggagggagggaagggagggagggagggagggaagggagggagggagggagggaggggggaagggagggagggaggggggaaggggggaagggagggagggagggagggagagagggagggagagagggagggagagagggagggaggaagggagggagggagggagggaagggagggagggagggaggaagggagggagggaggaagggagggagggagggagggaggaagggagggagggagggaggaaggaagggagggagggagggaggaatgaagggagggagggaggaagggagggagggagggagggaggaaggaagggagggagggagggagggaagggagggagggagggagggagggaggaaggaaggaaggaagggaggaaggaaggaaaaaagggaggcaaaaggaaggactggaggaaaaaagagaagataagaggaaggaagggagggaggaatttattcctcagagcctttgctgcatttaccaattctggttctgcccctatttgaccaaatatctgtggtgactctgagaattctgatttctaagataaggcagatattgtgaatttgaaatagcaaatcccttttgtgtcattcaaaccacgatttcctttttgttagagctcctgttctccagatagcacccagggcacacagagatatttgcctgtgactcttcaaagagcttcagaaagctgttccctctgaactccacacttaacttgtattagacatgctgggctttgcagaagagacacacacagggcttccctttgtccttgggacggatcccctgtgctgtctgcaaggaaactacctaacgctccactgccaggagcagagggcagcaggaatggcatcacccgggatgtctcctagggaggaggctagcagggcttgggcggcaaacgctcagctctctgcaaggcacgcagaggctcgttcgccttctggaaatgttgctatttgaatgcagacgctgttagtagatccttgagttgtgctgagagagatctgagggcacatgtatttattttagcaccgtccacatcttagggcagaaactcacactcagggaagtggctggcaagtaaagagactcctagctgagcttcccaaggagagtttccacgccccaaagttgtggaagaggggacggagtaatgctgtggtcaaagagaaattcagagacttctgcccaggctcagctgccttcctggaagaatgttctgaacattctacaaaggcaacacttcctctccatacctctgctccagccacccagggatcctgctgcttctgccacgatgtcccctgcctcttgcctctctgtacctgctgcttgctccttctggaatgttctggaaaataggtttcggggctggatgttttctgggatgctgactcacacgcaaatcatagggtgacataatgtgtgcatgtgtgtgtgtgcacagatatgcataggtacgcatttatgtggatgtgtgtgtacttgtgggtagatgtgtattgtatgattgtatgtgcatgtctgtatgtatatgtatatgtatgtgcacgtgcatgaatgcacacgttaatgggtacgtgtgtgtattcatgcatgtgtttggataaatatatgtgcatgcatgtgtgtgggggcgcagatgtgcgggtatgggcctgcgtgtgtttgcacatgtgtatatgtatgcatgcatgtgaatgtgtacttgagggatgtgtattgtatgagtgtatgtgcatgtctgtatgtatatggatatgtgtgagtacatgtacgtacatgcatgtgcatgaatgcacatgtgaatatgtgcatgtgtcgataggaatatacatttgcataaatgtgtgcatgtgtgtttgctcatgcatatgtgcacacatgcatgtgggcacagatgtgtggatatacgcatgtctgtgtgcatgggtttgcacgtgtatatgtgcatgtgtgtctatgcatgtgaaggtgtgtgtgcatttatgcacgtgagcatgtgtgcacatactatgcatgtgtgggaggggtgcaggtgcgcgcatgtgtttgcatctatatgtgtgtatttgtacatgtgtgcatgtatgtgtgcatgagtgtgcacatgtgtacgtgcacacacgtgctctcaactccccaatgagagctgtgggttgtgctaaacttctagggatgtttcatggcctcagtgaccacctgaagcagagaggattaagaaaaccttcctttaactacaatctcgtaagacacacacacaaacctgctcttaccaggaataaacactcacctgacagacaacagagaggagatggcttgtgctgtttaatgtcaggtaacacaggtcttaagtgggctctgtgatgattgagttcacgtatcaattggctgggctatggtgcccagacatttggtcaagcaccagactgggtagtttgtggatatcattaacatttacaaatcagttgcatttaagcgaaggagaggacgcttcacaatgtgggtgggcctcacctcatcaggagaaggccttcacagcaaacactgacacttactagaaaaggaattccactccagactgtgacagggcaatcctgcctgagtgtccagcctgccctgcagattttaggctcaaggctgcaatgtcaaatcttggccaggtctccagcctgccagccagcctaccaattttggacttgcccgcccctacaatcccaagagtcaattaaactaaatctttctctatgcatagatcctattggtcctgtttttcttgagaactgcgactaatacaaaattgaacggtctcaatggcagagagtctgggcattctgaaaccaggaagaaatgccgggctccaggaatgatcttggctcatctcttagcttgagtcactggaaggtctcgcacagagaccttcaatcaaaagcacagagactgctggctggcttttaaggctaaaccaaaggagggcatttatccactcaagggaagaagtttcccatccaaagaggacacttctttttagggtggcagcctcagagcctatgatgtctttgttcctggggagtctgttagagccaccagagagtccatcacagacataccctgtggaaaggagagatggcatctccttggacaaaacggcccttcccagttctgtaacttctgtggcatttccaatgtgtacctcaaactgatctgggtggcatcacctctgagcctgagagaacctccctctttccctccctctctctcacacccttctccttcctcctttgcttcctcttcctttttctctttttctctctctattcctctttctcttcctcccccatcttatcctcctcctctttcatttcttccttctccttctctttcccccttatcctcctcctattcttctatcccttcctcttcctttttctctcttcttcctcctccatcgtatcctcctttttcttttttcccttattctcctttcccatctctttctccctttctcttctctctctgccttttcttctttttttctttctcctcttttctcttcttgccttttcactctctattcctctttttttctcctccatcttctcttcttcctcctccacctcgtcctcttcctcctttctgccttatcctcctcctgtttttctctctatccctctctctcccttcctcttcctttctttctcctctttctcattttctccctcttcttcctcctccatcttctccaacttcttcctcctcctcctctttctcttatcttcttcttttcctctatctttctcttcctcttctctcctccttctcttttctttctgcccttctttccttttctctattcctccctttttcctcctccttcatcttctcctccttcttccttctcctcctttttctctttctatccctctgtcttcctccttttattttttctccttttcctcatcttcctttttctctctctcccttcccttcctcctcttccccttcctctttctcctcctctctctctgccccctctattatcaatttacagtataatccagcttttcctaaaaaaaaactagacaaccttcacactacacccttctgtttctaaaagtcttcctctgaatcgaaatcactcttgttcacttgtgtgaggctgggggattcctgaatgaacttgtatccacttgttttgaaaacaacaacaactaaagcaacagaacttcctttaggattcatatagagcattcatatggaattaccgagaactatcttcttttgtccacagccccaaagctggggctcaatcccctgcagtcctggggtctggggtcctcacgcttagcactcaagagaatgggccagagagcttgtaaaaacaactgcacccctggtatttctaactcagtggatcttaggaggcccaagaatcagcatttttttttattttttattatttatttatttatttgagatgccagggctggagtgcagtggcatgatcttggctcactgcaacctccgcctcccaagttcaagcaattctcctgcctcagcctcccgagtagctgggattacaggtgcctgccactacatccagctaattttttgtatttttagtagagacaggatttcaccatgttggccaggctggtctcgaactcctgacctcatgattcgcccatgtcagcctccaaaagtgctgagattacaggcatgagccatcgtgcccgacccaagaatctgcatttctaacgagctcccagaggctgctggtctcagagaccacgctgggaacctcactcattctagcttcttatgcagctctgcaaactatacaccatgggcaaaattcagcctgtacctgtttctgtacaggctactagctaagaatggttttatactcttaaagtgttgttaagaaaaagaaagaaagaaagaaagaaagaaatatgccaaagagactagaggtggcccacgaagactaagacacttcctatctggccgacctcctgtgtagagcaaggaactgtggcttcgcggcagaatttcattatctgccgctgtgcagctgtggctgacagacgctgtcttccacacattctcggaatgatgaagtgggcttgcttggtgacgccttgtgcagggaaatgaaagttgtcttctgaatacacaagacggtcctgtaaatcatgctccctgtggcttaaataacacatcctgttttatctacagcttttttttttttttaaatgacaatctttagagactggcaagaggacagaagatgtataaatgtgaacccaaatccaagaacgcagtgtgttcccttttaacagacacaagagcatctttgaagttccagacgcccggctggggggcgctggggagacggtgcagcaccatttatggtaaaatctgcatcaagccactcttgagtcctggagagtgttggagctgcaagctacagaaaccatttcaacttcattcagtccaatgaatgtttattaaatgctcacccgtattttgccagctcttggggcaaaggaagagaatttcagaaataacccctgctgcccaggagcttccaatagacatgggcagtgggtggatggtgaggcacaagtgcaggaaaaaaaaaagatgaaacacacacaaaatagaagatagagtttcaagtgtactaaatagagccacaagcaatatagtcagagagaggaatgaatggctcataattacataattacacagagctttacagtggagaaaatggtttcccatatattctgtcggcaatgttcacaacactcttatgtgatattattatccagaattaacaaattagaaaaatgagaggcatagcagggaaggagaggagaagggagctgttgcaggaaatagccactgcctgattcttccagggacccctccctcgtcatctcccttctttctctgctttgctatcatgagccctgatccatgcacacagctggatccatgcacatgcattcaatatctccctccctgccttcacccatgcacacagccctgatccatgcacacagctggctccatacacatgcattctgcagctgcctccctgcctgcatccatgcacacagccctgatccacgcacacagctggctccatgcatgtgcattcaatatctccctccctgccttcacccatgcacacagccctgatccatgcacatgcattcaatatttccctccctgccttcatccatgcacacagccctgatccatgcacacagcccagatccatgcacacagctagacccacacacacacattcagtacctccttccctgccttccaggcacagagccctgatccacgcacacagctgttttaggttttttgcagtagtattcagaacagcaaagatatgcaatcaacctaagtgtctgtcagcagaggactggctaatataaagaaagtacagtatagtatatacacaccatggaatattatgcagtcatatcaaagaatgaaatcatgtcttttgcagtgacatggacaaacactgcacgtttccactttttattttattattttactttttattttttgagacggagtctcactctgttgcccaggctggagtgcagtggcacgatcccggcttactgcagtctctacctcccatgttcaagcgattctcctgcctcagcttcccgagtagctgggactacaggcgtgtgccaccatgctgagctaatttttgtatttttagtagagacggggtttcaccatattggtcaggctggtcttgaactcatgacctcaggtgatccacccgcctcagcctcccaaagtgctgggattacaggcatgatccaccatgcccagcctgtttccactttctaaggtccctagagtcatcagattcatcaagacagaaggcagaatggtgttgctaggagctaggaacagcagggaaattggaagttgtattttaatggaaacagagcttcagtttgaaaagcaggccgttctcctaacaaacaactcagatactgaaagtcaaacactgatcctgccatgttctcacttgcaagtgggagttcaccagtgggtctacacagacacagagggtggattgacgatgaggaccctgaaaggtgggaggttggcaggaggtggaggatgaaaaaaatcacctacaggtatagtattcacagctggggtgaggggttcactagaagccgggacttcaccgctgtgcaatgtctccatgcaagaaatccgcacctgtactccttaaatttataataaataagtgaatcaataaatacataagccgggctgggtacggtggctcacacctgtcatcccagcactctgggaggccgaggccggcggatcacaaggtcaagagatcaagaccatcccggccaacatggtgaaaccccacctctattaaaaatataaaaattagctgggtgtggtgagacatgcctataatcccagctactcgggaggctgaggcaggagaatggcttgaacccgggaggcaggtgttgcagtgagccaaaatcatgccactacactccagcctgggcaacagagcatctcaggggaaaaaaaaaaaaaaaagggaacaaaaaaagaaatccgcacctgtactctttaaatttataataaataagcaaatcaataaatacataagccaggacgggtgcggtggctcacacctgtcatcccagcactttgggagaccgaggcgggcggatcacgaggtcaagagatcaagaccatcccggccaacatggtgaaaccccatctctattaaaaatataaaaattagctgggtgtggtgggacatgcctataatcccagctactcgggaggctgaggcaggagaatcgcttgaacctgggacgcaggggttgcagtgagctgagatcgcgccattgtactccagcctgggtgacagggtgagactccgtctcaaagaaaaaaaataaataaataaaataaataaatccgcacctgtactccttaaatttataataaataagtgaatcgataaatacataagccaattggtgagatgacccataaagacaaacaaagctttgtgaggggaaagcaagcgcccaggagaagccctgtcttcggaggttttggcgcaggcctgaatgaagggaaggagagggattggatacctgggggaagggcgtgcgtggaggaggaaacagccagggctgaggcctgcacattgcagggaaagggtgaagtccctggtggctctacctggagcaatttcttcttattttttctttttttgagatggagtttcactcttgtcacccaggctggagtgcagtggcgcgatctcggctcactgcaacctcctgctcccgggttcaagcgattctcctgcctcagcctcccgagtagctgggattacaggcgtccgccaccatgcctggctaatttctgtatttttagtagagacggggtttcaccacgttggccaggctggtctcgaactcctggcctcatgtgatccacccgcctcagcctcccaaagtgctgggatgacaggtgtgagccactgcgcccggccacctggagcattttcagtggagcatgggggactggaagtgaattgtatgagcaattcctgtatggggatttgctgcagcggagactgtagtcagggacagtccccaggggaaatagaaggtccagagagggtggttagatttgtttattaataaaaaaaaaaaaagaaatgggggggctgggtagggtgtctcatgcctgtaatcccagcacttcggcaggccgaggcaggcggctcactcgagactgtgagttcgagatcagcctgagtaacatatcgaaaccccgtctctactgaaaatgtaaaaattagccaggcgtgctgggaggtagctgaggtcccagctacccaggaggatgaggccgaattgcttgaacccaggaggcggaggttgcagtgagccgagatcgcaccactgcactccagcctgggcaacagagagaggttccatcttaaaaaaaataaaaataaaaaaattcccagtacctgcatccttgatttgattaattaacctgtcaccctctcggcacatcaatccaagttccaatcaaccctaagacagactttcattagactgcatggcggatacaaatacatgcttaagacaagcaatgatacgagtggtctacttcatggtgaagtgggcgcagtctacactgcaaatttgttcattttgatggcaggcctgatcacatgatttcaaagtggtcaggacttgctggacatgagccctgaatggtggagctgatacactcagcatttacaatagctttctatttttttttttttttgagatggagtttcgctcttgtcgtccaggctggagtgcagtggcatgatctgggctcaccacaatttccgcccccgggttcaagcgattctcctgcctcagcctcctgagtagctgggattacaggtgactgccaccacgcctggctaatttctgtatttttagtagagactgggtttctccatgttggttaggctggtcttgaactcctaacctcacatgatcctccccctcagcctcccaaagtgttgggattacaggcatgagccaccactcccagccgatagctcttttttgtaacacccattgatcttgagacaactggggtgggaagagaggtaatagccacgttcatttgctccctaggaggggtatacattgtagggggtactgagtttcactgatgaagctgcgaggagcttcctagaggtctgaagagcacacatgccctctgaaatactaagctactctcctacggaggctgagaccatctgcatgtctcagcatgaagaatggcctgatgcatttgtatacaggacaaatcaaacctctcatctttataaatgcacaaatcataatcccaacactttgggaggccacagcaggaggatcgcttggggctaggaactggagacccggctggacaacatagcaagacctcggctctaccaaaaaattttaaaaaattagccaggcatgctggtgcattcgtgtagtcccagctactcgggaggtggaggtggggtgatcgtttcagtccagcaggtcgaggctgctgtgagctgtgattgtaccactgcactccagcctgggtgacagggcgagaccccatctcaaaaacaaaccaatcaacctcctagtttttcttctggtaccgactggtcgcccaggttactggccgtgaatttggaatcgagtccatgtgttctgatgagacagaggatagaggtttcagagtgacatacaaccatgccctcagatgatatgaaacatcacagagatatgtatgtcacacagattctccccagggaccctggacagatcctgcaaggtttttcttctttcttttttttttttttgagacggagtttcactcttttcacccaggctggagtgcaatggcgccatctcggcttactgcaacctccgcctcccaggttcaagcgattcccctgcctcagcctcccgagtagctggaatgacacacacgcgccaccacactcggctaattttttttttttttaatagagatggtgtttcaccatgtttgacagtctggtctcgaactcctgacctcaagtaatccactcaccttggcctcccaaagtgctgggattacaggcatgagacacggcacccagctgatcttccaagtcttaatatacaatgcatgcatgcatgcatgcatacacactagtaaataatacatacacagcaatacagaattatcattacaaagacagcatcaagctactgcagctgtatagccttttctttaaaattcttacattattttaatttcatttccaggctaatgcatattcttctgctctataattttaaagtttccacaatgttgtctcttatataaaggcagtatcactcgagcaatgccccgtggttatttttaatccaaatttgcagatgatgatcaaaggattaaagaatgattcatgtggctaaagttgcagtttgcttgttaaatatttagaaagaaataatgtcaaggccagccatggtggctcatgcctgtcatcccagcactttgggaggcagaggtgggagaatcacttgaggccaggatttcaaggttgcagccagtgattgtgtcataattccagcgcacaagaccaacctgggcgaacagcaagatgccgtttctacaaaaaaaaaaaaaaatgcacagcagccagggtgacagagcaagacctggtctctaaaaaatttaaaagaggccgggcgtggtggctcacgcctgtaatcccaacactttgagaggccgaggcaggtggatcacgaggtcaggagatcaagaccatcctggccaacatggtgaaaccccgtctctactaaaaaaaaataaaaaataaaaaaaaaattagccagacgtggtggcgggcacctgtggtcccatttactcgggaggctgaggcaggagaacggcatgaacctgggaggcggagcttgcagtgagctgagatcgcgccaacgcactccagcctgggcaacagagcaagactcagtctcaaaaaaaataaataaattaaataaaataaaaaaacagcaaatgctctccttggatactgaagtcactctctgagggattcatgggggttttataaggatgaaatgtatcctagtgttggtgtattgctagcgaatacttagtgcttaataaaataactaatattttgaaattcctttgcttgaggaattagagatgtgaagaacaacagatcagaaagcaaactgcaaaataagggatgtacagctgggcgcggtggctcacgcctgtaatcccatcacttaggaaggccgaggtgggcggatcacccgaagtcaggagttcgagaccagcctgggcaacataatgaaaccccgtccctactaaaaacacaacacttagccaggcttgatggcaggtgcctgcagtcccagctactcaggaggctgaggcaggagaatcacttgaacccaggaggcggaggttgcagtgagctgagatcgcgccagtgcactgcagcctggtgacagagcgagactctatctcaaaaaaaaaaagaaaaagaaaaagaaaaaaagaaattcctttgcttgaggaatgagagattcgaagaacaactgataagaaagcaaactgcaaaataagggaagtaattaatcccctcaaaaagtccacattgggggcgggcagctcatatcatgagagactttcagacgaaatcaagagcaatgccaggagtccaacagggagaaaagagaatttgtaaccaagctcattaattccaaagcttgatgaaacagacaattacctaaagggaaaagctgtctaaactgactcagaaagaggtgggaaacttcaacaagcagtagacgcccaaggaattttgaaagctgagttagaatcgctcttccgaaaattcctcaacccatgcggttttgaaggtgaatcgtggcggtgtttcaaaagcagacacttttaaaaatgctaattagacgattctgcaatgtaaagggagaaatagaaaagcttctcaaggttctttctttgttttgtaaacaaattattaaaactttagtatcccgacttgagatagataggaaagaaagtaaatctatagctcccagatacatatcacttcaaaagacctcaaggaggacaggcacggtggctcactactgtatcccagcacttcgggagaccgaggcgggcagattacttgaggtaggtcaggagttcgagaccagcttggccaacatggtgaaaccctgtctttactaaaaatacaaaaactagccgggcatggtggcgcacacctgcaatcccagctactcaggaggctgaggcaggagaatcacttgaacccgggaggcagaggctgcagcgagccgagatcacaccacggcactccagcctggtgatagagctagactccatctcaaacaaacaaacaaaaaaacccaagggaatggctggggcatgaaatcttgcagtgcttaagaagttaatgcatcacgacaacgaagatcattgcagaaatgtgggagctttcagctgctgggtcttaaaaaccaacaccccaaagtacggtgctttgtcctgctgaactgaagaagcctcaagatctctctaacttccccctcctgcttcctctgtgtctcccgatgcacaggatgaagttgttctctgaagtttcctgaagtctggacatgtcaaagaaggaaaaatgaccagtgtccccttccctgagtttctgaacccacatcgcggaggaaagactgatgtctgtcaacagccctgcagagactcctcataaaccactgtctgttctgagggttccacagcctctgtccctgcagagactcgtcataaaccattatctgaggccaggcgcagtggctcacacctatcatcccagcactttgggagcccgaggcgggtggatcacctgaggtccagagttcgtgaccagcctggtcagcgtgatgaaaccccgtctctactaaaaatacaaaattagccaggcgtggtgtcacatgcctgtaatcccagctactcgggaagctgaggcaggagaatcgcttgaacccaggaggcagaggttgcactgggcagaggtcccgccactgcactccactctgggcaacacagaacgaaactccgtctcaaaaaaaacaagcaaacaaacaacaataacaaaaaacattatctgttttcgggccactgtacattgttcaaacccattgacttctctttaaaatcatttactatttggaatcctatattcacccccaattccccactccccttccgctaagaagaagaggacacaagcgtctgtacccctttgtgtaatggggcaattcctctgacattctcctccatggatgagaatacatttgcctgtcatttcctttattcatgtttcaaaaagggcaattgtattttgtgcgttgatttttcagcaaaccttcaaatggcaaagggggatgtttttcccttggcccctaccacagcatccccaaacggtctccagctcctaagaagattcatttatgggcactacctagctacacagcgtcacccaccgagctcgcacacaaccaaggctttggggtgagaatgtacaaatacatcacggaatccaagcccccaacaccgcacacgcagcctggaagtggttgtgtcagagctgtgtgaaccagcgtgactccatcttgaataggggctgggtaacacgaggctgagacctgctgggctgcattcccaggcggttaaggtatgctaagtcgcaggatgagataagaggttgctacaaggtacaggtcataaaaaccttgctgatacaacagcttgcagtaaagaagcgggccaaaacccacaaaaagcaaaatggcgacaagagtgacctccggctgtcgtgacggctacattcccaccagcgccaggacagttacaaatgccacggcaatgtcaggaagttaccctctacggtctaaaaaggggaggcatgaataatccccccctcgtttagcatatcatcaagaaatcaccgtaaaaatggccaaccagcggccgccggggatgctttgtctgcggaggagccattcatttactcctctaccttctcaataacttgcttctctttccaccactgagccgtcctgaattctttcttgcacgagatccaagaaccctcccttggggtctggactggggaccccctttcctgtagcatcttcaggtgcagccgtgaatcagagaagcagaaggggcttaccttgaaaagcaaccagccgagaagcttcttcgccagacgggtggcccagaacacgtgcttgtagacgtccgtgttgaccaccccggggtccaccacgttggcggtcacgtggcttccctcagccgccagcagccgctggaggtggtaggtgaacaggacaagggccagcttgctctgggcgtaggctgcgtggggtgagtagcaggcactgtggggcaagcaggagaaggtgtaagaggctgacggcgttcacgcctaagtgcttcatcccagcagcatctgtacctgcggccacggccacgtctatacgcagccacctcccctagacccatgtgtgatcatgccatctgttggccagttttccaacgcgtgtggatttttctagttcacctttttattataaactcatcccttaattgtattggggtcagatatgttaaattatgttactaattttttatttatttatttatttattttggagacagagtcccccctctgtcgcccaggctggagtgcagtggtgcaatcttggctcactgcaacctccacctgcccggttcaagtgattctcctacctcagcctccccagtagctgggactacaggtgcccgccaccacaccctgctaattttttgtattttcagcaaagatggaagttttaccatgttggccaggctgctctcgaactcctgacctcaaattatccacccgcttcagcctcccaaagtgctgggattacaggcaggagccactatgctccctgttttttttttttttttttttttttttttttttttgagacagattctcactctgtcacccaggctgcagcctcccgggttcaagcgaatctcgtgcctcagcctccagagtagctgggattacaggctcctgtcaccacgcccggctaattttttgtatttttagtgggaacagggtttcaccatgttggccaggctggtcttgaactcctgacctcgggtgatccaccctccttggcctcccaaagtgctgggatgacaggcatgagccaccgcgcctggccacatgtggtcttcttgatgagtctcaaatcataaaagacaaccacacaagcaatttggcaaacttcccaagctatcataaattttcctcacatctactgcaagctctgtagtgtgctaagcacatgttaaactctttgcaccttggttcaagcagtttagagaaatgttttagtatcacaggacatagtgataaaaatcgatccgataaccgcggtaaagtgagtaacgtgcctctctctctctctctggtaacctcaatcaccagaaacacagaaaactggatgtttccagctttgctcctgtaaatatgttctactttttctatgtatgccttagaaacactttttaaagagatgttatttgcggtgttacataacgtcccttgaaggcacacaaccaccatagactccttttagaatttaatgctaggcacagatcattagccttagaattggcctcatagttcttttcaataagacaaggagaagtatttgagcaataatgtttttctttcctctggggctccaaagatgcccagaggcgatcaatttgctacacaattatcgtaacaacatttcaaggtggctgaaggttcatatcgcttgcttcttttatatatatatatatttttaaattttatttttatttatttatttttgagacagagtcttgctctgtcaacccagctggagtacagtggcgtgatctcggctcactgcaagctcctcctctcgggttcaagtcattctcctgcctcagcctcccaagtagctgggactataggcgcctgccacctgcctggctaattttttgtatttttagtagagacgaggtttcaccatgttagctaggatggtctcgatctcctgaccacgtgatctgcccacctcggcctcccaaagtgctgggattacaggcatgagccactgtgcccggcctaattttctgaattaaccacatggtatatgtatcctgatggaagctgtgaacagaaaatatctgggcaccccaaaagcgggaagctcaaaggaaaagtccagctggaacctgctgaaggcaaacctgcctcccactctgttcaaagtcacccctgtgctcactgagatagatgcatatctgatcacctcctttgggaaggctcatcacaaacccaaaagaatgtaaccatctgtgtctcacctacctgtgagctggaagccccctccctgcttccagttgtccctgcttttcaaggactatacttcttatttttttgagacagagttttgctcatattgcccaggctggagtgcagtggcacaatcttggctcactgcaacctctacctcctgggttcaagccattctcctgcctcagcctcccgagtagctgggattaccagcgcccgccaccacgcccggctaattttttgtatttttagtagacatggggtttcaccatgttggccaggctggtctcgaactcctgacctcaggtgatccgcctgcctcggcctcccaaagtgctgggattacaggcgtgagccaccgcacccaccccaacgtagctcttacatatattgattgatgtctcctgtctccctaaaatgtataaaaccaagctatggccagacgcagtggctcatgcctgtaatctcagcactttgggaggccaaggcgggcggatcacaaggtcaggagtttgagaccaggctggccaacatggtgaaaccctgtctctactaaaaaaaaaaattaaaaaattagccaggcatggtggcatgtgcctgtagtcccagctactccggaggctgaggcaggataattgcttgaacctgggaggcaaagggtgcagtgagctgagattgtaccactgcactccagcctgggcaagagagtgagactccatctcaaaaaaaacaaaaaaacaaaaaaacacacaaacaaaaaaaaaacaagctgtgacctgaccacgttgcacacgtcatcaggactttctgaggctatgtcacaggctcacgtccttaaatttggcaaaacaaactctaaattaactgagacctgtctcaaattttcagggttcacaaagccatctcagatatagtttgaatatcagcatgatatttatgctaaaaaactaaagataagatcaaaaagcctaaaagaatgtttaacacattcaaaagatcaaaagaaagacatccgtcatcatatgcgtttcagaaaaagcttctgaaaatccaatgcctcttaccaacaaaagctgttcctaaataagaatacaatattgagggctgggtgcgttggctcatgcctgtaatcccagcgctttgggaggctgaggtgggcagatcaccaggtcatgagtttgagaccatcctggttaacatggtgaaaccccatctctactaaaaatacaaaaaattagctggacgtgctggcgggtgcctgtagacccaactacttgggaggctgaggcaggagaatcacttgaacccgggaggtggaggttgcagtgacacgagatcacgccattgtactccagcctgggcaacagagtgaaagtctgtcaaaaaaagaaagaaagaaagacagaaagagagaaagaaagaaaagaaagaaaagaaagaaagaaaaagaaaagaaaagaaagaaagagaaagaaagaaagaaagaaagaaagaaagaaagaaagaaagaaaaagaaagaaaataaaagaatagaaaattgaaataaatgaagtaaactttgacctaaggatctggagaagaaaaatgaaaatgctttcctaaggaaaacacataaaagaaaaccaaaaagatcaaagcaaatgagaaatacagaaagaaaacagtataaacataaatgataccactggggaacagagactgatgttggtttttgttgttgttgtttgagaaggagtcttgctctgtcacccaggctggagtgcagtggcgccatctcagctcactgcaacctctgcctcctaggttcaagcaattctcctgcctcagcctcctgagtagctgggattacaggcatacaccaccatgcccagataatttttgcatttttagtagagacggggtttcatcaggttagccaggctggtctggaacttctgaccccaagtgatccacccaccttggccttccaaagtgctgggattacaggtgtgagccactgtacatggccctggtattggtttctaaacctcctctccctgttataaaatgtccaatatacactatattttgcagatgaaaagtagaatattacaattacagagcagaccctgaaactataaaaaaaaaattagggctgggtgcagtggctcacacctctaatcccagcactttgggaggccgagatgggcagatcccgaggtcaggagatcgagaccatcctggctaacatggtgaaacctcgtctctactaaaaaaacaaaaaattacccgggcatggtggcgggcgcctgtagtcccagctactcgggaagctgaggcaggagaatggcgtgaacccgggaggcggagcttgcagtgagccgagattgcgccactgcactccagccttggtgatagagtgaaactccgtctcacaaaaaaaaaaaaaaaaaaaaaattagataccctctatattcatgtattcattttttcataaaataaatgaacaaaaccaataatgcatgcctatgctggggctcagagaacagtaacctaaaatgaagacctcagaagcagcatcagaagcaaacctttcttgctgaccttctcctaccctcctgtctctcagacccatttcgccccaagggcaccacggaaactggaatccttcttccccaaggtgggtcccgaaaaccaaagcacctttcccccaaggccagccagaaaccctataaataggactctaagtttccctacaccctgagtatataaaaactcgccataaagaaatttcctatcatcgtgcagtggctcacggctataatcccggcactttgggaggccaaggcaggtggatcacttgagatcaggagttcgagaccagcctgcccaacacagggaaacatcacctctactgaaaatacaaacattaggccgggcacggtggctcacgtctgtaatcccagcactctgggaggccaaggtgggcagaccacaaggtcaggagatcgagactatcttggctaatacggtgaaacccggtctctactaaaaatacaaaaaattaactgggtgtggtggtgggcgcccgtagtcctagctacttgggaggctgaggcaggagaatggtgtgaacccaggaggcggagcttgcagtgagtggagattgcgccactgcattccagcctgggcgacagagcgagactctgtctcaaaaaaaaaaagaaaaaagaaaatacaaacattagccaagtgtggtggcgggcacctgtagtcccagctactcgggaggctgaggcaggaaaattgcttgaacccagaaggtggaggctgcaatgagccaagattgcgccattgcactccagccagggcgacaagagcaagactctgtctcaaaaaaaaaaaaagaaaaagaaaagaaaagaaaaagaaagaaaagaaaaggaaaaggaaattccttgacctgccttgtttgaatgtaggttctacgacccccttcccagagagggtcccaccccacccccagaaggaaggcgcactgctcagaggccaaaaaaatctagacaggcctgtctgtttccccactcagaccgtcagccttagatcacaccctcttcctccaatcctattcctacacggatttcgttcagacgtcgttgaacctaagcataaaaatagacggtttcccctgcatctttgggtcttccctctgaaggctgctgtatgtatccatcgagtaaactttgtatgccttttctcctattcatctgcttttgcaagttgatttttcagcttgcaaaatcagagggaatgaccctccatctgttctcctatcacactgtcatcatttccactgtgaagaacatggggaaaactggccagacaaccaaaggaagggcgtgcacatacatttgcacatcttttgggagagcaacttcacaacatgcaactcaatctttaaaatcataaatctttttttttttttttttttgagacagagtcttgttctgtcgcccaggctagagtacagtggcacaatcctggctcactgcaaccaccccctcctgggttcacaccattctcctgccttaacctcctgagtagctgggactacaggcacctgccaccatgcccggctttttttttttttttgtatttttagtagagacggggtttcaccgtgttagccaggatggtctcgatctcctgacctcgtgatctgcccacctcggcctcccaaagtgctggaatgacagacgtgatgtgagccaccacgctcagccctttttgtgccttttttttttttttttttttttttttttgagacagagtctcgctctgtagcccaggctggagtgcggtggcgcaatctcagctcactgcgacctccacctcccgggttcaagtgattctcctgcctcagcctcccaagtagctgggactacaggcgcctaccatcacgcccagctaatttttgtatttgcagtagagatggggtgtcactgtgttggccaggccagtctcgaactcctgacttcaagtgaaccgcccgccttggcctcccaaagtgctgggattacaagcgtgagccaacgcacctggcctatgaatatcttttagtaacatcactacttgaaattgatcttaaaaaaataaaccttgggccaggcatggtggctcacgtctgtaatcccaggactttgggaggccaaggctggcagatcacgaggtcaggagatcgagaccatcctggctaacacggtgaaaccccgtctctattaaaaatacaaaaagttagccaggagtggtggcgcatgcctgtaatcccagctacttgggtgctgaggcaggagaatcgcttgaacccgggaggtgaagattgcagtgagccgagatcacgccactgcactccagcctgggcaacagagtgagactccatctcaaaaaaaaaaaaaaaaaaaattaagcattgattcaaaaagtcttttctggctgggtgcagtggctcacatctgtaatcccagcagaactttgggaggcagaggtgggcggatcacctgatcctttcaggggtttgaaagggttcttggatctcgtgagaaagaactccgagtgggtccatagagtaaagtgaaagcaagtttattatgaaagtagaagaataaagaatgtgtactccatagatggagcatcccgagagctgctggtggcctatttttatggttatttctctatcatatgctaaacaacgggtggattactcatgagttttctgggacaggggtgaccaattcccggagctgaaggttcatcccccttttagaccatgtcatggcatctgtaaaccgtctcttatcagctaatgcattagaattagcgtatcatgaccagagaggatgaccagaggtcagtcgtcaccatcttggtttcggtgggatttggctggctttaccacaacctggtttatcagcagggcctttgtgacctgtgtcttgtgctgacctcctctgtcatcctgtgacttagaatgcctcatccacctccagagaaggcagcccaagcaggtctcagcctcatgttacgcagcccctattcaagatggcagagttgctctggttctaatgcctctgaaaaatttaggggattgttttctgagccccaacactgtgatcttagcaactgagcaattttcccaccttcatgtaaccaaagacagagtggatcacagagcttggaaagctcgtacccgggaaatcgcagcctgcagctgacatgttctgagatgtgccttgccgttgtgcaaaaggcatgtttgaatgcttgcatgaggacaagtgactcccccattaacacctccaggggctcagttctgcctccagccactgtctcatcacgcagccatgggtagcagaaagccacatgccaaaatctgacatcgggcctgtaaaaaataaaggttcctgttcaaagactttcctccccatctaattaggaataaatagtaacttctctgagaagcaaacttcattcaaagacttgtgctaacattcctaaatatctgctagccgtgataaagaaatcaatgtactttatgctcttagctcccacaatttaacctaagtatcagccctggcatgcttatactggtccaagcaagcattacgtcacagcctgttcctcttctttatctaaaagtgctttttcctttctcagcattccacaagttacttcctccttcctttgttctcctctgcctttgcctcttttaaatagttccaaggtgctggccaatcgggacaaatacagaatgtgaggtcccattccagccctggaaactggacacagcagtagggcggacgcatcaagtgataaatgaccctgtcccctttgttcgctgtactctcctggcaaaactgctggagagtgtaccctttctgcagaaagtaaaaaaaatggccttgctgaggaaattaatgttcaagtgctatttctttatggcactggggaacaagcatttcaaacagacctgaggtttacccgatttctgctggaaaagaaacctcaggtctgctgccttagaaataaataagggcaggacagaaagggtgacaagggggtccttagccatggagactttgcaaaataatgaacaatcaaaacataactttttgggggttggggtggggtaggaggggactggaaaggctgactgcataataaagagattggaagaattggctgggtatggtggcttatgtctgtaatcccagcactttgggaggctgaggtgggtggatcacctgaggccaggagttcgagactagcctggccaacatggtgaaaccccgtctctactaaaaatacaaaaattagcagggcgtggtggcaggtgcctgtaatcccagctactcgggaggctgaggcaggagaatccttgaacccgggaggtagaggttgcagtgagctgataccacgccattgcactccagcctgggtgacaagagcaaaactctgtctcaaaaataaataaataaaaagaaatctaagagactggaagaattaagacagggaaattgagtagttcagagctgaagtcccatctctgatccaagataaactgtaaacctccaattactgtcaagatatctttttaaggcaaacttctccaatctcctcaccccaggggaagagaagagtccaggaaacagatagttactaagtgcagagaggcaaagactggctttcctgctggcatgatcgttttttaaatatcagctacaagcattcggttctgaatctccagcatttgattgatgggtaagaggaatggttacttgaaaaagcagaaaatgcatcatccaaaggcagatttttccagagtaaatggaggggttggttctgtaattatggttttacacagtagcgtggagaagagagaactaagattgtttaaaaatacggtgtgggggcaggcgaaaagccaatacatttctctacaggaggtgaagaaatgaatccaagaggggcacgtagtttcaggagagattccctggggtgggggttagggatgaagaaatatccaccccagaaatgggaaagaatgaaagcaaatacgtaggaggaaatgcccattaaggtctgtaaatgaaaccctaaggactctgacaaaagtcgttggtattaggccgggagtggtggctcgcgcatgtaatctgagcacttaggggacactaaggcaggcaggtcgcttgagcccaggagttcaagaccagactggggagtatagtaagaccttatctctacaaaaaatacaaaaagtacctgggtgtggtaaagcacacctgtagtcccagctaattgtgaggctgaggtgggagcagatcatttgagcctgggaggcgcacatggcagcaagccaagatagcgtcactgcacggcctgggaggcagatatggcagtgagccaagatggcgccactgcacggcctgggaggcggacatggccttgagccaagatggcgccacggcactccagcctaggaggcggacgtggtcgtgagccaagatggcgccacggcactgcagcctgggaggtggacatggccttgagccaagatggcgtggccgcactgcagcctgggaggcggacatggccgtgagccaagatggcgccacggcactccagcctaggaggcggacatggccgtgagccaagatgtcgcggccgcactgcagcctgggaggtggacatggcagtgagccaagatggcgccaccacactccagcctgggaggcggacatggccgtgagccaatcagcaaagatggcgccactgcactccagtctgggtgagacagggagactgccaaaaaacaaaatgaaacaaaaaatcattcaatgagctttcctgttgaataagaaactgaacaaaagccacctgctactaaatctggaccttataaaagggtatttgagttctccattttttgctgattaaagcattactctcttcttgttattaaaaatcgtgaagactgaacatacttttgagtgtttataagaccgggcgcggtggctcacgcctgtaatcccagcactttgggaggccgaggcgggcggatcacgaggtcagaatatcgagaccatcctggctaacagggtgaaaccccgtctctaataaaaatacaaaaaaattagccgggtgtggtggcagacgcctgtagtcccagctactcgggaggttgaggcaggagaatggcgtgaacccggaaggcggagcttgcagtgagctgagatcacaccctgcactccagcctgggcaacaaagcaagactctgtctcaaaaaaaaacaaaaagaaaggagccctttataagttattgtgatggatactgtaggatgtaaacgtgtcatatctcggtctcccaacagccagtctccgtaggcggtgtccttttatatggatcaacaggcagtttttgcattgattatttatccactttgagaggtacttgtgtagaagcaaggacaactgagtttttatgttaacttcctacgaatccgttgcattgcaacgtatttccattgcaggacattgttgcataatcaaattgccaatgcaattagggaaactcaatcgactgctcataacctagttgactggagctatttttccagtgctcattaaacctgatgacaatcactgttttaatgagtaagtatgggtggcattcaatatatttataagtattataacaatccttcatgtctaaattgaattttccctttggcagtacaaacaactccattacattctttctaggatatctacgcttaatattcttgataactatcatctacatttaatattcttgataacgatccgcctaccaggaactcagaaaatactgcgaataaagagaggttttttttgtttgtttgtttttttgaaacagggtctcgctctgttgctagggtggagtgcagtggtgcgatctcggctcactgcaatctccgcctcccggattcaagtgattctcctgtcttagccttccgagtagctgggactacaggtgcccgccaccacactcagctaattttggtatttttagcacagtggggtttcaccacattggccaggatggtcttgatctcctgaccttgtgatccaccccctaggcctcccatagtggtgggattacaggtgtgagccactgtgcctgccccacgcccccccccttttttttctttttttttttttgagagggagtcttgctctgttgcccaggccgggctggagtgcagtgctatgatcttggcttgctgcaacttccacctcccgggttcaagtgattctcctgcctcagcctcctgagtagctgggactacagtcacccgtcaccacacccagctaatttttgtatttttagtagagacgggtttttaccacattggcctggatggtgtcgatctcaaagagaggtctttgactttttccgctaagagaaaacaaccaaaacaacacaggacattgcaggtatcttgtgaattccagctgcatccaaacaccctgatactttcgctcatagacacatagtgagtgtgtcagctgtccgacatatctcagaacacagggggaacatgtgaaaccttgagtgaaatccgaatcgagatgggataccacactcaaaacacgttacacaacttagtctatactggatgatttcacgggatgtgaattcatggttaggaataaaataatgaagaagtcacccaaagttacataagttgagaaactcaaaccaagacagccatgttcacagtgaggcacgcccatgcctataacaactccatgactgagggacgtcagagtgaaataaagaatttcttaaataggtagagaatctatcatggccaggcacggtgggtcacacctgtaatcccagcacattgggaagtcgaagtgggcagatcattcgaggtcaggagttcgagaccagcctgaccaacatggtgaaaacccagctctacaaaaaaaaaacacaaaaattaggtgggcatggtggcggtgcctgtagtcccagctacccgggaggctgagacaggagaatcacttgaacccacgaggcagaggttgtagtgagctgagattgcgccactgcactccagcctcgatgcctgggtgacaaaagcgaaactctgtctcaaataaaataaaataaaacaaaacaaatttaagggtctcacaggaaagaaatcttaaagaatagaaaatgattttggaaggtatgtgtccctcttttttttttttttttctctccaggctggagtgcagtggtgcgatcttggctcattgcaacctccacctccccggttcaagcaattctcctgcctcagcctccccagtagctgggactacagggacatgccaccatgcctggctaattttttatattttagtagagacggggtttcaccatgttggccaggatggtcttgatctcctgaccttgcgatccacccctctcagcctcccaaagtgctgggatgacagacttaagccactgtgcctgcccttttttttctttttttgagagggagtcttgctctggagtgcaagctgggctggagtgcagtagcatgatcttggcccactgcaacctccacctcccgggttcaaacaattctcctgcttcagcctccaaagcagctgagattacaggcacatgccaccatgcctggctaacttttgcatttttagtagagacggggtttccccatgttgaccaggctggtctcgaactcctgacctcaggtgatacgcccgcctcggcctcccaaagtgctttctattgaaatttatttcaccatggggatgattcggtacagccaagttgaggagacatgttctctcatgtgtaaaaactcttggatttttggaatatgttacaacactgtgatttattcctttacaagaacgctaattttccaagccagtaaatcaatcttggcaattaacactaattactggcaatgattatatcaggcaaaagccaagaaccacatctttcatccaaaaaaaaaaagcagtatattttaaattcaagtggttctcatattttagcatgcatcagaattcccccaaagaccttctccttgccaacccctgttctccaaacttcgggtttaggagatctggaggatggtctgagaatgggagcatcttcatttcttttttctttttcttttttaagacagaatcttgctttgcagcccaggctggagtgcagtggtgcgatcttggctcactgcaacctctgcctttcgagtcccagttgaagcaattatcctgcctcagccttccgagtagcagggattacaggtgtgcacccccacgcccagctaatttttgtatttttagtagagatggggtttctccatgttggccaggctggtcttgaactcctgaccttgtgatccacctgcctcggcctcccgaagtgctgggatgacaggcgtgagccaccatgcccggcccactcaccatatatttactgaacttcagtcatatgtgacgcagggatgacacaagaacagaaaaatcagggagatggagacggagctaaccacggaagctgaagttcgtcggccagatggcccaatgcacaataattcggggaacacacatccaggcaactgcacctgactgggaatacctggctgtcctaccaccatctggtcatctaggggctcctacagtaatacagaagacgccggctgaggcgtgttctattctaccaaggggacctgggcgtatctcatggactgaattacgtctccccagattcctatgaagttctaactctgaggaactcagaaagatgaccttatttggagatagggtccttttattttatttattttttgagacagagtttcggtcttgtcaccaaggctggagtgcaatggtgcaatcttggctcactgcaacctccgcctcccgggttcaagcgattctcctgcctcagcctccccagtagctggggttataggcacctgccatggcgcttggctaattttgtattttttaagtagagacggggtttcaccgtgttgtccaggctggtcttgaactcctgacctcaggtgatccacctgcctcagcctcccaaagtgctgggattacaggcatgagccaccatgcccggccggagatggggtctttaaagatgcgattcaggtaaaatgaggtcactagggtaggtactgatccaataggactgaggtccttataagaagaggagatgaggacacagacacacacagagggacaaccaagtgaggacacagggcgatgatgacatctccaagcccaggagagaggcctgaggaggaaccagccctgctcacaccttgatctcagacctccagcctccaggactgtgggagaatcaatgtctgctgttataagctacacagtctatggtattctgtgatagcagcctgagatggagtaaggcattgcataagaagaggagatgaggacacacacacacacaaagggacgaccctgtgaggacacagagagaagatggcgtctacaagtccagcagagaggcctcaggaggaaccagccctgcccatacctggatctcaaacttctagcgtccaggactgtgagagaataatgtctgttgtttataatctacccagtctatggtattctgtgatagcagcctgaaatgggctaagacacctcataagaggaggagatgaggacacagacacacacagagggatgatcctgtgaggacacagggagaagacggtgtctacaacccaaggagagaggcctcaggaggagtcagccacacccacaccttgatctgggacctccagcctccaggactgtgggaggctcaatgtctgctgtttaagccactaggtccgtggtattttattatggcagccccagcaaagcaatgttctctcctttaagagatcactcctaagctatgaacgatgaaaaaggggcctatttggaaagagtcagtgccgtcaacgaagaacagtttccagaaagctcagaggaggcatctgttaacactctctcattatcccctgcagaggaatcatggagaaatgaaacatggctcaggtgaatgcctgtcatcaatattcattttacataatcaaactggtgaagcaaaagaggagaacaggaaaagaaaagcagtgtaagttgaattgtaagtctcgaaaaaatagggggaagtggccgggcgcagtggctcacgcctgtaatcccagcactttgggaggccgaggcgagaggatcacgaggtcaggagatggagatcatcctggccaacatggtgaacccccgtctctactaaaaatataaaaattatctgggcgtgatggcgcatgcctgtaatcccagctactcaggaggctgaggcaggagaatcgcttgaacccaggaggtagaggttgcagtgagccgagatcgcaccactgcattgcagcctgggcgacagagcaagactctgtctcaaaaaaaaaatatatagatagatatatagatatagatatagatatatagatagatatagatatatatagatatagatatatagatagatatagatatatatagatatatatatagatatatagatatatatatagatatagatatatacaataaattaaaataaaaacaatacaatacaaataaataaacaaaaaatgttagagccggctctgagctggctctggctctcaagccctttgactttgaagttccttgatctgctttgcaatctgtattactttcctgggattgtccaaacaaatgagcacagactggatgcttcaaagtcacagaaattcatccagtgaagtgataccttctggagaccagaagtctgaaattcaggagtggacagggtcgtgctctctctggacggtcttctagggcaggaacccttcctgcctttcccagcttctgggggctcggggagtccctgaccccgtggtcagatcactccagtctctgcctccgtctccacgtggacttctcctctgtgtctgtgtctcctcttctgtcttttagaaggataccggtcagtggatttaggacctaccctactccaggatgatctcatctctagatctctaactaattacaccggcaaagttctttattttcaaataaagtctcattctaggttctgggcttcgggatgtggacagatctttctgtgaaccaccattcaatccactacaattgtatccagttccctccagaggctctaggggagggcccttcctgcctctcccagctcctgggggctccgggcatccctgaccctgtggctgcatcactccagtctctgcctccatctccacgtggccttctcctctgtgtctgtgtctcctcttctgtctctttccaagaacacctgtcattccatttagggcccttcttatatgtagagtggggtcggaatagttaatattatgtgttaacctgactggatcatggggcacctagatgtttgattgaatgttactctggggtatctgtgagggtggaggggagggtccttcctgcctctcccagctcctgggggctccaggcatccctgggtgtgtggccgcatcactccagtctccacctccatctccatctccatgtggccttctctgtgtctctctgtctccaaattttctacttcattttttttttttttttgagacagagtttcgctcttgttgcccaggctggagtgcaatggcacgatctcagctcactgcaacctccacctcccaggttcaaggaattctcctgcctcagcctcccgagtacctgggattacagacgcgcagcaccacgcccggctaattttttgtatttttagtagagacagggtttcatcatattggtcaggctggtcttgaactcctgacctcaggtgatctgctcaccttggcctcccaaagtgctgggatgacaggcatgagccagtgtgcccaggtattttctacttcttgtaaggccacccatcatattggatcaagggtctaccctaatcatctcatcttcacttaattccatctgcaaagacctatttctaaattaggtctcaattatacatatttggagttaggatgtggacataactcttcagataagagttaatggtggtcgggtgtggtggctcatgcctgtaatcccagcactttgtgaggtcaaggcaggcagatcacttgaggtcaggagtttgattacagcctggccaacatggtgaagccctgtttctactaaaaatacaaaaattagctgggtgtggtggtgcatgcctgtaatcccagctactcgggaggctgaggtgggagaatcattggaacccgggaggcggaggttgccgtgagccaagatagcaccactgcactccagcctgggcaacagagtgacatttgtctctttcaaaaaataaaataaaataatagttaatggcatataagcaataccgtcaaagcctttctttaatatgtgtttttataggaataaaaactctcttgttaattgcacttggtaatatatgcttcctcagctttcttaggtgataatgaggctcaattcttattaagcgcatgaatctgctctgtagcacctaaagtctctaggaagtagctgtcatttctgttgggtggggttgttctggatgtgatctgcttatcttcattattcaaaacagagatcgtggctgggcacggtggctcatgcctgtaatccacgcactttgggaggccgacatgggaggattacctgaggtcaggagttcgagaccagcctggccaacgtggcaaaatcctgtctctactaaaaatacaaaaatcaactggacgtggtggcgggtgcctgtagtcccagctgcttgggagtcgaggcaagagaattgcttgaacccgggaggcggaggttgcagtgagccgagatcacaccactgcactccagcctgggagacagagtgagactccatctgaaaaaaaaaatgagtaaatacaacagagattgctttgatcaacagtatcaaccccaaagtgagctctcagaataacagacaggcggccctccaccagtgctgtacgaggaaggggtgttcctgtgtgtctttggcgagcggtaatgcctgccaagcagctcacattccccaggttccccaacccatgccttgccttgctcagtgagtcgtgtctgcagcaagtgctgctggctgtgccaagactcctcgttccctcctcccttctcccaggccctctcatacagcaggctccgtgtgtggagccccgagtgggcatcagggaaggctggcccccacacacccagcccagcctcaggcctggagttagggaagccagtcatggcagggctgttcttgccagtgggtccaggcaaacccttcagcatggagcccgaggcaggaggcctacacaatcctgcagtgagccctgagctgagaagaagcctgagaaacacgcatgtcttcctctgggtgctgtcatgcatgggtgtgaaaacaggaaatgccccagccagcatacacacgtcacctgcgcacactggcacgcacatgactcacctgtgcacacgagcactcacgcaccttatctgtgcacactggcacgcacctcacctgtgtacacaggcatgcacatctcatgtgtgcccacgggcacaaagacctcatctgtgcccacaggtacacacaactcacctgtgcatatgggcacgcatgcacctcacctgtgcatactggtacacacctcacctgtgcacattggcacacacatctcagctgtacacacaggcacgcacacatgcccttgcttcctcagggcaccatgaaggagaagcagcccctcccggccacaggccctgctctccctgcattcctctcacccgcccttccctgcacagcccggtgcttcttcagctgcccggagaagatgaagtcctggccagcctcgctccttccctcccacaaccggcagggttcacacttcatgcaggatcccatcgaggccgactccctcatcccacacccttcagagcagagaggctcacagacacaggagctcaattcgacaaaacagatgggccaaggtatcctaggaggcccccacggccctcccttcgttacatcctgcccctcgctgtgcagggaaatgcaaactgttaggagctggcagggcctgtgcccctgggctcaccctcctcgtagtcctgagggtactccagggcctgggggtggggagggcgcccaccctgctgtacattacagaggctggccccaaagtctgatgctggcacagccaagcagccagttctttccgagtgtggcattaacgctttgtgatcttagggctgcagagaaattcaaaggcgagtccgactgtgtgctctgactgtgtctgtctccaaattcctacatggaaatcctcatcccccgtgagatggtgttaggaggtgaggcccttgggaggtgatgaggtcacgatgggggagactcaagtatggaatcagtgcctttataaaggggaccccagagagctcccttgccccttccactgcttgatgacacagtgagaaggtgccatgtgtgaaccaggaagcgggttctcgccagacgctggcacactttgatcttggacttccagcctccagaaccgtgagacataaatgtgtgttatttataagccacccaaactatggaatttttctttcttttttttttttttttttgagacggaattttgctgttgttactccggctggagtgcagtggcgtgatcttggctcaccacaacctccgcctcccgggttcaagcgattctcctgcctcagcctcccgagtagctgggattacaggcgtccaccaccacgcctggctaattttgtatttttaatagagatggggtttcaccatgttggtcaggatggtctcgatctcctgacctcgtgatctacctgcctcagcctcccaaagtgctgggatgacaggcgtgagccaccacacccggactgctggattttttcttatatcagcttaaacaaactaagatgattattcccacagaggaatcgtttttatccttaaggcggggttaggaggaattcacaagagagacctgctgatggacagacagtacattgcgtgtcgacaggagtccacaccaatgccacctgcagatgcagtgcctgacattcccatgggggcacaagagaaggtttaaatagatccgttttccttttctatgtctcacctctgtgtttcttgttccttctaaaaaataaagtaacaataccatcgcacattgctaagttgcccaaggacagcaaatggctggggatgtacatatcccacaacacagcgccaggagcacctgtgcccggcagatgcaggcagcaccatttccagagcacatgtgcccagcagatacaggtagcagtgtgcccagagcaccgctacccagcagaagcagggagcaccgtgcccagagcacctctacccagcagactcagggagcaccgtgcccagagcacctgtgtccagcagactcagggagcactgtgcccagagcacctctacccagcagatgcagggagcaccatgcccagagcacctgtgtccagcagactcagggagcactgtgcccagagcacctgtgctcagcagacgcagagagcaccgtgcccagagcacctgtgtccagcagactcagggagcactgtgcccagagcacctgtgctcagcagacgcagagagcacaatgcccagagcaccagtgcccaccagatgcagggagcactgttcccagaggaccatgcccagcagatgcagggagcatcgtgcccagaacatctgtgcccagcagatccagggagcaccatttccagggcacgtgcgcccagtagacacagagagcagtgtgcccagaacacctgtgcccagcagacacagggagtaccgtgcccagagcacctgtgctcagcagacacagggagcaccgtgcccagagcacaatgctcaggagatgcaaggagcaccgttctcagagcacccatgcccagcagatgcagggagcactatgccgggcaccaatgtgcagcaaatgcgggggcactgtgcccagagcacccatgcccagcagactccagggagcaccgtagccagagcacctgtgcccagcagatgcaggaagcaccagtgctcagcagacgcagggagcactgtccccagagcaccagtgtccagcagacacagggagcactgtccccagagcaccagtatccagcagacgcagggagcactgtccccagagcaccagtgctcagcagacgcagggagcactgtccccagagcaccagtgtccagcagacgcagggagcactgtccccagagcaccagtgctcagcagacgcagggagcactgtccccagagcaccagtgctcagcagacgcagggagcactgtccccagagcaccagtgctcagcagacgcagggagcactgtccccagagcaccagtgctcagcagacgcagggagcactgtccccagagcaccagtgctcagcagacgcagggagcactgtccccagagcaccagtgtacagcagacgcagggagcactgtccccagagcaccagtgtccagcagacgcagggagcactgtccccagagcaccagtgtccagcagaagcagggagcactgtccccagagcaccagtgtccagcagatgcagggagcactgtccccagagcaccagtgctcagcagatgcagggagcactgtccccagagcaccagtgtacagcagacgcagggagcactgtacccagagcaccagtgtacagcagacgcagggagcactgtacccagagcaccagtgctcggcagacgcagggagcactgtccccagagcaccagtgtatagcagatgcagggagcattgtccccagagcaccagtgcttggcagacgcagggagcactgtccccagagcaccggtgtccagcagacgcagggagcactgtcctcagagcaccagtgtacagcagacacagggagcaccgtccccagagcaccaatgctcggcggacacagggagcactgtccccagagcaccagtgctcggcagatgcagggagcactgtccccagagcaccagtgtacagcagatgcagggagcactgttcccagagcaccagtgctcggcagacgcaggaagcactgttcccagagcaccagtgtacagcagacgcagggagcactgtccccagagcaccagtgctcggcagacgcagggagcactgtacccagagcaccagtgtacggcagacacagggagcactgtacccagagcaccagtgtacagcagatgcagggagcactgtccccagagcaccagtgcttggcagacgcagggagcactgtccccagagcaccggtgtccagcagacgcagggagcactgtcctcagagcaccggtgtacagcagacacagggagcaccgtccccagagcaccaatgctcggcagacacagggagcactgtccccagagcaccagtgctcggcagatgcagggagcactgtccccagagcaccagtgtacagcagatgcagggagcactgttcccagagcaccagtgctcggcagacgcaggaagcactgttcccagagcaccagtgctcggcagacgcagggagcactgtccccagagcaccagtgctcggcagatgcagggagcactgtccccagagcaccagtgtccggcagatgcagggagcactgtccccaaagcaccagtgctcggcagacgcagggagcactgttcccagagcaccagcgtccagcagatgcagggagcgccacaccgcacagacagagggagatgaataacctttaacccacctgagatgctgttatgattattcacagggtgcacctacctgctctgaaggtcatccatgttcagctcagcgacgtaatgggtggcagaggagacggtgaccaccctcgcactgtggccaggggacccagactctttcagcgtatccaagagaaggttggtcagcaggaagtgccctaggtagttcaggccgaaatgttcttcgaatccatctctggttttcctctgagggaccatcatcaccccagctggacaaaagagaatatcagaaggagttagactggggaagacagtggagaaatctcacagatggattccccagatgcgcaaatggcccaggacatcggagggtggggtgtagagctggcggccatgtcttcctcctgggcctctgtttcctgctttaggtgtgatggagaagattctagaagatcactgaagtcccttcctgccttctgtctctgcacctctgtgccttgagtttaaaaataataaccacaggccgggcgcggtggctcacgcctgtcatcccagcactttgggaggctgaggcgggtggatcacctgaggtcagaagttcatgcctgtcatcccagcactttgggaggccaaggcgggtggatcatctgaggtcaggacttcaagaccagcctgcccaacatggtgaaacccttgtctctagtaaaaatacaaaaattagccaggtttggtggcagggtcctgtagttccagctactcaggaggctgaggcaggagaattgcttgaacctgggaggcggaggttgcagtgagctgagatcatgccactgcactccagcctggtgacagagcgagactccatctcaaaaaaaaaaaaaaggaaaagaaaaataataaccacaatgataacacagcaacacacacaagagagtgagaatcatccaagtcaccaaacagagtcccctggacaattaattattctgggcggctaggtgtgatggctcatacatgtaatcccagcctttgggtaggtgagtagggcagactgcttgacgtcaggagttcgagaccaggctgtgcaccacagtgaaactccatctttaccaaaaatacaaaaaattagtgggtgtggtggtgcgtgcctgtagtcccagctactcggggaggttgaggcgggaggattgtttgagcccaagaggtggaggttgcagtgagccgagattgtgctactgcaccccagcctgggcaacagagatcctgtctccccccagaattctggacaagtatagctgctatggcaccccctcttcactgagtatcccacaaacaaactgctcagatgtcctttgagaaatgccgacctcagtataaacatggcctgtcctcacccctagaccacagggcagccctgtcggtcatcattctatagacatcatcatcaccgcaggttctgtgcttgacatgttctatctaccagacacagaacagcccacccctgtcaggccaagcccggctgagcgcctgccctgaagtccttgctgtggaggcctgatctcaaaggtgacttgtcctagaaacacgcacgaaccatactgccttgtacttagagcagaccagtttgcttggatattaatgccaatgtagatatgtatttgtatgtacatggataatgtagatgtgtatacataggcatgttatatatgtacctggaattctgtatctatctacacgtaacgcaaatacaggcacgtctattcatatacatatatgcatacgcatttgtaaatgtgtttatatagctatacacttgggtatataactgcatgtatgcataattcaaagatatatgcctatagagatatatgttagcatgtacatatgtgttcacgtctttacatgcagattcattttcaaatgcctataaatttgtgcatattttcttttacatatgtgttgtatgcacatgtgcatgagtttgcatgtgtacacatttattcacatgtatatacatgtccatacacatttacatctttgcatgtgtatctgcatacagtgtatgtatatattatatgtttctatttggaattgtacaatcgcaagtatttgcatgtgttcatacacctacaaacacacagcatttgtcattatttgtacattggaacatctacgtgtattgcacgcatgaatatgcattttgattcatctgtggaatcccatagcttttgcatttgtgcacgtttgcatttgcaaatgcatttgaggtgtatgattaatacacacacacacctatccatttgcatatggacacgtttgtgttcaaagatgtatttcaatatggagctatattgatatttgtagatctatttctgtatttgtatatatatgtgtttgcatctgcatgtgtacatatctttctatgcatatgcatttgtatatgtgtttgtgtgtattttatatggagctatctatacatatatgtaggtctagcatttgtctacatatttgtatatgtatatctgcatgtgtacatattttcctatgcatatgcatttgtatatatgcttgtattagtgtgtatgtattttatatctacacacaaatatatagaggtctagcatttctctgtgtatttgtacatgtatacatgcatctgcaagtgcacacattttttatatgtacatgtatttgtatatgtgcttgtatttgtgtgtattttatatggagatatctacacatatataggcctagcatttctctacttatttgtatatgtatacgtgtatctgtacatgaatacattttcctaggtacatgcatttgtttatgtgcttgtatgtgtgtgtgtattttatatgtatgtatttatttattttttgaggaggagtttcgctcttgtcgtccaggctggagtgcaatgaggcagtctcgcctcactgcaacctccgcctcccaggttcaagcaattttcctgccttagcctcccgagtagctgggattacaggcacccaccaccacacgtggctaaatttttctgtattttcagtagagacggggttttgccatgttggccaggctgctctcaaactcctgacctcaggggatccgcccacctcggcctccctaagtgctgggattacaggcgtgagacactgcacccggccgtgtgtgtattttatatggagatatgtatatatctataggtctagcgtttctgtatgtatttgtgtatgtatatgtacatctgcatagcgtacatctttttctatgcatatgcatttgtacacgtgcttgtgtttgtgtgtatcttatatggagctatctatacatatatgtaggtctagcatttctctatgtgtttgtatatgtagaggtgtatccgtaggtgtatacattttttgaggtacatgcatttgtatatgtgcttgcttctgtgtgtactgtaatatctgtatgttatttgtgcctcggtacatggacccatttccctataaatttttgatgcgtgtgcatttgtgtacctgcctgtgtttgtgtacacagtctttccagttgtactttatgaacactcaaaaccaaagctggctcctcgccggctcagcattcccaaagaaccaagcaggagccacgtggccttatcgacccaactttggaactcctacagagttgtcaccactgccccattctaggaattacgagacagttaatgaggacagccgagattcaagagacggagcagggactccagctcccgaagagacaagtgtgaaaagaatttgcaggcctgttttacagcctctccaacccgcctttcaaaactgtggatgcacaggccgcactggatgccccattgcgcggagggcccacagaagactcagcagtgggtcccgcggctctacacgtccctggccccagtggaggcttgacaattgtgaggtccttgaggaaaaaccaacgtcttattctggctgtagcctccacagtgcggttgtagtgctttgggtacagcaagggggaaataaaaaataaacgtggatggagatctgctgcttttgagacgtgaagccacctggacttcctgggtcgagtggagacccggagaccttttgtctagctaaagaattgtaaaggcaccaatcagcactctaaaatggaccattcagcagtctgtaaaatggaccaatcagtgctctgtaaaatggaccaatcaatgctctataaaatggaccaatcagcactctgtaaaatggaccaatcagcactctgtaaaatggaccaatcagcactctgtaaaatggaccagtcagcaggatgtgggcggggccaaataagggaataaaagctggccacctgagccagcttgtgtccccttccacgttgtggaaactttgttgtttcactcttcaccataaatcttgctgctgctcactctttgggtctacactacctgtatgagctgtaagactcactgccaaggtccgcagcttcactcctgaagtcagcgagtctgcgaacccaccagaaggaaaaaactccaggcacatctgaacatctgaaggaacaaactcgggacgcaccatctttaaaagccctaacactcaccgtgagggtctgcggcttcattcttgaagtcagcgagaccaagaacccacaagaaggaataaattctggacacactctcacagagaatggtggcaggggagaggcaccaccatgccattccaggcctgtggcctgctgaaatcctcagggagaaatgagcagactgttcaggtgcagtccttgcttctcacctgcacacactttccagccagactcagtgcttccccctcctacgtgaatatctagctttcaaaaaaacttccaggatacagagaatttattccctgagcttatgcctgtaaaacatcaggagtataaaccaactgggagggatccaatatcaatcagggtccagtatcaatcagtcacaagacacatgtgtattaaacattcaacactcctacagtcctcaaagcccatctaacaaaacacttctgagaagtatgtcagaattcacctcaggagttatccagaaaaaaagcccggcccggtgggtcatgcctgtaatcctcccagcactttcagagggcgaagcgggcagatcagttcaggtcaggagttcgagaccagcttggccaacatggagaaaccttgtctctactaaaaatacaaaattagccgggcgtggtggtgcatgcctgtaatcccagctactcgggaagctgaggcaggagaatcgcttgaacctgggaggcagaggttgcagtgagccgagatcacaccactgcactccagcctgggcgaaagagtgagacaaaacgaaacaaaaaaacatacctgcacctgtctgtttcttgcagcacaactcacaactgcaaacatacggaatcaacctaagttgatttttgtctcaaaaacaaaaaaaaaccaacaacaaaaaaacaaaaacaccagaataggttgctgtgggtggacgggaagctttgcattttgatgaactataaacatctttttcacgatgccattttcctcatattttatttgatgtgaagaatctggagacacacagctcaatccgtgcctgaagtgtcataaattcccagcttaggagagacgagcttatcatgaacacctggcttatgcatgcatggttttgaaaggcagcttcagggggctctaaagcaggcctgcaaattcttttgacactcgtctccttgggagctagagtctacgccccttcccttgaatctcggccatgctcattaactttctcgttaattcttttgtagaatgccacagtggtgtaaacactgtgtgacttccaaagttgggtcaataaggtcacgtggcccctgcttggttcttgggaatgctgagtctgggaggagccagctttggtttaaaaagactgagcaccttcagcctgacatgctggagaggccccaggtacctgttcttgttggccctcccagctaagcccaggtgacaggctgtaccagcttcttgacaccagagaaagctatcctggacatccaacctggtcaagccttcagataaagtcagccccagctgcagccccacaggagaccccccaggcagaactgcctacattcctgtgccccgaaagaaagtgaattcatacaagctgtatagaaaacagcacggatgttcctctcaaagaactaaaagcagatcatttgttcgatccagcaatcccactcctgggtatctacccaaaggaaaagaagtccttatatcaaaaagacacctgcaggccaggcatggtggctcacgcctgtcatcccagcactttgggagaccaaggcgggcagatcacctgaggtcaggagttcgagagcagcctgggcaacatggagaaaccccagaattgcttgaacccaggaggtggaggttgcagtgagccgagatcgcaccactgcactccagcctgggtgacagagcaagactccatctcaaaaataaataaatcaataaaataaaataatcaaacaaaacaatacaaaacaaaatacctgcacctgtctgtttcttgcagcacaactcacaattgcaaacatacggaatcaacctaagtacccctccgtggagtactggataaagaaaatggaatggaatactactaagccattaaaaagagtggaatcgtgtcattggcagtaacttggatagaactggaggttattattctacgtggagtcactcaagaacagaaaagcaaatacacgttctcacttgtaagtgggcactaagctctgggtatgcttctggcattgaaggggcatacggaatagaggaatacacattagagactgagggtggggctgtgagtgaacctgtcacccaggaaatggccactgtacccaacaggtggtttttcatcccctgcctccctccccctaccttctagcagtcaagagtttctgctcttcccatctttgtgtccatgagtacccgctgtgtaccttccaggtgtaagtcagaacatgcagtatttggttttctgtttctgtgctggttctcttaggataatggcttgcagctctgagcaaattcttggtgacaacagcatcgttggggaaggtatcttttgcaagagcagaggggacagtgcttctgtgcaggcaggtggtgacctgtgctccagatgaatccgagccgtgctagggactcgcctggcggggaagctgcgtgagaattcctgcgccgtggtgaatgcagcagccacgcgcaggggccctggatgctgataattcatcgttagtgagctactgcgagtaattacgtttattcctattttattattattattattactttgaggtaaactcttgctgtgtcacccagactggagtgcagtgttgtgatgtcggctcactgcaacctctgcctcctgggttcaagcgattctcctgcctcagcctcccgagtacatgggattacaggcacctgccccgatggccagctattttttgtatttttagtagagacggggtttcaccatgttggccaggctgctcttgaactcctaatctcaactgatcctcccgccttggcctcccaaagtgctgggactacaggtgtgagccactgcacccagccctactaatattattatttttttggagacagagtctcgctctgtcaaccaagctggagtgcagtgtgtccgtattttattttttatttcattttttttgagatggagtctcactctgttgcccaggctggattgcagtgggttgaactcggctcactgcaacctccgcctcccgggttgaagtgattcttctgcctcagcctcccaagtagctgggattacaggtgtgcaccacaacacccggctaaactttttttttttttttttgtatttttagtagagatggggttttgtcatgttgaccagtctggtctcgaactcctgaccccaagtgatctgcccgcctcagcctcccaaagtgctgggatcccaggtgtgagccaccgcgcccggccacgcacccgtattttaaaccacagtgtcacggagacgtttctaggcagcaaacccacctgaaacgctgatatttacggaacgaaagcctgacatattctgaaggagaaattgttttgttgttgagttctttgccagtggctttaggtattaattttcctcttcctatgtaagcagagcattgaaagaccagattggtgccaggtagagagattggatgggtgcctgagatgcctgttaggaggccattatcatggcctaggaagagatgatggtaccccagaggagggattgacggaagtccgaaatgcagaattgagtactagttagacaatcgacggcaaattcaaatgcctgtaggcttttgtatgtgttttaaattttccataatcatgtttttttcggcatcagtaaaattctatttatttatttttgtcaagttattattttcttttaaatcaaaggaaagtataaaaaaggtgcacagggctgggcacggtgactcacacctgtaatcccagcactctgggaggccgaggcaggcggatgacctgaggtcaggagtttgagaccagcctggccaacttggtgaaaccccgtctctactaaaaatacaaaaaaaaaaaaaaaattagctgagtgtggtggcgggcacctgtaatttcagctgcttgggaggctgaggcaggagaatttctggaactcaggaggcagaggttgcagtgagctgatatcgtgcactgcactccagccccggccgacaacagcgagactatgtttcaaaacaaaaaaaaaaaaggtgcagagatcatgagggaaatctcaatggaatcatccaaagcgagcactctcccctctcaggtaaccgcctcccacatctgcacccctaagcccttttttgatccaaaattaattatcacattcttctaaggtaactacaattccaatttccattaccatagatttaatttgcctgtttttttctgggaggcggagattgcagtgagaagaggttgtgccactgcactccagcctgggcgacagagcaaggctctgtctcaaaaaaggaaataaataaataaaataaaataataatttgcctttttttaaaaattttaatttaattttatttttgagatggagtctcactctgtcgctaggctggagtgcagtggcacaatctcggcccactgcagcctctgcctcccgggttccagaaattctcctgcctcaggctcctgagtagctgggattacaggtgtatgctactatgcccagctaatttctgtatttttagtagagacgggatttcaccgtgttggccaggatggtctcgaactcctgacctcgtgatccatccacgtcggcctcccaaagtgctgggattacaggcgtgggccatcgcgcccggcctgtttcttaaaatttcaataatttttgggaaaccagtggttttgggctacatggatacattcttttgtggtgacttctgagattttgttgcacaagttttaatcatcagcaaatatactgatgtttcattgcgaattttgtaaggaataagaaaaccctgtggccacgtcagtgtatcgggtgccgtccacgttaggagcattcacggaatctgtctcttcgccaattcaaaggtggagaatacacaatagaactatcgttcattgatctgcgaatcgaaaggtggaaaatacagaataaaactatcgtccatcgatctgccaattcaaaggtggaaaataaacagtaaaattatcgtccattgatctgccaattcaaaggtggaaaatacgcaatacaattatcgttcattggtctgtgcacctaatggcattttactggggagtgaacgctcagggtcacaatcacatattgtgcctgaagcagtgaacacaggtgaggtgtatcctgaacgggaggagaagggagagttctccgctctccaagcggagaactccagagaaaggagagtgatggggatgaaagggcaatcagagagagagagaggagagagagagggagggcaaagaaggaagagagaaggagagggaggaaatagggagaaagagagacaaagagagatggagagggaacagggagagagagggagggcaaacgagagggagagagaaggaggggaggaaataggggaaagagagaaagagagatggagagggaacagggagagagagggagggcaaacgagagagggagagagaaggaagaggaggaaatgggggaagagagagaaagagagatggagagggaacagggagagagagggagggcaaacgagagggagagaggaggagagggaggaaatagggggaaagagagaaagagagatggagagggaacagggagagagagggagggcaaacgagagagggagagagaaggaagaggaggaaataggggaaagagagaaagagagatggagagggaacagggagagagagggagggcaaacgagagagggagagagaaggaagaggaggaaatgggggaaagagagaaagagagatggagagggaacagggagagagagggagggcaaacgagagagggagagagaaggaagaggaggaaatgggggaaagaaagagaaagagagatggagagggaacagggagagagagggagggcaaacgagagggagagagaaggaggggaggaaataggggaaagagagagaaagagagatggagagggaacagggagagagagggagggcaaacgagagagggagagagaaggaagaggaggaaatgggggaaagagagagaaagagagatggagagggaacagggagagagagggagggcaaacgagagggagagagaaggaggaggaggaaatgggggaaagagagagaaagagagatggagagggaacagggagagagagggagggcaaacgagagggagagagaaggaggaggaggaaatgggggaaagagagagaaagagagatggagagggaacagggagagagagggagggcaaacgagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacagggagagagagggagggcaaacgagagggagagagaaggaggaggaggaaatgggggaaagagagagaaagagagatggagagggaacggggagagagagggagggcaaacgagagggagagagaaggaagaggaggaaatgggggaaagagagagagagatggagagggaacggggagagagagggagggcaaacgagagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacggggagagagagggagggcaaacgagagggagagagaaggaagaggaggaaatgggggaaagagagagagagatggagagggaacggggagagagagggagggcaaacgagagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacggggagagagagggagggcaaacgagagagggagagagaaggaagaggaggaaatgggggaaagagagagaaagagagatggagagggaacagggagagagagggagggcaaacgagagggagagagaaggaggaggaggaaatgggggaaagagagagaaagagagatggagagggaacagggagagagagggagggcaaacgagagggagagagaaggaggaggaggaaatgggggaaagagagagaaagagagatggagagggaacagggagagagagggagggcaaacgagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacagggagagagagggagggcaaacgagagggagagagaaggaggaggaggaaatgggggaaagagagagaaagagagatggagagggaacagggagagagagggagggcaaacgagagggagagagaaggaggaggaggaaatgggggaaagagagagaaagagagatggagagggaacggggagagagagggagggcaaacgagagggagagagaaggaagaggaggaaatgggggaaagagagagagagatggagagggaacggggagagagagggagggcaaacgagagggagagagaaggaagaggaggaaatgggggaaagagagagagagatggagagggaacggggagagagagggagggcaaacgagagagggagagagaaggaagaggaggaaatgggggaaagagagagaaagagagatggagagggaacagggagagagagggagggcaaacgagagggagagagaaggaagaggaggaaatgggggaaagagagagagagatggagagggaacggggagagagagggagggcaaacgagagggagagagaaggaagaggaggaaatgggggagagagaaagagagatggagagggaacggggagagagagggagggcaaacgagagggagagagaaggaagaggaggaaatgggggaaagagagagagagatggagagggaacggggagagagagggagggcaaacgagagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacggggagagagagggagggcaaacgagagagggagagagaaggaagaggaggaaatgggggaaagagagagaaagagagatggagagggaacagggagagagagggagggcaaacgagagggagagagaaggaggaggaggaaatgggggaaagagagagaaagagagatggagagggaacagggagagagagggagggcaaacgagagggagagagaaggaggaggaggaaatgggggaaagagagagaaagagagatggagagggaacagggagagagagggagggcaaacgagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacagggagagagagggagggcaaacgagagggagagagaaggaggaggaggaaatgggggaaagagagagaaagagagatggagagggaacagggagagagagggagggcaaacgagagggagagagaaggaggaggaggaaatgggggaaagagagagaaagagagatggagagggaacggggagagagagggagggcaaacgagagggagagagaaggaagaggaggaaatgggggaaagagagagagagatggagagggaacggggagagagagggagggcaaacgagagggagagagaaggaagaggaggaaatgggggaaagagagagagagatggagagggaacggggagagagagggagggcaaacgagagagggagagagaaggaagaggaggaaatgggggaaagagagagaaagagagatggagagggaacagggagagagagggagggcaaacgagagggagagagaaggaagaggaggaaatgggggaaagagagagagagatggagagggaacggggagagagagggagggcaaacgagagggagagagaaggaagaggaggaaatgggggaaagagagagagagatggagagggaacggggagagagagggagggcaaacgagagagggagagagaaggaagaggaggaaatgggggaaagagagagaaagagagatggagagggaacagggagagagagggagggcaaacgagagggagagagaaggaagaggaggaaatgggggaaagagagagagagatggagagggaacggggagagagagggagggcaaacgagagggagagagaaggaagaggaggaaatgggggaaagagagagagagatggagagggaacggggagagagagggagggcaaacgagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacggggagagagagggagggcaaacgagagagggagagagaaggaggagagggaggaaataggggaaagagagagaaagagagatggagagggaacggggagagagagggagggcaaacgagagggagagagaaggaagaggaggaaatgggggaaagagagagagagatggagagggaacggggagagagagggagggcaaacgagagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacggggagagagagggagggcaaacgagagggagagagaaggaagaggaggaaatgggggaaagagagagaaagagagatggagagggaacggggagagagagggagggcaaacgagagggagagagaaggaagaggaggaaatgggggaaagagagagagagatggagagggaacagggagagagagggagggcaaacgagaaaggaagagagaaggagagggaggaaataaggggagagacagagaaagagacagagagaaagagagaaagggggagagaaggaaggcaaaggagagaggaggagagatgggggaaggaggaaagagagagaagtgggacacagaggaagacaaaggagatagagagacaaggggagagacaggaagagaaaggagatagggagaagagggagggtgtgcgagagggaaacagaaagggagagagagaagaaagaggggagagagaagaaagaggggagggagagaagaagggaaagggagggagagagggagagagagaatgggagaaaaggagagagagaagaggggagaaagagggagagagggaaggaaggagagagggagggagggagagggagaatgggagagagagaagaggggagaaagcgagggagggagggggagagagagaagaaagagagaagagagaaagagagagagggagagagagggagaaagggagagagagaagggagaaggggagagagagggggagagagggagggaggagggagaagggaggtcgagagcaaaatagtagaagcggggatggggtagactgaggagagagagagacagagagaaaaagcaaaagagaggaaaagtgagacagtgaagaggtggaaagagagaatgacagagagacggggagaaggaggagagagagacagagagttacagaaagagagagagagaggagaaaagcatttgagtaactgaaaaaccactgcttctcaacccacttcctagaatctcgggagggcggtgggaaggatggagccagtccagggaggctatgggacggacgccctgaacatctagccttctctggcagggaacagcctgccgcagagtcacaacagaccacatcccatgctgctgccaacaccaacactaaaagaacatccaaatgcctcctgttcagagaaggcgccatcgggagaggcagaggaaaccactacggaacagaaagctactctatccacaggagagcagctctggaagagaagcaaacagaaggcacgcagaataaatggtctacacctgtgcagactcaaggatccgctgacgaatgcatgcgccgcgatgcaacactttccgtcttcccgggagggagaccagatgactgtggagcccgagtcacatagaaaatgccaggcgcccacaaagacaggagatggctgctcaggtgtccgtccaccaaaaagtgggtcctcagtaaggaccggctccactgcacctcagtcttctgttgatgcagaactgcacacctgggcttccccgaatgaatcttccttaactctcatgggtcttgtaggtgccctgtgcccatttgctcatttgaatgaactcattagaattcattcattcatttgattccattcattcatttgcatcatttgaattcattccttcttttgaattcacttgttcctttgaattcattcattcacttgaatttattcatttaaattcactcatttgaattcattcattcattcctttgaattcgttcattcctttgaattcactcattcctttgaattcactcattcctttgaattcactcattcctttgaattcactcattcctttgaattcactcattcctttgaattcattcattcattcctctgaatttattcattcctttgaattcattcgttcctttgacttcatttgttcattcatttgaattcattccttcatttgaatttattcattcccttgaattcattcagattcactcatttgaattcattcattcattcctttgaattcattcctttgaattcatacattcctttcaattcatttagtcctttgaattcattcgttcctttgaattcatttgttcattcattagaattcattcattccttagaattaattcatttgaattcatttgttcattcctttgaattcatttgcattcattcattcctctgaattcattcattcatttgaattctttcattcattcattcactcatttgaattcattcaagtgaatgaatgaatttgaatgaatgaatgaatgaatgaatgaatgggtgaatgaagaactgtaccaaaaaacagagtctttaggtctctggccagggaagaatcattgttatttttcagggtcaccctgtatcgtggacgtatttctttggtggtaggaaaaataatgcttagtaattcattatctcagaaagaaattcatccattagagttatgggaagatggctgacaaggataaatctataaatcctctgcattattaaaaatctatcaattttcagacatggggatgggaagctagataaatacaattttgaagtgaataaaccataaataccggctctgcaggaggtctattattgatttattcttgtgcttgataaatcatcgcgttgcctctgagcttcccacagcagccagacagaggcagtcaggttctattttcaacccactagcaaatgaaaaagatattctatgtctgaagtatttaatgtttgcaaaaccttgattgctctaagaataaaaaaagaaaagcacgaagtgtagctccttcttgccttggaagtcaccctggctgagctcagctggggctgttttccatgagacttgaggcacgtggttgactagcaggagttttggagggaaggttctggggaaatagtttagggcagcagtctccaacctttttggcaccagggaccacttttgtgaaagacaattttctgaagacagaaggtggaggtggaatgtggggatggttttgggatgattccggggcatgacatttattgtacactttatttgtattattattacattgtactatataatgaaataattctacaagtcgccatcatatagaatcagtgggagccctgagcttgttttcctgtgactagacagtcccatctgggggtgatgggagacagtgacagatcatcaggaattagattccataaggagcacacaacctagatccttcccatgcacagatcatcaggctttagcttttcataaggagtgcacaacctaagtccctcacatgcacagttcacagtagggtttgtgctcctataagaatctaatgctgctgctgatctgacaggaggcagagctcaggcagtcatgtgaacaatggggagtggctgtaaatacagatgaagctttgcttgttcacttgccactcaccttctgctgtgcggccggtgtcctaacaggccatggactggtactatgacctgggggttggacagccctggtttaggggtctgcagaccccctactagcctcttagacactaaaagtaccaccactggagtccttccctgaggctgcctataaatagaaactctatttacataagttgacaccagcaatatcccaaacatacaatccagcaatctcatttgcacacaacgaagaagaattctgatgcacaaaccaacgagaaaaatccttgatttcttctctaagtcaaggtacatctggcccaagcttcagcacaccagctggtgatgaacccattctcagcgttgactgtatagaatccagccttctcatttgcacacaacgaagatgaattctgatgcataaaccaaggcatgcaacaaatgagaaaaatcctttacttcttctctaaatcaacgtacatctggctcaagcctccagcacaagagctggtgatgaatccattctcaacgctgactgtgtagaatccagccttctcatttgcacaccacgaagatgaattctgatgcacaaactaaggcatgcaataaatgagaaaaatactttgcttcttccctaaatccaggtacatcagacccaggcctccagcacacgggcttgtgctgaatccattctcagtgctgactgtatagaatccagcctcgtcatttgcacaccatgaagatgaattctgatgcacaaaccaaggcaaaaaatgctttacttcctctctaaatcaaggttcatctggcccaagcctccagcacacaggctggtgatgaatccattctcagcatagactgtgccatctgggctacttctggcttgaggagcacttatccctgcagctttccatccaccctgggtacctcgggaggcccctttccaagcccatgggcttcacgaagctccatggttctgttgcatttccaagagaaccaagaggatttgtcaacaagagactgcctctctgcatttctgtcttcttgtgaagagtgggcaatgggtattcaacacagcctccaaaagcgaagtctccagctcttttctagaagcttctgtctgtacccacagaggaaaaaaaaaaaaatccagatcctctgcaactgagctcttctcaacagtgaccccagggacaagatgaaccttagtcagccacaaaaacctatagggagtccaggaaagccacagcctgagcaacctcttgaaagatgtagaacaaaaagataaaaggaagaaagtgcaaagtgttatttcaagccatcatcttgtaacaaatggattctcattatcacctcctggaaatggtgttctgagcagcacaggctggggaattccagggaggcgtgtgacttggggtgcaatcttctctgtactttacaagactgtgttgtcacattgcaagaggtgtgttttctaaggcagaacatttcacagaatgattattggtccaatgtttgtttccgttgctaaagtatgatttctatgaggtcaagaatcttgcttattattttatttttcctgcaagcgaagtatgtgaagggcagagtaggtaggtatggcaggttaaataatgcacaactcaagatgtccaggtccacattattcatgtgggagacagaatcatgaccccaaaaatgcccacactgtaatccccatgtgggagacacaataatggccccaaagatgtccacatcctaatcctcaggtggaagacagaataatggccccaaaaatgtccacatcctaatcctcatgtggaagacagaataatgacccaaagatgtccacatcccaatcctcatgtggaagacaaaataatggccctgaagatgtccacatcctaatccccatgtggtagacagaataatggccccaaagatgtccacatcccaatccccatgtggtacacagaataatggccccgaagatgtccatatccgaatccccatgtgggagacagaataatggccccgaagatgtccatatccaaatccccatgtggaagacagaataatggccccaaagatgtccacatcctaatccccatgtggaagccgaacaatggccccaaagatgtccatatgttaattcccatgtggtagatagaataatagccccaaagatgttcacattctaatcctcatgtgggaaacagaataatggccccaaagatgtccacatcctaatcctcatgtggaagactgaataatggctctaaagatgtccacagactaattctcatgtggtcgacacaataatgaccccagagatgcccacaacctattcccaatttggaagagtaataactcaaaagatgaaaaaatgtccatgtcctcatctctggaacacatgaaaatgtgactttcacggcaaaagggcctttgtagatgtgaattagtggaagatcttgagatgaggtgattatctgagatgatcctggtgggccccaaataatcacaatggttcttctacaaggcaggcagaagaacaaaagtaagtgaaggagataaaaaaaaagagaaggcaagatgagagagagaaagagagagaagggaagagagggagagagagagaacaagaaagagagattcaaaggtgtctcattgctggctttgttgttgtttttgttgttttgagatggagttttgctcttgttgcccagactggagtgcagtggtgtgatctcagcttactgcaacctctgcctcccgggttcaagcaattctcctgcctcagcctcccgagtagctgggattacaggcatgcgccaccatgcccagctaattttgtatttttagtagagacagggtttcacaatgttgtccacgttggtctcgaactcctgacctcacgtaatccacctgcctcggcctcccaaagtgctgaggttacaggcgtgagccactatcattgctggctttaaggccgggttggaggccatgggtgaagaaacgctgacagtcttctaaaaactggggaaggaaatactctcctctagaaccagtgtcagccatagactcaggaatttcacactggacttactggcttgaggtgcctctgaggcattgagcgaaggtaaaaggtcttagcatggaagaaaggtctagataagtctaggaagaagtaaacccaatatgtgcatgagattttctacagaagagatagggtacagagacaatccaacaacaagacccttttgattcaaattcaaccctgtcccagtttccagaatatttttgtttgtttctgagagccctgtgtgccttgtttaaaatctgttgagaaaaggaacagaggagaatcctaggaatgcaatagccatttcaaaaggtaaacgtggtggttgagtgatggagtatacgctggttagcctgtgtcaactggtgttagcctgtatccactgtcacagatgtggttcatatacacattgctcagtaaaattctgctccccccagaacacagtaagattctgctggagaaacatatcatatctgacattcctaatttttttttttttttgaaacagtcttgctctgttgctcaggctggagtgcaatggtgtggtctcggctcactgcagcctccacctcccaggttcaagcgattctcctgcctcagcctcctgagtagctgggactacagatgcccgccaccacgcctggctaatatttgtatttttagtagagacagggtttcaccatattggtcaggctggtctggaacccctgacctcaggtgatccactcacctcagcctcccaaagtgttgggattacaggggtgagccaccgcgcccggcctgagattcctaattttttctgcttactggtggatgcaagcccataccaaatggatggaagtagtcgcacaaaagtcctaagaggatggacagttctgttttgtgtgtctctgtgcaagggcaccatgtcatgtatgtatttccatctccaactgctctgtgataaagtgctcccattactaatgagtaagggtgttacacagaacgaggaaatgagacgtcgggtcgtgtaggatctccacagtgcctctaagtggtctccacatttggtgacttataatgctataattctaatcacttctaatactgataggtcttcagcaaaggaagtccacacccagtgctgagacagaagattccaaatggctgctgactgggaaatcatttatgcctgcgtagaaacttcagatcccaccaggatggcaaatctgaaaagtgttattgatctccaaagaagacacacaaagttaaaatcattccggaccttccaacaggagccactagcactgataatacgatgtttcttaccaggctaagtacatggaaatggtgttgtctgtagctatttgagtggcactcacacatcatagctatgtctgcacgtatttttatgcataaatacatatacatcatacatcaaatacatatacaaatacatatgcactcacacatagctatgtctgtacaaatttttatgcataaattggcatcacactctatgtatagttttatatcccatgcttctcctttaaactctagcataataatttccaattaaacaagtgggttgagggggaaccgtgggtatctcatccactttcctatcctccaatcccattaatgttatacaaaaacacgaaacacatcaagacaaaaagaaaaaaaaattagatagaagctaccacatcttggcagctggaaacagacaggtattacaactttagtacaaagaataatgctttctccctccttacagacatgtccatatcctaatctccagaatttatgaaaatggtacgttaggtagcacaaggggttttgcagaattaagaatctttaatggtctaggtgggtaatggagtaattacattgggtaatcacaagatccttttgctgatttttttgtctgcaatctgaagtgtcaataacttgataaatatttcatgtatttgaaaggaatgtgctgtctttatgggctcactgtttgacgtacgtctgttctatccactgtattaatgtcactatttatttcctctctgaatttgcatttggtctccatctgtgaaagtgatgcgttaaattctactagcacacatgtttgttggtgtatttctgagacctttagttctatgtatttacttagtttggagatgtcaataactgtacctcctcagtgtggagggttcaggttaacttttataaaaaataaaatggactgcagcaggggatgagagtaatgggcatcagtgttacgaggagaaacattaagtgttgcaatgatcttaagcgctcagcgtggcccaaagaagggctcaaggtcaacagtaagcgttgcaatgaccttaagcactcagcgaggctcaaagaagggctcaaggtcaagggtagtttgtgttgaagattggcagatgggcagattgaaggtggggaaggggagatattgactccacctatctgggtgagaatgttgaacagggggtaaaatcaagagataaatggtaatgagcttctagtgcccaaataatgactctcaggggaatgtggtgatggttttgtaagataacatttgggaaaacaccaacccttagcatgtgcctcataccctttagtccaagtggacaagtcaacgtgtcaactccatacaacatgttatcgcgtttaccattatttcaaagtaacatgctaacaagaatgatgctcttccaaagctatccgtgaaatgaagcactgactagaaatagcaggtatgttcaataattcccatggatatcctgttttgctgagacacttctcccgcatgaaagctagagttcctgtttgcattcaaattaacccctggcttgctgcaatttcaccaggactcaccattgttgatcaggacatggagaggaatcttcttcatcttgaacttctgcacaaactgccggatggaagtcatggaagccaagtcacagtataaaaattccactggaaaaggacaacaacaaaaaatacctggttatctcccaacctatttcagagattaagaaaatttctaaacaggtcaaactcaatttcatctaggaagtaacactttttttttttctgctctttttgagatggagtctcgctctgttgaccgggctggagtgctgtggcaggatctcagctcactgcagcctctgcttcctgggttccagtgattctcctgcctcagcctcccaggtagctgggattacaggcacatgccaccaggcccagctaatttttgtatttttgtatttttttttttttttttttttttagtagagacaatgtttcaccatgttggccaggctggtctcaaactcttgacctcaggtgatccgcccgcctcagcctcccaaagtgctgggattacaggcgtgagccaccacgcctgtccaggaagtaacactgaattggacatgtcagtagggtacaatgaggagctcatactctagggagatcaatgagtcccatccttgtatagtcccctttccttgagtctgtgtgggacctgtcattctcctcctgaccttgatgtgagctgatgttttgtgagagcgccttggggccagaacctgggcatggcctctctaggagctgacagcagcccctggccaaaagccagcaagatactcagatccccagatctgcagcttccaggaattggattctgcgtataaccatgtgaatttcgaagatcctgagctccagagaggacctcaggccagatgacactttggttatagcccagtgagaccccgaagagagaatgcagttacacctgcccagattcctgacccgcagcagctgtgggatagtaagtatgagcccttccacgctgctgagtctgtgggttattttgttacacagcatatgtaactgatacacaaaatgactcagaagcaaggacttccttcttctgcagtagaggaatatagaatatagaattttatataataatcaaacaggaagcaatttatgcatcccctgctacagatagtaagaagtacgagcccttccacgttgctgaatctgtgttattttgttacagggcatatgtaactaatacacaaaatggctcagaagcaaggacttccttcttccacaggagaatatagaattttatataataataaaaaaggacgccatttatggatcccttgctacagatagtaagtatgagctcttccacgctgctcagtctgttattttgttacacagtatatgtaactaatacacaaaatgactcagaagcaaggacttccttcttctgcagaagaataataaaagaaagcattttattttttattacatttatgtttttggagacagggtctcactatgtccccatggctggtctcgaactcctaagctcaagtgagcctcccacatcagcctcccaaagtgttggattacaggcgtgagcagctgtgtccagccaaagatgacatttttagagagtgaatgactcagggacagctttataacatcacataggtagagaggtagacttatgtctattgtattcagtatatcaacttcactctttctctctaaattcccagtgggtctccatcgctaaaagtgatgtgtttgattgtgttaaagctgttttttttttttttttcccagaaggactgaggttttggagggagaggaactagaaagaaaagcaaattcacaggtatataattctgcctccaggtccatgggttcaaggaggttgggagaacaatgcaacaacctaaagtcagacagaacaaaatgcatgaaaactagctattacttgcagcagagacagcagatctctgagggaagaagcaagttcccttacattgagatgggaaggtaatttctggagagaggtggaaggtattgggggacactgccagtgagttctgaaaggtgaggatggggaatggtgtgaggtggaagagcaaatcacagcatgtgtgcagaggtcagagacaggagtcctcagggagggagcgagcagaggctggttctgggctggccgagaagagaacagccttgatctgcagggctgctggtggtcagtgtcatttacagcctcctcactggggagcctcataggggaaaatcattactgtaaaagaactgttaatatttttatgaaggccacatagctttcagaggataagcagtgtgtgtgtgtggtggggggaggggtctgcctgtgccccccatgtctgcactgatgtgtaaaatgccagcaatcaattttatgacagacacaccttgcttaataagctctatgagccttactctccaaaactattactggaatgctcatcatcattccaaaacgaaatgactctccactcaccatcagagagagagaagagacagagatggagtgtaagaatgagaaagagagagatagaaagatagaagcagagagagagagaaagagagaaagaaagaaaggctaagagagaaagagaaaaaaggagggggaggaaaaggggaagagagaaaaaacacacagagataaagacaaagagacacagtgagagagagaaacagaaagagagagagggacgggagacagtaaaagggacaaagagagaaaggcagacagagagatacaaagaaagaggccgggcacgatggctcatgcctgtaatcccagcactttaggaggcgaaggcaggcagatcacgtgaggtcaggactttgagaccagcttggctaacatgttgaaacctcgtctctactaaaaatacaaaaattagccagctgtggtggtgcacacctgtaatctcagcactttggaaggtgggcagaggtcaggagttcgagaccagcctggccattgtggtcaaactccatctctactaaaaatacaaaaattaggcgactgtggtggtgcacgcctgtaatcccagctacttgggaggctaaggcaggagaatcgcatgaacctgggaggtggaggttgcagtaagccgaggtcgcgccactgcactccagcctgggtgacagagcaagactctgtctcaaaaaaaaaaaaagagacagaaagaggcaaagagagagagcgtgacaaacactgagagacagagagaaatagagaaaagaagacaaagagagagacagagaaagagagagagagagaggaaaaagagagggagagagagagaggaaaaagagagggagagagagagggagaaagacaaagagagcagacagaaaaagaaagagaatgaaatgagagaaagtgtgtgttagtttcatattccttactgtataaggagaagaaaaggaaatggagaggatttggagaaataggaacatttttacaccgttggtaggagtgtaaattagttcaaccattgtggaagacagtgtggcgattcctcaaggatctagaaccagaaataccatttgacccatcaatcccgttactgggtatataccaaaggtttataaatcattctactataaagacacatgcacacatacgtttattgcggaactattaacaatagcaaaaacttgaaaccaacccaaatgcccatcaatgatagactggataaagaaaatgtggcacatagacaccatggaatactatgcagccataaaaaaaggatgagttcatgtcctttgcagggacatggatgaagctggaaaccatcattctcagcaaactatcacaggaacagaaaaccaaacactgcatgttctcactcatcagtggaagttgaacaatgagaacacatggacacagggaggggaacatcacacaccagggcttgctggggggtggagggttagggaagggatagctttaggacaaatacctaatgtagatgacgggtcgatgggtgcagcaaaccaccatggcacgtgtatacctatgtaacaaacttgcacgttctgtacatgtatccagaacttaaagtataataataccaaaaaaacaagaagaaaaggaaatggtatctggattactttgacaggacataactttctaaaacacgtcattctggataaaatattaccaggctgttaggacacgctgctgagtctgtgttattttgttacacggcatgtgtaactaatacacaaaatgactcagaagcaaggacttccttcttctgcagtagaataataaaagagggctagcacttgcttgtattgacggcttgtattttcacgcggttccggcatgtggcaataccgaagcacaaagctggggcgcatacgcacatttattttctcatcgaagaccataaatagttcccttcctcccatacgtagcccattctcttgactttccttttctgggatggactgtggggttctcgccgagagatgcttgtgtgcctcacttggggatcgtaaacgcaaatgtgtcacctccttcaggaagttttcctgaaccccaagccacgccgggcatctctagatctggcttccgcaatcgcaacgacagtacccatcattgcacctcctcacttgcatgaccagtatgtttttaagcatgtctcatatgccttggatgctacgtaactttggaacatacattgaaatgatgcatctttgagtgtccagagctaggctctctgggcacacccagaaaaaagtcagcggaagaggtaaagggaagatgtatgggagcttgggccacgtcctctgctggcgctctgccgcatgccagcttctgccccagagggaggggagggaaggagagggaaaaagagaaaagaagaaaaggggagaaaggtgaagtgaaaaatatcagcatgaagcaaaaatgtgtcctcagacaaaaaggaaatgcatagacccgaggcagacaggaataggacccaggcagataggaataggacccaggcagatagacccaggcagacaggaataggacccaggcagatagaccccaggcagataggaataggacccaggcagataggaataggacccaggcagatagaccccaggcagataggaataggacccaggcagataggaataggacccaggcagatagaccccaggcagataggaataggacccaggcagataggaataggacccaggcagatagaccccaggcagacaggaataggacccaggcagataggaataggacccaggcagatagaccccaggcagataggaataggacccaggcagataggaataggacccaggcagataggaataggacccaggcagatagaccccaggcagacaggaataggacccaggcagataggaataggacccaggcagatagaccccaggcagataggaataggacccaggcagataggaataggacccaggcagatagaccccaggcagacaggaataggacccaggcagataggaataggacccaggcagatagacccaggcagataggaataggacccaggcaggcactgcaagctgtgagcatcatcttgggaatatgcaaatgtttgtgctgaattactttcctttttaaaattatttatgcatttattgagacagggtctcgttctgtcacccaggctggagtgcaaaggtgtgatctgggctcactgcagcctccacctcccgaattcaagcgattctccctccttagcctcctgagtagctgggaccacaggtgcgcagcaccacgcctggctactttttgtagttgttgtagagatcggattttgcaatattgcccaagctggactcgaactcctgggctcaagcgatccgcccgccttggcctctcaaagtgctgggattaccgtcgtgagccaccttgcctggccatcctttcctaaggtagtaagaatgtggtaggctaaatgacggtatcctccactccgtccctaaaaatctcctggtcctaatctctagaacctgtgaaaagattaccttgtatgaaaatagggtgtttagacattaaaggttttcaaatgaggaaattatcctgtattagcctaaatataatgacaaagatttttgttttttgtttgttagcttttatagagacaggggtctctctatgttgccaaggtaggtctcaaactcctggccttgttatcatactgctgcccaaaatgctaggatgacaggagtgcggagttttttttgttttgtctttttgagttttttttttttgacaaagtcttgctctgtcacccaggctggaatacagcggacagatcttggctgactgcaacctccacttcccgagttcaagtgatcctcccttcctcagtctcccaagtagctgggattacaggcacccgccaccacgcccggcttatttttgtatttttagtaaagatggggtttcaccatgttggccgggctggtctcaaactcctgacctcaggtgatctgcccgcctcggcctcccaaagtgctgggatgacaggcatgagctaccacgcctagcctggggtttttataaggaggaggaacaggcatgcttgagacagatgagagaaaatgatgatgtgaagacagaggcagagactggagtgatacagccacaagccgtgggatgcctggagcccccaggagctgggggaggccaaaaggatcctcccctagagcgtctggatggagctcagccctgagacaccttggatttaaagtcttgtcctccagacctgggagaggatatatttctattgtgcaagttccccagttttggtgttttttttttttttgttagttcaatatgattttattcaaaaatgtatacagctgaaggagggatctggtcttttgttaaaaaaaaaaaaaacaattttcacagtatatatttggccattttagctctgtagtgaacaacaccagaaaaggaagtttctgttcaagatcctgactccagcacactcagccaggttgcttggcaagatgacacatttcctggtctgaagcacacagcccatcctctcacctaagtggaacagcagttctcctgcaggcgcgtgtgtacacacacacacacacacacacacacacacacacacgaggtcttattttcactgctctacacagggtcctgagaacccttacttttaaagttgggaaaaacgggccgggcgcggcagctcacgcctgtattcccagcactttgggaggccgaggcgggcggatcacctgaggtcgggagttcaagaccagcctggccaacatggagaaaccccgtctctactaaaaatacaaaattagccgggtgtggtggcacatgcctgtaatcccagctaccagggaggctaaggcaggagaatcacttgaacctgggaggcagaggttgcggtgagccgagctcgtgccattgcactccagcctgggcaacaagagtgaaactctgtctcaaaaaaaaaaaaaaaaaaaaaaaaaaaaatgggaaaaatgtggaaggattccttaactcattgtctgcgacaaatccagctgccttttaactcttagcaactgccagtatcaaatacttgaaagtgacgagatgctccatttaatgcaacaactcaaatgctaagcaattcggtcaagtcacatgcttgaatatttttaaatgtcacttaaaaattatcgagagaagataagatgtgcttttcacagtaaccctaaggaactcacacagaataaaaatcttaaccctaacggagtgtgaatccacagtaacaaatgccttctgtcactgtgattctgacagtgagacagtatcatatgaagacaggagattcacgcacctgctgtgtctgatgcccctctcggcacctagcatggtgaatgatgtccacgcttcccgtagcccacacaccacaccctccaatgcagaaagtgagtctacaattctcactgttgctcttgaggctgccaataactcatccaacttttcttttatttgcaactcagtgacagacagtaaaccctgagactcaagaagataacctcatctggccgggtgtggtggctcatgcctataaccccagcactttgggaggctgagatgggtggatcacctgaggtcaggagttcgagaccagcctggccaacatggtgaaatccggtctctactaaaaatacaaaaattagccaggtgtggtggtgcacgcctgtaatcccagatactcgggaggctgaggcaggacaatcgtttgaacctgggaggtggaggttgcagtaagccgagatcacaccactgcactccagcctgggcgacagagcaagactatgtctcaaaaaaaaaaaaagataacttcatccacagaagaatttctaacatctaaaggggtttcctgagggcaagtcagaaatacagatttctgaaattaatgctgcccaagagatgaagtcaactggaaagacacagaggcatgtgttgataaatagggatcaagaagaaaaaaaaattccttttgtttggagttctggcaaatcgcctggtttggaggaactgaattaccccttcttctttgcgatagagaacatcattatggaatgaactgtacctccctaaaaaatccttttgtctgaggctctggcaaacctcctaatttggaggaattgaatagtgccttcattttttctttgcaatagatataggacatcgttatagactgagccgtgccctccctcactcatcatcagaacccttaaactccaatgtgactttatttgcagacagggcctgtaggagctcaaaagggtgaggccctcgtccagtaggactggtgtccttataatcagagaaacacacaccaggtgtgatggttaatgccgagtgtcaacctgattggattgaaggatgcaaagtattgatcctgggtgtgtctgtgagggtgtggccaaacaagtttaacatttgagttagtggggtgggaaaggcagacccacccttaatcggggtgggcaccatctaatcagctgccagcacagcacattcaaaaagcaggcaaaagaatgtgaaaaggttagactggcctagcctcccatgctacagctttctcccgtgctggatgcttcctgccctcaaaaattggactccaagttcttcagctttagcactcgggctggcttccttgctcctcagctcgcagacagcttattgtaggaccttgtgatcctgtgagttaatactgaataaacccccctttatatatagctatttatcctgttagttatatccctctagagaaccctggccaacacagggtgcatccctcaccccctatatctatcaccctgctgcctgagttgataggaaagcagaaagagcccctttttaatgtttaattttattaagtatgcaatttcccagtgcccaaactcatgttgatttcaaaaactgcccttttaaagcatgtggacagggtaacaattcatagcaggtgacaaaaatgttttataaataatatccacggaaacagaaggtgtcaccgtctgcagaatgcagccaaaatattcagaagatttgtatcactctaagttctcgtgctagtaagaaataaaaaagcaggccgggcgcagtggcttacgcctgtaatcccaggactttgggaggctgaggcgggcgatcacctgagttcaggaattcgagaccagcctggccaacatggcaaaaccctgtctctactaaaaatataaaacttagctgggcatggtggtgcattgcctgtaatcccagctacttgggagactgaggcaggggaatcgcttgaacctgggaggcggaggttgcagtgagccgagaccatgccactgcactccagcctggtgacagtgccagactccatctcaaaaaaaaagctgtgtaaatacatgaatcattagatattagcctttctttgctgagccttgcacatttccacgaggtgtctctggaagcaggttagctttggtcttattgctgcgtggagcagagatgagagggatgggccatgacatgccatcctgcagcattctggtctttgtatgatcacggctggttgcgctgcaggagcacgccaggtcttttcacctagttctttgttgttgttgtttgagatggagtttcaccctgtagctcaggctgaagtgcggtggtgcgatctcggctcactgcaacctccacctcctggattcaaccaattctcctgcctcagcctcctgagtagctgggactacaggcacccgccaccacgcctggctaatttttgtgttttagtagagacagggtttcaccatgttgcccaggctgttcttgaactccggaccttgtgatctgcccgcctcggcctcccaaagtgctgggattacaggtgtgaagcacctcacccggcctcatctagctcttgatgacatactcagaccaacccgtggggtcccgggtccccagaacagaggtggacatggctccgatatcacaagaactggcgcttcctgcagcacacacctgaggttgagacacagtgattaggttttgttttattgtggctgatctaggacactttaaataacacaacatccaagagtcagccaaacgtggcagccaaaagtgctcctgaccttgtgatctgaaatatatactttaaccttctcttggaaggcatgttttaagataatataacagcttcctcatcatggagaatgaagcccatctgtaccaagtcaccaggccatcaaggaaaaggaaataagtactttcaatattttccttagagaaatacagttgggtgggcaggtgcagtggctcacacctgttatcccagcactttgggaggccaaagcgggcggatcgcttgaggtcaggagctcaagaccagcctggccaacacggtgaaactgcatctctactaaaaatacaaaaactagccgggcatggggtcaggcacctgaaatcccagctacttggatggctgaggcaggagaattgcttaaacccgggaggtggaggttgcagtgagctgagatcgcaccactgcactccagcctgggtgacagagccagactgtctcaaaaaataaataaataaataaataaagtaatatattggatggtatgatggtacacacactcctgaatcagacggctgccactctgtgaactgttactgcaagctgtctgtggtgagacatgttcagaaattgaaagtaaatgtttagaaacttaaaaaataatgacagtcatttaagctttgttcaatccaatgacttaaaaaaaacacactgagagcttctagtttccatgtttcttaaatgcattttttttagtaattcatttttattgtatctacggcagttatcaatctgctgcagattaggggagaggcagttttgccatggagagtttaaaagcgctgattctgagcacagtgtcatctggatagaaactcctgaggtactgctgtaattttccacaaaaacacttgtggggatgtaagaaagaggaaaacccatactactgctaataattggaaccagtgatcaaaggatgggtaaaagcacaagctgagcttccaaaaacagcagtgtgaatggattttttttaaaaaaactagaagatgcatttttcttgctccttgagaaaaaaggcttatagccactagcaacatgaacatcagcattctattgagatcactggcttgcgaggtggtgatatagtttagatctgtgtccccacccaaatctcatgttgaattgtaatccgcagtgttggaggagtggcctggggagaggtgatgggatcatggaggtggatttctcacgaatgggttagcgccatccccttggtgatgttcttgtgaccatgaatgagttcccacaagatctggttgtttaaaagtgcacagcacctcccctccactcttgctcctgctctagccattaagacgtgctggcttccacttcaccttccatcatgattgtaagttgcctgaggcctccccagaagcagaagctgctctgcttcctgtacagcttgcagaaccatgagccaattaaacctcttttctttataaatcatccaatctcaggtacttctttatagcaatgcaagaacagactaatacagatggatgcatgcatggacggatggacggatgaattgatggatgggtggaaggatgggtagatggatggataggtggatggatggatggattggatagatggatggataaatggatggatggatggatgggtgggtgggtgggtggatgggtgggtggatgggtgggtggatggatggatggatggatgggtggatgggtggatgggtggatgggtggatggatggatggatggataaatggatggatggatggatggatggatgggtgggtgggtggatcgatggattgatggatggatacatgagaggatgggtgagtggatggatggatgaattgatggatggacggatggatgaactgatggatggatggatggatggatggatggatggatggatgggtggatggatggatgggtgggtgggtggattgatggatggatagatggatggatggataaatggatggatggatgaatggatggatggatggatggatggatgaactgatggatggatggatggatggatggatggataaatggatggatggatggatggatggatggatggatggataaatggatggatggatgggtgggtgggtggatggatgggtgggtgggtgggtggatggatggatggatgaatggatggatggatggatggatgaactgatggatggatggatggatggatagatggatggatgaattgatagatgggtagtgatatggtttggatctgtgtcctcattcaaatctcaagttgaattggaatccccagtgctggaggtggacccttgtagggggagattgggtcacgggggtggatgtctcaggaatagtttagtgccatcccctgggtgctgtgcttgcaatagtgaatgagttctcgtggcatctggttgttgaaaagtgtgtagcatctccccagcccaccccaactgcacctctgtctctccttctcttgctagggccatgtaagacacctgctttccttcactttccactatgattatgcatttcctcatgcctccctagaagcagaagctgctctgcttcccgtacagcctgcagatccatgagccaattaaacttcttttctttataaattacccagtctcagtgtagcaattcctcaaagacctagaaccagaaacaccatttgacccagcaatcccattactaggtatatatccaaataaatagaaatcattctattataaagatacaggcacacatatgttcattgcagcactattcacaatagcaaggatgtggaatcaactcaaatgcccaagaatgatagactggattaaaaaaaatggtacatatacaccgtggaatactatgcagccataaaaaggaacgagatcatgtcctttgcagggacatggatggagctagaagccattattcttggcaaactaatgcaggaacagaaaaccaaacactgtacactctcactcataagtgggtgcttaacaatgagaacacatggatacagggaggggaacaacacacactggggcgtgttgtgggtgggggtcagggagggggagagcatcaggaaaaatagctaatgcctgctcagtagtgaagtacaaatcaaaaccacaatgagataccacctcacatcagttagaagggcgatcattaaaaaatcaggaaacaacagatgctggagaggatgtggagaaacaggaatgcttttacactgttggtgagagtggaagttagttcaaccattgtggaagacactgtggcgattcctcaaggatctagaaccagaaataccatttgacccagcaatcccatgactgggtatatacccaaaggattataaatcatcctactataaagacacatgcacatgtgtgtttactgcagcactgttcacaatattaaagacttggaaccaacgcaaatgcccgtcattgatagactgaataaagaaaatgtggcacatagacaccatggactactatgcagacattaaaaaggatgagttcatgtgctttgcagggacacggatgaatctggaaaccatcattctcagcaaactaacacaagaacagaaaactaaacaccacatgttctcactcttaagtgggagttgagcaatgagaacacagggacacagggaggggaacatcacacactggggcctgttggggggtggggggcaaggggagagatagctttaaaagaaatacctaatgtagataacgagttgatgggtgcagcaaaccaccatggcacgtctatacctatataacaaacctgcatgttctgcacatgtaccccagaacttaaagtacaataataaaaagaatagctaactcatgctgggctttaatacttaagtgatgggttgataggtgcagcaaaccaccacggcacatgtttatctatgtacaatcctgcatatgtacccggaacttaaaatttttaaaaattacccagtctcaggtatttcttcagagcagtgtgagaacggagtaatacaggcaaccaacgggctttgctcattcttgcaatcagcatctttttttttttgcatccattcaggagctacctcgcaccaagagaaacactggtaggaagggtaaggggaacagggtatggctggcatcactaggggaagatgagccgatacatcaagccctgcagcaggggaaggcagaatgctcactgggtgctagaacttgaacttcacccctgacattcagaaaaatctctttggacaaagagcagagcaggaatgaagcccacaattaagattgcgatcaattatcttttttttttttttttgaggcagagtcttgctctgttgcccaggctggagcgcagtggtgcgatcttggctcactgcaacctccacccgccaggttcaagcgattcagcctcccaagtagctgggattacagacgcgcaccaccacgcctggctaatttttgtatttgtagtagagacaaggtttcgatgatcagtcatctttttgacgcactgctggattctgtttgctagtatgtggttgagcatttgtgcgtctatcttcatctgggatattggcctgtagttttctatttttgtcgtgtccttgtcagattttggtatcaagatgatacaggttttgtagaataagttagggaggaatccctccgcctcaattttttagaatcgtttcagtcagattggaaccagctcttctttgtacatctggtcgaattcagctgtgaatttgtctggtcttggggcttttttttttttttttgattgataggtttttgtaaattactgattcaatttcataacttgtcatgaaatgagtctgttctggatctgatttcttcctgattcaatcttgggaggcatgagggaatcagcccaggtgtccatcaattatgtgttggatgaagaaaatgtagttgctgcatatataccgtagaatagtatagagccataaaaaagaatgaaatcatgtttttagcagcaacacagatgcagctggaggccattatcctaagtgaattaacacagaaacggaaaattaaataccacttgttctcaattatacataggagctaaacattgaataatcaggcataaaaatgggaagctggcacacctgcgcattccaagagcaggggagggagaggggtgtaaaggctaaaactctacctatgaggtattttgttcaccgtttgagtgacaggttcaactgaagcgtgaaccgcagcactacacaatgtatcttacaacaaagctgcacgtgtacctcatgaaattttttttaaaagaaaacaaacaaggccggggggtgggtggctcacgcctgtaatcccagcactttgggaggccgaggcgggtggatcacgaggggtcaggagatcgagaccatcctggctaacatggtgaaaccctgtctctactaaaactacaaaaaattagccaggcgtggtggcgggcgcctgtagtcccagctactcaggaggctgaggcaggagaatggcatgaacctgggaggcggagcttgcagtgagccgagattgtgccactgcactccagcctgggcgacagagcaagactccctctcaaaaaaaaaaaaaagtaataaaaataaaaaaaataaaataaaaaacaaggaaaaacaaaagagtatgaggcttcaagcccactggaccaagacaccagggtgatctgcgcataggacacaggaaatcgtacttgctaggagctcagtggctgcgttcacctggaacctaacccatgtaggagctgcgtccctttcccagggcaccatgagagggaccagggaaccgaacacaggaggatctccggaagacttgagataggttttttcattccacctggagtaccttcaacgataccttcattctatttagataatttagagaaatgaaagttagagtgtttgggagtatttaacgcactcctaggagctacaaaatgagtgtctgccacgtagctcatggaataagatggagtataccagttatccatgtggcaagaacagaaaagaagcaggaagtacagcttcagccaacgagggcgctcccagttactggtcatgatataaagccaaaatggtggcctcctacactcagagcctgtgaaaaaggtgatgtctgtatcttgatggtaaagatacagagtattaaaaaggaggaattacaattgttaaaacaactgttcgacaattgttcgacaattgttttaacaattgttcaacaattgttaaaacgttcacatttatcagccaaacaagcaaaaaccaagtagaaatggccctagtcacacaagacagcaatgattgaagtctaaaacgttaatggaacaaggaggatcatcgcctatgaaggcatggtttggatctgtgtaaccaaccttgtaacccaacagggctaacttgaaaatcataaaccaaatgctgaattgagatgaagctataatgtgccattttcacagcattttcttcagaataacacaatatccaagtatatttttcaagaattcctaggtaggcagggagaaatgaacaaaatcaacattgtgggggaaggaggaaaggatgggtggaaagagggaaggggaggggaggggagggaagcaagaatgaatggaaggagggaagaaagaaagggagggagggagaaaggagggaagaaagggaaggaggaaaggatgggtggaaacggggaaggaaggaagaaggagaaacaaggtcccagaaaatactgtcaataatatatttaatgaggcaggaaatgcaaacttacaaataggaaacactgtactgtatgaaaaaagctttaaaatgataggtttctgtttcttagtatcctgataatatgttacatttgtaagtaaaatgtgaaaatctcgaggaaataattttctcagagatactaattatcccaattcaatcaaggaaattaggtctaatcagaccaatagctataagaaaaatagagaagaataatgaaagaatggcatgaagaaagggtagatgagtgcagagggtattttagaaaattcttctagactttcaaagaacagataagtgccctgatactgactggttggacaaaaagagtctgaggtggtttgttttgtgaaatttatgctgttctgatagaaattctgaaaaaagcatagcagaagaaatttgctaggagggcaggaattgcttgatgagtaacatttatatatacagaagaaaaaaatcataaaaatgtaaacttaaagaagtcttccactgagacatacaaaagcaaatgtatttaatactaagaaaaaaatttccagaaatgctgtccattctgaaatattattaaagagctcctagaataaatgtgataagtgtgtccataaccactacctgaaaatcagatcttagtcaaccttgtaacccaactgggctaatttgaaaatcatcatggccaggtgtggtggctcaccctgtcactgtagcattttgagaggccgaggtgggaggattgcttgaggccagttcaagagcagcctgggcaacatagcaagaccctacctctacaaaaggaagtcataaaaaattatctgagtgtggtggtgcatgtctgcaatcccagctacgtgggaggctgaggtggcaggactgcttgagcataggaggttgaggctgcagtgagctatgattatgcctctgcacctctgcactccagcttagaaaacagagcaagaccctgtctcaaaataatataaaataaaaacccatcatttagaccaggaggcagcgcttgtggagaaggcgttcagctcagagcagcaacagctttcaagcatctaccaacagccaacacagcccctgaatccgtctgcacctgccccgtccctacgcatcctaataaattcacgagtgtcttggtaagccagaacctccgggatccaggcagccagaggacagttcttcccgcacttgtgggtagcaacagccgtcctgctacccaaaaagcccagttcttggagccaagagctgatgcgaccacagcctgcaaagtcttgagcagggacgaagctcatgatggcttctggcctctcttcattcaggagggaaggaacccaggtgcccgaactgccggaatttgccaagaaggagggcagattggttgtcaccccctgcgtctctcatttctatatatttatcaatttaaaaataaaggtgaaataccagtatctcttagtcgttatgcaggtatggagcgcctctctggagacctgaaatcctattttctttgtatgaggcagctatccatctgcccctaagacctactgtgaaagacgctgcagcgagattattctgtgtgtgtgtgtatatgtgtgtgtgtgtgtgtgagagagagagagagagggagagagagagaaaataagcaagagagaggaagaaaaaagaacaaaacacagagaaagttatggagaaagagagggtgagaatgggagagaaagagagagacagagggaggaaagagacagagagaaagattgtgacacagaaatagaagcacagaaagagagcttgaaagagacagagagtgtgccagagagacacagagagacagatacaggctcacacctgtaatcccaatagtttgggaggccgaggcgggtggatcgcctgatgtcaggagttcgagaccagcctggccaacatggtgaaaccccgtctctactaaaaatataaaaactagctgagcgtggtggcgggcacctgtaatcccagctactcgggaggctgaggcaggagaatcgcttgaatccgggaggcggaggttgtagtgagccgagatcactccattgcaccccagactgaatgagaagaacaacactctgtgtcaaaaaaaaaaaaaaagagagacagaaggagagagacacagaaactgagagacagagagaataagcgagagacagagagagagaaagaggagagacacagagaaagtgacagagagggacagagaggaatagaatgagagagacagaggttgtgacacagagagggagagaaagagagagagacatacagagagagaaagagagagatggggagagagctgcctggcatggtgggataaataagtgggtgacgcctttgttttcattgtgtttactacgatggccctcctctccctcttgagcacttgagatacatcactacgagagaactcaagttaaaacaatgctcctcggatacacagctgtcctcagaaaccaccttcaggataaactctgtaaatattgttgtcagaatggtaaagtgttcagataattaaagttgtcctctgactcccaggtctagtctagaaaagaagattaaaatgaaagcaccattgacccacccgcgaggcaaagagcagatgccccaaagagcttgtgtaagtaaagaggaaagaaaggctttcgaagacaaggcactacccaagggcgagaagtcaatcttgatgttgccgtggaaacgcggacttgtgaagagctttcaagaacaattctgtctccaaggaggtaaatcgtcctcctgggaatgcgttgaaaccattatccacccacaggactgggctaaaagtaaacttcagggtagcttggatgagcagcataggttgctaatgagcgtcgatttaatggtctgagttgtttatacatcaaaaagaagttaccaagggtctacctgtctgctgtttagatacactggaaaccagttaaaacttaattcctaagaagctgtttcccactgtgttcaaatttaaatgcttcaagagtaatgcttctgggcacaaaatggaaaaagtggggaaaatccaacggcatcaaaatccccacgccaccacccatgctgcaagcactgtaagctgtgatagtatctgtctgctaaaggtgctaaagagaaagcttgaggaactgagacctggcagggacccctcttaggggcaaaccaggaaactctctccacccccgaccaagcatggaaatcaagagaaatcttgagttccttccaggaaggaaactccaggcacttcgctggctgggagaagttaatgagcaacttgatgaagaagaaagtcacagtagcttaaaataacaaccaaggaaattagagtcagggatgttcgcttccctagagcaactaataaagaaaatgtggcacgtagacaccatggaatactatgcagccataaaaaaggatgagttcatgtcctttgcagggacatggatgaagctggaaaccatcattctcaggaaactatcacaggaacagaaaaccaaacactgcatgttttcactcataagggggagttgaacaatgagaacacatggacacagggaggggaacatcacacacaggggtctttcggggactgggggactaggggagggagagcattaggacaaatacctaatgtagatgatggatggcagcaaactaccatggcacgtgtatacctagtaacaaacctgcatattctgcacatgtaccccagaagttaaagtataattaaaaaaaataaaagaaactcacacctctaccctatggaatcctctggcatgaagacctcagacgtgggagagctagggactgaactctgatccctgttccttgttttaaatttcttcctgagggtcctggaggaggtcctgcccatgggccagatccaatgtgcttttactgctgaccgcaagtcttagacaaagctccacttccttaaccaattgcaagtccaaaagtctttgaatccaccttgttcctgtaagcaaccccaccctcgggcccagcttcaagatatatatttttttttttttgagatggagtttcgctcttgttgcccaggctggagtgcagtggcatgatcttggctcgctgcaacctctgcctcccaggttcaagcgattctcttgcctcagcctcccaagtagctggaattacaggcacttgccaccacacctgggtaattttttgtatttttagtcaagacggggtttcaccatgttggccaggctggtcttgaactactagtagacctcaggtgatctgcctgcctcagcctacaaatgtgctgggattacaggcatgagccaccgtacctggcccaagatatccctttttaggccaaaccaacgtatagcttccatgtattgatttatgattttttttttacttattatttttgagatgtagtctcgctctgtcgcccaggctggagtgcagtggtgccatctcggctcactgcaacctccgcctcccaggttcaagcgattctcctgcctcagcctcccaaatagctgggactacaggcaagcgccaccatgcccagctaatttttgtatttttagtagagacagggtttcaccatgttggccaggatggtctcgatctcatgacctcgtgatctgcccacctcggcctcccaaagtgctagaattacaggcatgagccacgacgcccagccgtgatttataattgttgatgaaaagagtcaaactctgtaaaatatttgaagagatttattctgagcgaaatatgagtgaccacggcccgtgacacagccctcaggagatcccgagaacatgtaccccaggtggtcggggtgcagcttgattttatatattttaggaaggcatgagacatcaatcaaatacatttcagaaatacattggtttggttcagaaaggtgggacaactcaacctgggggctgccaggctataggtaagtttaaatattttctggttgacaactggttgagtttatctgaagacctggaatcaacagaaaggaaatgtccaggtggagataaaggattgtgggaaccaagttttattttgcacaggaagctctcagatagcagacttcagagagaacaggttgtaaaatgtttcttatcagacctaaaagggggcctggctctcagttgattatgtcccagatctgggaaggaacaaaggaacaaagggagggacggaaggaaggagggaaggagggaaggaagagagggagggaaggagggaaggaagggagggagggaaggaagggagggaaggagggaatgaaggagggaatgagggagggaaggagggaatgagggagggaaggagggaggcagggagggaaggagggagggagggaaaggagggagggagggaaagaagggagagagggaaaggaatggagggaaggaaggaagggaaagaagggagggaaggaaggaaggggagaagggaggaaggaaggggagaagggaggaaggaaggggagaaggaaggaaggaaggaagggaggtaaaggaggtaagggagggagggaggaaaggctattctctatagaatgtggatttttcccacaagagacttctcagggcaatttcaaggtatggcaaggaaatatattttggggttaaatacattgtttttccttgtctcattatgttatgccagagtcacattggaaagtaagttacgatatatagggttaaataaaacccatctaatgagaactcatggtttgtaaagaatgactccctagaccctttagataggaatttgggcaagataaaaaaatcagaacttcgtcctcatgattttgcctggagcagcttctgtcctgaaatttacccgacttgaaacactatggctcggaagtcattgaaaagattgggtcttaggccaggtgcggtggctcacgcctgcaatctcagcaccttgggatgccaaagcgagggaatcacctgaggtcgggagttaagagaccagcctgaccaacatggagaaatgctgtctctactaaaagtacaaaactagccaggcgtggtggcgcatgcctgtaatcccagccactcagcaggctgaggcaggagaattgcctgaacccgggaggtggaggttgcggtgagctgagatcacgccatagcactccagcctgggcagcaagagtgaaactccgtttcaataaaaaaaaaaaaaacgttaggtcttaagcgtgagctgcctgagtctcctggcttggtgctgtccaaataaacactatcctttctcttgctgcaaagcctcattgtggaggtttgacctaagtgcaccaggcaagtggacaccagtccagtttggcaacaaaacaggcatcagtaacgtggggtacagggtgagaaaggcctacatcagcagctttttatgagatgaaaagatttcctatcaggagaacataaacagacttagactaaggtgttggacttctgttcgtctgaggatcctgtttcttgctgcctggtgagaaggtagtgaggtcatttgggtatacatagcagcattaacagcttgaacctagcgaatatagatgcccatctgtctgcagaagttgcctccctctgccctcaaatgagctgcttaaggagccatccatcttagctagctctgctgcgtaacaaaacgccccaaacgtagtagtttaaaaaacaacacccctttatgatctcacagttctgtaagtcagaagattgggtttagattaacaggatgtctccatttagagtctcacaaggctggaattaaggtgtcagacaaagctgagatgacatctgtagcttaggatgctcttccaggcatgctgaattgggaggcaaaattcagcttcttgtggttgtgagattgagtcacattttctctcttttctttgagacagagtctcactctgttgcctaggctggagtgcagtttcgcgatctcagctcactgcaacctccgcctcccaagatcaagtgattctcttgcctcagcctccccagtagctgggattacaggtgcctgccaccacacccagctaatttttgtctttttagtagagacgggttttctccttgttggaaagagtggtctcaaactcctgatctcaggtgatccaccggccttggcctccaaaagtgctgggataacaggcgtgagccaccgcgcccggccaagtctcattttcattttggctgtcagacaatggtggctctctgcttgctgtgacaccctcagcaacttgtcatatgggagtctgcttcttcaaaaccagcaaaaagggccggctgcggtggctcacgcctgtaattccagcactgtgataggctgaggtggggaagatcacctgagctcaggagttcgagaccagcctggccaaaagggtgaaaccctgtctctacgaaaaatacaaaaattagccaggcatggtagtgggcgcctgtaatcccagctacttgggaggctggggcaggagaatcgcttgaacctgggaggtggaggttgcagtgagccgagattgcaccactgcactccagcctgggtgatagagcaagactctgcctcaaaaacaacaacaataataacaacaaaaaccaggaaaaggatctctgagaccatctcaagtttatttgaagaagaagaattactcattcatctcaccctctttgaggcaggtccagcacagatgatctctcctttgattaaacccacgtatgcctagtgttccattattggaatgctaagcatgtggagttatttatatcctactgctcaaggtcatcgccaagatctgatggcaaaaattcaaaaacttgcaacttcaggcataaatggattaactcaaagttttgaatcaaagaagatgagtgaggcaagcctccattagtttagaggttaattttgccacggttgagaatgtgccccagtccaggaaaaacagacgccagtcaccataggacctgtgctccgtgctttttcttttctttttgagacggagtctccctctgtcgcccaggctggagtgcaatggcgccatctcggctcactgcacccttcgcctcccgggttcaagtgattctcctgcctcagcttcctgagtagctgggattacaagtgcacgtcaccacgcccggctaatttttgtatttttactagagatgggctttcaccacgtttgtcaggctggtctcaaactcctgacctcaggtgatccacccgcctcggcttcccaaagtgctgggattacaggcgtgagccaccgcgcctggctttttttttttttgagacagagtcttgctgtgtggcccaggctagagtgcagtggcgcagtctcagctcactgcagcctccacctcccgggctcagatgattcttctgcctcactgtcccaagtagctgggattacaggcatgcaacgccacgccctgctattttttttatttttcagtacagacggggttttgccatgttggcaggctggtcttgaactcctgacctcaggtgatccacctgcctcggcctcccaaagtgctgggattacaggcgtgagccactgcgtgcggccctgtgctttttccaaggatggttttgagggctttggtatagaaagggaaaaaagcaggcaggagggaaagaggaaagaaaaaaaaaagaaggagagtagataaaagaggcaaatgattacattcttgtgagtctttgattggcactctctgaatacacattttacatggcaaagtgcgggtagaggaacagtcaatcacgcgttcatttcatgcacagtaaatccacttttgcataagacaaagtcaacatacagaagaggaagatgtcaaacatgcatttgtctcagggtgggcggagagatcatttctagtcttatctttgtcccacacttgtgaagacaagttgttaatttacattgtcagggagaaattcaacagaactctgttttaggggaaagattttggagcccacaagaaatttccttatgagcaatttgtgagagcatctccgctggggagggatgtgcagaaatgaagaggctacaacaagtgtctgaagatagtcctgaaggccaggtgcagtggctcatgcctgtaataccagagctttgggaggctgaggcaggaggattgcttgagcctagcagttcgagaccagcctgggcaacatggtgaaacctcgtgtctaccaaaaatacagaaaaaaaaaaaaaaaaaagcagctgggtgtggtgatggtggtgcatgcctgtagtcccagctacttgggaggctgaggtgggaggatcacttgagctgagaaggtcaaggctgtgccactgcactccagcctgggcaacacagtgacaacccaatctcaaaaaaaaaaaaagatacccttccagccagatgaatgcacatgaccactggcatgagaggaggtcggcattaagatacaggtcctaaggaccttgttgataaaacaggttgtggtaaagaagctggccaaaccccatgcaaaccaagatggcgacgagactgacctctggtcttcctcactgttcattatacgctaactctaatgcattcgctgctaaaagacacttccatcagcctcatggcagtttacagatgtcatggcaatgtcaggaagttaccctatagggtctaaaaaggggaggaaccctcagttcccagaaccgcccaccggcttcccagaaaactcacgaataatctttcccttgtttcgcacagaatcaagaaataaccataaaaatcaccaactggcagccctcggtgctgctctgccaatggagtggccactctttattcctttactttcttaatcaacttgctttcactttactctatggactcaccccaaattctttcttgcacaagatccaagaaccctctcttggggtcaggatcaagacccctttccagtaaacaacgcctcatgttttctataataatttcattactttgtgtgcccactgacaatggtaatggtctaacccggggttggtcaactgcagccctctagcaaaatccagccccttgcctatttttgtgcaccttgtaaaccaaaaaactatttccacatcttttaaacagtgggttaaaaaaaatcaaaagaaggataacacagttgactgttggacaacatacatctgaactgagcagattcacccatttggactttcacccgagatgactcctcctccctcttcgtcccccctcctccccccctcccttctcctcctcccctccccctcctctccctactcctgcagagtgcagtgactcacgcctataatcccagcagtttgggaggccgaggcgggtagatcacgaggtcaggagttgaagaccagcctggccaatatggtgaaaccccgtctctactaaaaatacaaaaattagccaggtgtggtggcgtgtgcctgtaatcccagttacttgggaggctgaggcagaagaagtgcttgaacccaggagacggaggttgcagtgagccgagatcgtgccactgcactccagcctcggtgacagagtgagactccatctcaaaaaaaaaaaaaaaaaagagaacgaagacctttatgatgatctacttccatttagtaagtagtaaaatattttctcttctcttccttagcattttttttctagctgactttataatatacataacatacaaactatgtactaatcgactctatgttatgaataaagcttccggtcaagagtacactaccagtatttaacttttgggggagtcagaacctatacatagattttcaactgcatagaggtcagtacccctaacccccgtgttgttcaagggtcagctgtatatacatattttttcgaggtggagtttccctcttgttgcccaggctggagtgcgatggcgtgatctcagctcactgcaatctccacctcccgaattcaagcgattctcctgcctcagcgtcatgagtagctgggattacaggcacgcaccaccattcccagctaattttttgtatttttagtagagacgggtttcaccatgttggtcaggctggtcttgaactcccgacctcaggtgatccacccgcctcggcctcccaaagtgctgggatgacagttgtgagccactgtgcccggccgggtcaactgtattttgtgccacgtgataaatatatacatttacatctcagtgtccctcaagattcttagaacacagaacttgcccattcatttacatattgcgctgttgtggtagcgatcatatgacccaaagagcttcacatatttccctatgtggacttttcttttcttttttttttttttgagatgggatcttgctctgtcacccaggctggactgcagtggggtgatctcagctcactgcaacctccacctcccaggttcaagagattctcctccctaatcctcctgagtagctgggattacagacacgcaccactacacctggctaactttttgtatttttagtggaggcggggtttcgccatgttggccaggttggtctccaactcctgacctcaagtgatctgcccaccttggcttcccaaagtgctgggattgcaggcatgagccaccgtgcctggccctgcaagtctgttttgattggatttgtttgactttaaacccattcggaagagttttcctagaattgctacactcggagacatgaggcaatgcttactctgacttttgacgttttcaagtgtacagttgaaagtcaacaacatgggtgaatgtggcaacccctccttacacaatcagagacagtcactgccaagccgcttcgtggattgtcattagcttccaatgagaaacaggtgcacaatcaaggtctaaagataaagagggttaagtgcaagacagcagccatgacgtgtcggtccacgtacagcctgtctgcctgagggctcagtgatccaaaaagacactgcaggtcagcacttcagagtgttcgcaacatccggggttacttaaccctgtggcttgacaagcagcagagatttgcaaacaatgatagcttctgtgccacttcagccgaacactggctctgaaaacagcctcagtatctgacaagctctcattcctgggcttgtggcgtggctgtccattgagagagcctaagtatatcttcatgccgaggggatgggagcatttatataaataaatgtttgcactgattacagcactgctgccaaagagcttgatgggcgatgatgatccgatttcgccatggcagcttatgtttacagaacccggctccattgcagacaggacatcgaatgtgtaacgcagtatttaaatgtccactgacatttacagctcgtgtcagcccaagagggaagaggcgttggtgtcccagtctgccaaggagggctcctgctatggaatgaatggtgtcaccccgaatctcatgtgtggaaaccctaatgccaaaggggatggtatttggagacggagcctttgggagatgatgatgtttacatcaggtcgtgaaggtgggatccttatgttgggattcgtgcccttgtaagaagagacaccagggcacacatgctccctcgtgctccacccccctctctctctgccctgcgagaccatctgtaaaccaagaagaggaacctctcaagtacccaaccatggtgccacctggatgtaaacatttctgcctccagtactatagagaaataaatttctgttatttatgccaccccatctatggtccagttaacccttaaacaacacaggtttgaattgcacgggtccacttctacgggcattttcttctacctctgccaccccggagccagcaagaccaatccctcctgtccgctctcatcttaggctactcaaggtgaagacgataaggatgaagaccttcatgacgatccactcccacttcagaaatagtaaatatattttctcttctctatgatttttaaaaatttagtttggtgtccttttttgtttttaattatctttccataagtgattggggtactggtggtatttggttacctaagttctttagtggtgatctgtgagattttggtacacccatcacccgaacagtatatactgcaccctatttgtagtgtttatccctcacccccctcccactcttcccccccaagaccccaaattccattttatcattcttatgcctttgtgtcctcatagcttagctcccacgtaacactgagaacatacgatgttggtttttcatccctgagttacttcacttagaataaaagttccttatcaggcgtggtggctcaagcctgtaatctccacactttgggacgccaaggcgggtaggtcacctaaggtcaggagttcaagaccagcctgaccaacgtggtgaaaccctgtctctactaaaaatacaaaaattagctgggcgtggtggcgtgcacctttagtgccagctactcgggaggctgaggcaggagaatcacttgaacgtgggaggcgtaggctgtactgagcagagatcacaccactgaactccagcctgactccagggcaacagagtgaaactccatctcaaaaaaaaaaaaaaaagaatgaaagttccttatgatttttgattctcaaagttccttataaggcgattctcctgcctcagcctcctgagtagctgggattacaggcgtgcgccaccacgcccggctaaaaaaaaacaaacagcattttcttttctctagcatactttaataatacagtatacaatacataaaacatacaaaatatatgttaatcgactttatggtattgataaggcttctgctcaacaataggatattcataagttttgggtgagtcaaaagttatctttggattttcaactgtgccagggacgtgtgtgacgcccctaactcccacattgttcaagggtcaactctagttttttgttgttgttgttgttgtttttgagatggaatcttgctctgtcgcccaggctggagtgcaatggtgtgatcttggctccctgcaatctccgcctcccaggttcaagcgattctcctgcctcagcctcctgagtatctgggattacaggcgccacacccagctaatttttgtatcaaggtcaactgtattttcttgcaacagccagagctgactaagacagtcttgaagctcaaagaggtacaagaacctacccaaagttatccaaccaacaagcacctggaaggcagaataaagactcaggtagccaagcgccatagccacaccatggtagagctattctgccttgtagagatgcattgaatctgtcacagggtgaatacatctccaaatgcatttgaaaactcctacgggatgctacagaaacacgtgagggaagagtgggtgtggacatactctccatctgttacactcagagtactccaactacaggagtgagatgcctcaagacaggccaaggcagaaacaagcatcactatgaaccccagaatagatatgttttttggccagacacggtggtacacgcctgtaatcccagcactttaagaggcccaggtgagaagactgctggaggccaggagtttaagaccagcctgagcaacagaggaagatcccatctctacaaaatatttaaaatatatacatagctgggaatgatgatgcgtacctacagccccagctactttagacactgtggtgggaagatcactcgagcccgggaggctgaagctgtcgtgagccacagtcacaccactgcactccagcctgggtgacagagtgagatccggtctcgaaaaaatcatcattatcgtcacagtaatgagaggaattttaggtgataggtggttactaatttcaaaaataggggcttccggtttctcctctaatgatacaggggttaagaagaaatgacttaagcagatagtaaaaattagctgggtgtggtggtgcacacctgtcatcccagctacttgggaggctgagatgtgaggatcacctgagcctcggaagttgaagttgcagtgagccatgatcacaccactgcactccagcctgggtaacagatggagaccctgtctggaaaaaaaaaaaaaaaaagattttgcacaaagttttacgatgactctgctttgtaattaaaagtaatttctgctttgttggtgatttctcacacatttatctggtagaccagatacctgcatgtgatagggtaagaaggacccatttccctccaaggagaacagcattgcaagggggttgaggacgcatgcatgtggaatccaaacattgaatgcactgagacggcgctgcatgaagcctgtctgtgagtttatgatgaagctgcacagagctccgtaggcggctctcactcctctctctcagcctttggcttcagtttaattgcatacacacccttcagagctgctcggggcccccacttcttcagccttctggcatttttctaagaaacactaaacctctttccaacgttgcccttggattttgtgtgcacgtcttccagcccttgagctgcttgacctgtgcttgcaagggttccataacactggataggacagaagctccgcccagccccaggtgaaagctctgtgctcttcagggaccatgtcctattcacactgtctccctcacatctaatacagtcatgatactcggcaatatagtactccacccaacaggcaactcagagtctgccagtgatacaggagttaagaagaaatcacttaggcagacagtaagggtatgggagtcctcggcaaggcttttttcttttctttttttttttttttttgagatggagtcccgctctgtcgcccaggctggagtgtagtggcgtgatgttcgctcattgcaacctccgcctcccgggttcaagcaattcgcctgcctcagcctcctaagtagctggcattataggtacgcaccaccaagcccggctaatttttgttttgttttttttttttttagtagagacgcggtttcactggtcaggctcgtctcgaacccctgacctaatgatccacccgcctcagcctccaaaagtgctgggatgacaggtgtgagccactgcgcccggcagcttttctctttaacgaaaagcagccccaagtcattttctaacaatgaacagcctgtcaagtcgagctgcagacatacacaagccagctgggagcttgtacgggtgaatgtcgggaggacctagggactagacacgttcaagatggcggctccatcttcccgggaggaactaacgactagacacgttcaagatggcggctccatcttccgggcaggaactagggactagacacgttcaagatggcggctccatcttcccggcaggaactagggactagacacgttcaagatggcggttccatcttcccggcaggaactagggactagacacattcaaaacggcggctccatcttcccagcaggaactagagactagacacgttcaagacagtggctccatcttccctcctctttgtcagccacatgtaaagtaagaaaaacaggaccgagagccccgaccaactacaaagcccatttgcataaccgattagggtgggcaaccagcctttcctgtgggctatgtaaatgtcatgcttgatggaaccaatctctcggagagccccgaccaactacaaagcccatttgcataaacgattagggtgggcaaccagcctttcctgtgggctatgtaaatgccatgcttgatggaaccaatctctgagctctatgtaaatgagacaccgcctcctcaaactggactataaaatccatcacatttggtgccagctggtcctttccgctcggagacccctttctctatagagaaaaccatttctctttctcttctcctgattaaacttccactcctaaactcctcgtgtgtgtctttgtcctaaattttcctgatgcccaatgacgaaccccagggtatataccccagacaacgtagccacttcactaacatgtagagagcttgcgcattttaattcctatcctcacaataggcaaagagcagaacatactgaaaatcagcaactctgcgatccatcagaaaatagagatcacaagacgaaatgctgcctgaagactggacagacaggtggcaagtggaattgtgcttgtctaggagttcctgctggagccagcacctgatggacacatttgcagggtaattattaaacagctgcaggctgacagtggacaagcctaagtaagttaaaaactcctggccaggcatggtggctcgcacctgtaatcccagcactttgggaggccaaggcgggcagatcacctgaggtcaggagttcgagaccagcctggccaacatagtgaaaccccgtctctactaaaaatacaaaaattagccgggcgtggtggcaggcacctgtaatcccagctactcgggaggctgaggcaggagaattgcttgaccctgggaggtggaggttgtagtgagcccagatcgcaccactgcactccagcctgagtgacagagcgagactctgtctcaaaaaacaacaacaacagaaaaacttctgggggcccatcttagaggggaccttgtactttcacaaattttacctccgggagctccaccaggttcccagggtgaagatcaaagaaatatccagttgtgtgttattgggggaaagtaaccactttgcaatattcctagggagacagtagcattttgaagtatgcccaaagcaatccgtgtcctctctgccctcaaaggaaattactttagcgcagtcaaagtgaactgggggaagggaaatcttctatttcagtttttcttttttttttttttctttccaggcagattttcactcttgttgcccaagctggagtataatggcgcaatctcggctcactgaaacctccacctccagggttcaagcgattctcctgcctcagcctcctgagtagctgggatgacaggtgcctgccaccatgcccggctaatttttcgtatttttagtagagatggggtttcgccatgttggccaggctggtctcgcactcctgacctcaggtgatccacccgcctcagcctcccaaggtgctgggattacaggcgtgagccaccgtgcccgaccagatttcagtttctattagctttcaacaacacttttcgtgcatgagtgacgctggcggccatgtactcagccattccatcaaggttccaagcagcaaagctgcaaaatggatctgactccttcagtgaagaagagtctccctgaatgcattggaaacactcatgagatgctactgaagcaagtaagggaagcctgactgtggacatgctctctgtctcttaggctcacagtactccaaccacagaaacgagatgcctcaagggaggcagaggcagaaagaagccatcactataaacccaagaataaagccagcagagctacagtgatggcctgtgtgctgcaggtgagcatcaccttgttgtaaggccacaggctttcctggccaccctgctcagttggcctcgtggtgggagtcactagactcaagatagacccagccagaccatctggttagagctacccaaggaaaagccattgtcagcacaaagtcactggagtcttagaatgcacagctgtgatgggctgattccttctcccaaatccctatgttaaagccctaacgcccaggacctcagaatgtcaccatatttggagatagtctttaaagaggtgattaaggtaaaacaaagtcaccagggaggcccctaatccgagaagactgggatgcttataagaagaggagatgaggccgggtgtggtggctcacgcctgtaatcccagtactttgggaggctgaggtgggtggatcacgaggtcaggtgatcgagaccatcctggctaacacggtgaaactccatctctactaaaaatagaaaaaattagctaggcatggtggcacgcacctgtagttccagctacttgggaggctgaggcaggaaaatcgcttgaacctgggaggtggagcttgcagtgagccgagatcccgccactgcactccagcctgggcgacagagcgagactccgtctcaaaaaaaaaaagaggaggagatgaggacacagacacacagagtgacgaccctgcgaggacacagtgagaagatggcatctacaagcctacaagagaggcctcaggaggaaccagccctgcctacaccttgatcttggacttacagcctccaggattgtgggagaataaacgtctgttgtttacaagccacccagtctatggtattctgtgatagcagcctgaaatggactaagacacctcataagaaaaggagatgaggacacagacacacacattgggacaaccctgtgaggacacagggagaagatggcgtctccaagcccaggagagaggcctcaggaggaaccagccctgcccatacctggatctcagacttccagcctccaggactgtgagagaatcaatgtctgttgtttataagtcacccagtctatggtattctgtgatagcagcctgagatggactaagacacctcataagaggagatgaggacacagacacacacagaggggcgaccctatgaggacacagggagaagacggtgtctacaagcccagcagagaggcctcaggaagaaccagccctgcccacactttgatctcacagacttccagccttcagaactgtgggaaaataaaagtctgctgtttaagcggcccagcctgtagtattttgtcatggcagccctaggtgactaatacaacaggtgtttcatcctgttcctttcctcaggtggtgttgcagagtaccccagcatctttaggtggtggtagaagagactccagcatctgccataacccccggaagagtgttctgtatgttacactgtggggaggttttcctcaaagcattagagtgatctgaacaatgggaatctttgcacagaggaggatgagttctactcggggatggtacctactaagagagacatgttgtcttctcttcaattgccctttaatgaagaaataaaaattatttaattattcggtgaagaaataaaaagagtattgcattctttcaacagagattctgcacttgtactcccaggtatttatgaaacctcatgttgatgcctggtgcataggccaggcagtggggctctacctaagtaatgcctggtggttggccatgggtagctggagcaccaatagcatactctaatagtccatgacatcggtctactcaagggccatggctcaaatagaaggctttgtttggaggaattcaaaagaggttctactgagaaggaacctatgaatcagtgctgctacaatacttttggattgtgcggttcaaacgccatattggttttcttccagctctccagctccagcagcactgaggcagatctgagtttctcgaagctgggcccatcaccaacaagacagtgatggtgaaagcaatgatagaagaggtcgaatttagagtaaggatcaggatggacaggtgggtacatctatgcaaccctaacctttctgaaactactaggcatagatattttcctgaagactagtctcagcctgcatggatggtccctcatggctactgtctcatttgaaaagtgaacctatgaaaagaggaaaacactatgacatccaccactgtttggtcacaccaattcttgacattaactctctcgaaggacattagtatgaccttcaaatcctagcccgcaggaaagcttcactttagttgtttgtttcctgggtgtcccttcctacaacccacgaagcaaatgccacacaccctccttacatgcataaaacagtgctgataatggatgaaacacacaagtatcagctcatgcctgcactttcagagaaaacactcttgcttagaccatgggtatgtcaagctgccaaggatacaaaaggtaaaacaatccaagggcaacagatggttcatgacaaagaactaagagggcagcactgcgattccaaaaatttggatatggacgtcaatgagagtgaatgagagagaagcagagagacggcgggggggggggggggggggggagggagggagagagagagagagagagagacagagagaaaggaaggaggaggaggagaaaggaaggaggaggaggtgaaagaggaggaggagaagcaggaggagggggaagaggaggtgaaggagaagggaaaaaaaaagtagaaggggccaggtgcggtgtctcatgcctgtaatcctagcactttgggaggctgaggcaggtggatcacgaggtcaggagactgagatcatcctggccaacatggtgaaaccccatctctactaaaaatacaaaaattagctgggcagggtggtgcatgcctgtaatcccagctactcaggaggctgaggcagaagaatcgcttgaaccggggaggcagaggttgcagtgagctgagatcgcgccacggcactccagcctggcaacagagtgagactccgtgaaagaaaaaaaaaaagaaaagaaaagggaagggaagggaggggaggggagggaaggggaggggaagagaggggaagggaaggaaagggagaaggagaaggaggaggagagaaagggaaggagaagaaacgaaagaagatgaaggagaagaaggagaaggaggaggagaagtaggaggagatgaggggcaggagaaggaggggaaggaagaagtaggaggggaagaggagggaagagaagaggaaagaagacagggagagagaataagagaatgagaaagagagaatgaaggagagaataaatgaaagaagagagagatgagaaaacctacttgtgaaagaggcctcagtagaagaaaagagaatgagcaaagagcctggtccaggccactctaaatgtctctcaaatgttaaagactgatgaaggaggagcaggaagacttatcacacgtccaaggagacaatgttgagcgacccgcaaacttagcagaagggagaacaggctctggagatgtccagtaatggggtagagcccagactcccacacttggtagttgtacccttcaacctggagaggcctcagttttctcatcagtgaaatgggcccaagaatagtatctatctcaagaaaccattttctctgctccttcatgagaagaaactcctcttccattccagttttatcatgagattacaggagttcagccccatcttcaacctgcacctttacttctgctattttcaccatagcagaagtgacttcctccactgaagtcttgaaccccctcaatgtcattcatgaatattggaattcactttttcccgatttctgttaatgtggatatcttaacttcctgccatgaatcaccaaggttctaaatggcattcagaatgaggaatcctttcaggaaggttttttggttttttttttttttttttttttttttttgagacggagttttgctcttgttgcccaggctggagtgccatagcgcgatcttggctcactgcaacctccacctcccaggttcaagcgattctcctgcctcagcctgccgagtagctgggattacaggtgcccgccaccatgcccagctaatttttttgtagttttagtagagatggggtttcaccatgttggtcagactggtctcaaactcctgacctcaggtgatccacctgccttggcctctcaaagtgctgggattacaggcgtgagccaccacgcccggccctgactcgaattttgaaaaaagttctactctgggtaaaaccctatcaaacagcatcgcttgatacagaaaaatctttcatgacagaaagggtcaactgatgtgacaaacatcactgttgtctattttaagaaattgccaaagcaccctctaccctcagcaaccaccaccctgatcagtccacagccagcaacattgaggcaagactctccaccagcaataaggttttgactcgcgaaatgttcagataattgttagtattgtttaccaataaagtatgcttaaattaaaaaatatatatcgttggaatggtgtatggatacaccacaaaacagtcttagcataatgctcaccattcactaagtgctcaataacgacattattaactttgccaattcctctgtttattgctcagaaggatgatgcatttgtcaggagaagcaaagaaaaagattcttgaaaagatcatggtgacattgctgaaaggtcggggagaaaacacaaacagactgaatgggtcctgtgaagctcaagggtgtgggtagctcgtaagaaaggctatgagcagagattacgctggagaaatatgccaggaagggaagggaagggatggtcagaagctagttagtgtgtgcagtgatattttcacaatgcttttgaaatcagcgtgttaattggctaaatgagccactggctggatgacagtatgtgagcattagctgctctatgtcagctgggattctaggaaaacagattgtgccaaacatttggatatccagaggaggcacaacaactgtgcattagaaataggacttatgtttcccacccaactacctctctctggggcctgacctgccgtctaaaaacagtccaccccaatgcagcctccagtcactctgccaggtattgacccagagtcttgattctatgcaacaaataagatctttgcattttaacccattgagttttagtaagaatcttcgacaagaagatttcttccagagaaccaaagcaggagttgcaagattgcaaagggcacactgaggtcttaaatatccatctgatttggccaggaatgtgatcgatcaaaaactcaggaattttcctggtcatcgttgtctaacgtgtattcagaatgtactctgcggtgagtaccattttacgaaaagactcactggccaagactatgggcgtgaggtaactaacaatcagggggcttggtttcattttgttgaaaaaaagttcaacaaagacatccacaaagaaataggtgatgggcctttgcctactcatttctttgctcgttttgctatttacccattcccctgttttcttgccctgtaaaatggacacaatactcaagcttcccattggtgtcaatgtttacattcacgatgggtaaaaaaaggtatttcatgatttgaaaagtgtgatgcattttattcttttttataactttaacaccttttaattttttgaacgtttttgagtcatcataacacatagcttaaaacacatacacacgtggtgcagctgtacaaacatgtatttttttaaacttgtatgttagattcgggaggagtccatgtgcaggtttgttgcacaggcaaattacgtgacatgggagtttggtgtacagattattttgtcacccacataatcagcacaatatctgatatgcagtagagacagagtgccactctgccgcccaggcttgagtgcaatggtgcgatcccggctcactgcaacctccgcctcatgggttcaagtgattcttgtgcctcagcctcccgagtagctgggattacagatgcctgctactctgcctggctaatttttgtatttttagtagagacagggtttcaccatcttggccaggctggtctcgaactcctgacctcgtgatctgcccacctcggcctcccaaagtgctgggattacaggtgtgagccactgcgcccggccaataggcagctttttaatcctccctctcctcccacccttcaccctcaagcagaccccaatgtctgttgttcctttctttgaggccacctttactcaatgttgaacttccaattataagtgagaacatgcgatatttgcttttatgttcttgtattagtttgctaaggacaatgatctccagctccatccatgttcctgcaaaaaataataagatcttgttcttttttacagctgcacagtattccacgacgtacatgtaccacattttctttacccagtctaccactgatgggtatctagcttaattcccatgtctttgctattgcaaataatgctgcaatgaacattcatgtgcaaaagtgtctttacggtagaataattggtatttctttaggtatgtacccaggaatggttgctgggttgaatggtaattctgttgttttaactcaaaagtatgctttttttttttgagacacagtcttactctgtcacccaggctggagtgcaatggcatgatcttggctcactgcaacctccacctcctaggttcaagtgattctccctgccttagcctcccaagtagctggaattctaggcacctgccaccatgcctggctaatattggtatttttagtagagacggagtttcaccatgttcgctagactggtctcgaactcctgacctcaggtgattcgcgtgccctggctgggattacaggcgtgagtcaccggacccagccgcctattttctttctttaagagataaggtcttggtctctcagccaggctggagtgcagtgatttgagcacatctcactgcagcctcaaactcctgggctcaagtgatcctcccgcctcaacctccccagtagctgggaccacatgtacacaccaccatgcccagctatttttgaaaaatttttgtagaaatggcatcttgctgtgttgcccaagctgctctcaaagtcctgagctcaaaataatcctccatcttctgaaagcattgcgattatgggtgtgaagtttctttgactttaatattttaacttaatttataacagtatttttgaataagggactctatccatcactatttaattctataattgtatatatttgcaggcccctccaagcctttgtgaaccctgaatatctgagatggtgtcagttaatttagaaagttaagtccgggcgtggtggctcacgcctgtaatcccagcactttgggaggtcgaggcgggcggattgtctgaggtcaggagctcaagacaagtctggccaacatggtgaaactccgtctctactaaaaatgcaaaaaaaactttagctggacatggtggcgggcacctgtaatcccagctattgaggaggctgaggcaggggaatcgctggaaccagggaggtggaggttgcagtgagccgagatcgtaccactgcactccagcctggacaacagagtaggactccatctcaaaaaaaaaaaaaaagaaaaatttattttgccacagttgaggacgcacccatgacacagcctcaggtggtcctgacgacatgttcccaaggtggtcagggcacacgctggttttatacattttaggcagacatgagacatcaatcaatatatgttgagaggtacactggttccatccagaaacacggggacgactcgaagtggggagggggcttccaggtcataggtggataagagacaaatggttgcattcattatttttttggggtgtgtgtgtgtgtgtgtttagacagagtattgctctggcaccaggctggagtgcagtggcgcgacctcggctcactgcaacctcagcctcccaggttcaagccattctcctgcctcagcctcccgagtagccgggactacaggtgcccgccaccatgcccagctagtttttaaaatatttttagtagagatggggcttcatcatataggccaggatggtcttgatctctttacctcgtgttctgcctgccctggcctcccaaagtgctgggattacaggcgtgagccaccgcacctggccaggagtaactttgaataaaacgggaggcaagtttgctctgagaagttcccagcttgacttttcccttgagcttagtgatttggggaccccaagattttcctttcaaaccttcttaaattattgttactgtcactatgcttccatctttcatgaacttaggcgacatccatggaggtatcatttgcagattcaaagtagctctttcaacttctgagtcatggagcacagtgtctttaatatcatgcttttgtttttgtttttgtttttttgttgtcgttgagacagagtcttgctctggtaccagggagtgcagtggcgtgatctcggctcactgcaacctccgcctctcaatttcaagccattctcctgcctcagcctcccaagtagctgggactacaggcgcccgccaccatgcccagctagtttttttgtacttttagtagagacggggtttcaccctgttgcccaggatggtctcgatctactgacctcatgatccgcctgcctcaccctcccagaatgctgggattacaggcgtgagccaccacgccagactgcagtagtgagtcttagtcactcactgtgaagttccctgcagtttctttttcaaaagcattttgctgtggataacgcattctcattacgtcagacatctgcagtaacatttatctagcaacaaggttaactgccttcacatcaacaaaaacaggttgtgttgccagcaaagaagaatgccagttctcttttccatcccataatacttgtcatcagtactggggtatcctgttcaccttctcccatgctgtgagattaatttagagaacatattcacggtattttgttttttgttttgttttttttttttgagacggagttttgctgttgttgcccaggctggagtgcaaaggcatgatcttggctcactgcaacctctgcctcccaggttcaagtgagcctccagaggaagcacagtactgcccacatcgttatttcagacttctggtctccaggactggaaaagaataaacttgttgtggctttaagacttccaagtgtgtggtcgtttattacagcagccctaagatagatagatagatatagatagatagatttattttactttaagttgcaagatacatatgcagaacatgcaggtttgttacataggtatacatgtgccatgctggtttcctgcacccatcaacccgtcatctaggttttaagccctgcttgcattagaaatggggtttcgccatgttggccaggctggtcttgaactcctgacatcatgatccacccacctcggcctcccaaagtgctgggattacaggcgtgagccaccgcggctgacctttattgctctttctatgtaaaaccagaaaagccaacaaagctatttcccgtaatgacatgcccaagtcctaacccccaaacaccgtgaatgtgaactgatttgcgaatagggtcttggtagatgcattctcgttaaggatatcaggacaggatcatcccaggttcaggactgatggacacttcaaactttcattctatattctttcacacgagtagtgttgtttggctctgagaagcactttcatttttatttccaggcaatttcatatcgttctcttcaattcagtgagtgcaaaagaagcaagacagggagtgatataaaattactgctaatagaaaattcacttttaatcttgcttaaaacaagtttttttgttttttgtttttttgtaaaatgaaggagagagctgaacttcaaggatgcgaatttatttccacacaggggagaaacactgattggagaaaatttacagttgctgtttagacacttgagcctcaggatcgagaaaaggtgcacctcttagatgggccttaaattggagatgatgatatctaaccacctggagacgggaaagtaggtgtcactcaatgctgaacggtgctactcatctgtgagattgtataatgaagttttggagactgagcctgtaccttcatctgttctttaaccaatgcacacttaacaagcacgtcatgtttagctgctcagcagagcttccttcttcagaaacagagacggggtgcggaggcattttacaacccagggggctccagcttcatagactgtcttgtgaggatctatgctgttactctgaggatcagcgttggttttccaagtccttcatgaacataacaagtcaatgataagacgacaagttccaccgctgtgcctcagctgagacaaaaaaaaaaaaaaagctggaatcatttagaaataacaatcccaggccaggcatggtggctcatgcctgtaatcccaacattttgggaggccgaggccagcagatcacccgaggtcaggagttcaagaccagcctggtcaacatggtgaaaccccgtctctactaaaaatgcaaaaattagccaggcatggtggtgcgcgcctgtaatcccagctacttgggaggctgaggcaggagaatcgcttgaacctgggagatgaaggttgcggcgagccgagacagtgccattgcactccagcctgtgcaacagagcgagactctgtttcaaaaaaataaaataaaaatagaaaaaggaagtcacactcacaaccattctacaagcaggagacccagaatattttgctttagaatctacaggctctgctttaaaattcctcctctcccaaactcaggttaaaatgtaagcctcagtgctggatgggaggtcgaatgggaggggtttgagcaacggacgatggattcttcctgaagagatcaatgtcctttcttgaagcatgagtgagtttttactctatgagttctccacaggctggttgttaaatagagcctggcgtctcccgtctgtcttccctcctgtctcttcgtgtggtctctgtacacataccagctccccttcccgttccaccatgagtggaagcctcctgaggtcctcagcagagacagatgctggccctgtgcttcttgtacagcctgcagaatcataacccaaataaacctctttcctctataaattatccagcctccagtgttcctttctagtgacacaaaaccgacgaagacaccccagctctctctaccatggggtatttatgtcactagtgatgaccgtcctgacaaggggccagccctgcagttcccacgagaccacctacttcccactccccatatgagctcagaaacttccggaagctggtacactcatggaatgataatccatataatttccgcaacgagatgtgatgtagtatcatgcttacttaagtgatcctgaatatactctttttgtgtgtttttctttaattttccataacttattgggttacaggcagtatctggttatataagtaagttctttttatttttttctgagacagagtctcgctctgtcagccaggctggagcgcagtggcatgatctcggctcactgcaacctccacctcccacgctcaagcaattctcctacctcagcctcccaagcagctgggattacaggtgtgtgccaccaggcctggctaattccttttgtatttttagtatagacagggtttcaccatgttggccaggctggtcttgaactcctgacttaaggtaatccgctcgcctcagcctcccaaactgttgggattacaggtgtgagccaccacatccgatcacgagtaagttctttagtggtgatttgtgagattttggtgcacccattacccaagcagtacacattccacactatttgtagtcttttatccctcgctgccccctcccaagctctccccaagtccccaaagtccattgtatcattctcatgcctttgtgtcctcatagcttagcttccacgtatcagtgacaacagacgatgtttggttttccattcctgagttacttcacttagagtaatagtctccaaaggacatgaacttgtccttttttatggctgcatagtattccatggtgtctatgtgccacattttctttatacattctatcattgatgggcatttgggttggttccaagtctttgctatgtgaatagtgccacaataaacatacgtgtgcatgtgtctttatagtagaatgatttataatcctttgggtatatactcagtcatgtgattactgggtcaaatggtatttctggttctagatccttgaggaatccccacactgtcttccacaatggttgaactaatttacactcccaccaacagtgtaaaaccattcctatttctccacatcctctctagcatctgttgtttcctgacttttaataaagctggaaaccattcttctcagcaaactaacacaagaacagaaaaccaaacaccacatgttctcactcataagtgggagctgaacaataagaacacatggacacggggaggggaacatcacacactggggcctgtcgaggggtggggggctaggggagtgatagtattaggacaagtatctaatgtagatgacgggttgaggggtgcagcaaaccaccatggcacatgtatacctatgtaacaaaaactgcacgtcctgcacatgtaccccagaacttaaagtataataataaaaaaagtaatagtctccagtctcatccaggtcactgcaaatgctgttaattcattcttttttgtggctgtgtagtattccatggtgtgtgtgtgcgtctgtctgtgtgtgtgtgtgtatatatatatatgatgtccatcaatatatacaatgtccaatgttctggagtccacagtcagtaatgtccatcaaggtacatacacacgttcacggacattattgcctgtggacatcagaatcttgacccacacctaggaaatgactgcattcaacgtcaggcgactggactccccgccagacacccgccattgagaacaaataataaaagccacagtcttcaccttgcaaattgatatttggacttttgtcattcaaggatgctttcaatggttcgtgtctactaggcttgggagaaagataggctcgtgagaggagacatcagacaactggcaaatcagaggtagatgaagcaacaaaaggaaggaaaaagagtgtggaaataccagccaacgagctggtgttcccaatgggacctatgaaaagatgttttgcaggtggagagaagaaagaggagacgcaagcatttgagctgagcaacgaatattgcctgcattgcggaggaccaagaatggacaatatcaccaggttagcctcctgggaaatgctgcacgggtggcaggttcagcaaatcaaggcagggggagaaaatggctgccgctctctctccagtttgcgatcctgggaagttagggtgcacgggtttactgggctttgatttcctcagaggactggttttacttacacacagcaggaagccataatacaaggggctcttttcccaccacaggcatcaagctgaatcaccgcacacgcttgcattccagactcatgttctccagagcttacaggttgggatgggaccactgtaacccatgaccccaaactagggagcttacaaaagcagccatttaacctctcccagtcctggagactacatctgtgaaatcgaggtgcctacagggacatgctccctgctctagggaagaattcttcctgcctctcccagctcctgggggctccaggcatccctgggcttatggccgcatcactccagtctctgcctccgtctccacgtggccttctcctctgtgtctgtgtctcctcttccgtctcttacaaggacacctgtcattagatttaggatccactgcaatccaggatgatctcatctccagatccttttttacatctgcaaagaccttatttccaaataaaaaatcacatgtacagattcaaggtgaacttgtcttttttttttttttggtgggggtgggggtaaaatagaggcaccattcaatccactacaggggttgagaagaaataaaatattacaaaatgctccctgataagaaataaaatattacaaaatgcttcctgaatgtgatttagaagtttttttgtttgttttgttttgtttttaaatggagtttcactcttactgcccaggctggagcgcaatggcgtgatgtcagctcaccgcaacctctacctcctgggttcaagtaactctcctgccttagcctcccaagtatctgggactacagatgcccgctaccactcccggctaattttttgtatttttagtagacatggggtttcaccatgttggccaggctggtttcaaacccctgacctcaggtgatctgtccgcctcggcctcccaatgtgctgggattacaggcgtgagccacctcgcccggccgatttagaagcttttgtttgtgggcgtgaaggttcagtaagagcttcctctagtccttgtcaagatcaaaattaaaggcattataaacagagatgcctatctgtcggccacatatccagaaaataaatgctgagatgagaattctggtttctgaataggagtctgatatctgcatttggtgttgccaaagcaagccctgacttctctcttctctcattgagacagagcacacaccctcactccttgtgtctctgagtcacatgtatcgggccatactcacctgatacctcacggattgtcccggggctagttctatttctagctcctgggcaggacggtgaccatgagttcgacggtgcccagcaagcccatctggccagcacttatctgcctttgggtacagcctgccctttctcccaagtgtctgagcataaaaatagcccaccatgtcaaccccgcagatgacaagcatgtgagtggctagtttctgcctgagaactctcccgaggtctccctgaacactcacggatgcctgggctggcccaagatgcagcagtaggtcactgacagactctcttccatttattcacagtttccatgattcccacgctcatagcatcgacataacaaaagcaaagttaagctacagactctgctcccgccccaacctctctaatagctgctaacagagccaatggattgtttttttcaacttgcaacttaaacacaactttgccttctccctgagtcttttaattcaaacattcagtcattctccatcaggtacgcacaggagatacaaaatcaatatgataacggtcttcaggttgtgggtgacagagcgggagcatggccatcttgaacaaacaccaccattctaggctccccttgattaaaaaccgcctaaatccagcccgaaaacatcagcctcatgactcatgtcagcataaccagaaacattccaaccctaagataaacccgtctccgaccaaaaacataccaaccctgagacagcctcccctctgaccagagatattcaaccctgcaataaactctccctcacatacaaacattctgaacctatgataagcacccccttccaaaacccttaaatgtgcttagtctataagagagaagagctctgacctaactcagccagaagcccctctcaggtttctctaaaataaacctgtgtttaactgtcaagtgacatttcatgcttctttcctctttaattcttacagtgagtgtgtagagcacgcttgacataagtgactccaccttagaaaaagattccatgttacatttcattcaaaaggcatcatgcctacaggagccagatgttcacctgatcaataaagaccacatccaaacagttaaggacacaaccaaacaccctcttccattgtcaatcctcaccagaggactctgtggtcatgaaagaacagggcttcagcagctccaaatggctaccttaacagatgccatcttgctgtcacttgtaatcattacgcagcatccaccgcaaaaggctctgccccactgatatcaaaggctcttccttgcaagatggcgaccactgatggccctccagggccaggccaggagacttttttttgtccacatcaatatccctgtgctcctttgttaagctttttcctaccccttttctcttgatgataaatgttacgttgtttgatgtagaatgtttaatctataacatgcatatattggtgaagtgtattagtatgtataggttgcaatactgactgacttgggtcacagcaggagcctgtgcgcctgtagctctgactaaatgctgccggcacacaggctccagtactccaagggctcaagccatttcagtactaaatgggaagtcctaaggagaattgcctccttgaaaactccgtgcatcttggggcttctgtaaactgaaatagcatcaataaaaggctgaacttgtgaaaagacacaaccatacatgggcctggttttctatctctgaccttgcaccactcatgagagcgggctccagcaagccagccagcaggaaagacagaaaaggtgaaaactgattcaacaaaggaaggatacttgagctagattaaacattttattacattttctctgaatttttagcccatcatcacgggtcattagagaaatgcaaatcaaaaccacaatgaaataccaacttatgccagttagaatggcgatcactaaaaaagtcaggaaacgagagatgctggagaggatgtggagaaataggaacgcttttacactgttattgagagtgtaaattagttcaaccattgtggaagacagtgtggcgattcctcaagaatccagaaccagaaatactatacgaccacagactggataaagaaaatgtggtacacagacacaccatggaatactatgcagccataaaaaggatgggttcatgtcctttgcagggacatggatgaagctggaaaccatcattctcagcaaactaacacaagaacagaaaagcaaacaccacatgttctcactcataagtgagagttgaacaatgagaacacatggacacagggtggggaacatcacacaccagggtctgtcagggggtcaggggctagtggaggtatagcattaggagaaatacctaatgtagatgatgggttgatgggtgcagcaacccaccatggcacatgtatacctatgtaacaaacctgcacgttctgcacatgtaccccagaacttaaagtatataaaaagaagcatatatatatatatatatatatatatatatatatatatatatactgtatttatttaataaaatttcaaattaatgatgtaaaaattttgaattttataaatttgaatatgacttggcctgtgacagagacagaggccacaagacccctgcagtctaccctataccctgctgccacagtgacctccctaacatacacacctgatcacaagtcccctcagagcagcttccatggcttcccctgcctcttgaaatactgcccaacttgtgttctgtctgggtactcttgttctgaggcacccttgatccttgattttataagtccacttggctgagccatggtgcccacatatgtgattaaatgttcttctgggtgtttctttgaggttgctttaaatgagataaatatcgaaatcaggagactttgagtaaaggaattggtgggtaggcctggtctaatcagttgaaggtcataatagaacaaaagactgggctgggtgcagtggctcacacctataatcccagcactttgggcagctgaggcaggtggatcatctgaggtcaggagtttgagatcagcctggccaacatggtgaaaccttgtctctaccaaaaaaataaaaataaattagctgggcgtggtggtgtgtgcctataatcacaactactcgggaggatgaggcagaagaattgctcaaacctgggagatagaagttgcattgagccaagatcgcaccgagatcgcatcgtaccccagcctgggcaacaagagtgaaactctgtctcaaaaaaaaaaaaaaaaaaatctaaatcagtacactttgagtaaagcaatttgtccttcctatggtgggtgggcctggtccaatcagttgaaggtctgactagaacagaagactaatgttacctgagccagaagggattctgccaacagatggactttggactccaactacatcatcagctcctccctgggtctccagctggctggtctaccccatacatcttgagacttgccagcctccatcaccatatgagcaaaattccttaaaataaatgtgctttctatcagtacacacatcatattggttctatttctctgcagtatcttgactcagacacacagttccctggttctgcggcacccacctcccgtggtatccttgttctgtaagaaattagtaagttttaggtgaacgccaaggaggaatttcatccaggaaagctctttgcctccttgtagacccgatgaatttctactcactctctaaaatttaactcaaatacatgtattttctgataatgtttctaactctatgagcaaaaccaggcatctcactccatggcatctggacacgcagctacagaggtgcatctgacatgcccgagttgttatgtaccatcttcccctgactgtgaatctcttaggaatgacatccataaaaatgcaatgtgccatccaggatttaatacgtgctcaaatattgccgagtgtggtttttctcgtctctgttttcacagtccaggctggcaccatttctctgcaaatcagtgtatttttcacccacctgattttcctgcccccagcctcccctcccacaaggcgccttgaagctgctgtcaagctcaatctcctgaagatagcccaaatccttcccgcagcctttggaaagcctcccatagcttcttctcacagcaaatctaagtaaactacaaggtgactcccatgttcccctccccatttttcctgtttgtagggatgttgtatgagtctggttttttttttgttgttgttgtttaatactttaagtcctggggtacatgtgcagaacatgcaggttacataggtatccatgtgccatggtggtttgctgcacctatcaacccgtcatctacattaggtatttctcctaatgctatccctcccccagtcccctactccccgacaggccccagtgtgtgatgttcccctccctgtgtccatgtgttctcattgttcaactcccacttatgagtgagaacatgaggtgtttggttttctgtccttgtgatagtttgctgagaatgatggtttccagcttcatccatgtccctgcaaaggacatgaactcattcttttttatggctgcatagtattccatggtgtctctgtgccatattgtctttacacaatctatggtcaaatagtatttgatatagataaggatggataaataaagtataagtatgttttcatgctgtagataaagacatatctgagaatgggcaatttagaaaagaaaggtttaactggacttacagttccacgtggctggggaagcctcacaatcatggtggaaagcaaaaggtgaaaggcacgtctcacattgtgacagacaagagaagagagcatgtgcaggaaactcccctttataataaccatcagatctcataaaacttactcactatcatgagaacagcagggcaaagacctgcccccatgattcggttacctcccactgggtccctcccacaacaggtgggaatacaagatgagatttggggccgggcgcggtggctcacgcctgtaatcccagcactttgggaggccaacacaggtggatcacctgagctcaggagttcaagaccagcttggccaatttggcaaaagcccgtctctagtaaaaacacaaaaattagccgtgcatggtggcgggcacctgtaatcccagctaattaaaaggctgaggcaggagaatcgctggaacccaggaggtggaggctgtagtgagccgagatcatgccacggcactccagcctgagtgagcgagactctgtctctaaataaataaataagatttgagtggggacagagccaaaccatatgagatgtaatgagctgtacattttcccaggcatttaatgcctttttgtttttcagttgccataatgcggtgtccagcaacatacggtacatggatgtcatacatgggacatgtaaaatggtagcatccatctgcagttagactgtaggctccctgttggaaccaccctgctcgtggacaatcactgctgtcttggtaatgaacaccccctacatatctgcttcactatagagctgctgcctccagaaaccccatacacccatgcgttctggcagtgccaacggctggaaattgctgcccactcctcagccaaacccacagtcaggcagggaacccaagccaggccaattgggtccctgccttgggatagtccaacgtaacataagaaaaagacagtgtgttagtattataggcaaagcaaggcaaaagagaatagagaagcagctcgggtaagagactaaagcttctctgcaggaagaggagaccccagagataggaagctggcatcctggaaaggttggactctgtgttctggcctctgagaagaaagtgatcactaagcttggtgcagattaaacatagaagcaaaggctcttctggcttaagtggatcaagctggggtcagtcgcttgcagccagggttttgatgcatttgttcgttctctctggatggggtcagtccctcgcagccagaattctgaggcgtgcgctcctattgtctggatgtgtggggttttatttactttctttcaaaagaaaagtagatagaaaggctcaaaaggatgggggcaggggaaagacctcccagcaataagaaagaggtccaggcagcaaccatacaggaagaagcaaaaatgaaactggaaagtcagaatgaaaaactgcccaatgtctgctatattattttcttgttttgcaaagaaaggaggtccaaagcccttgtgggtctcttatttttattttttttttttttattttgttttgttgagagagcctgttgcccaggctggagtgcagtggcacgatctcggctcacggcaacctccgcctcccaggttcaaggtattctccctcctcagcctcccacgtaactgggatttcaggcacccacgaccacactcagctaatttttgtatttttagtagagacgacatttcaccacgttggccaagctggtctcaaactcctgacctcaggtgctccgcttgcctcagcctcccaaagtgctgggattacaagcatgagccaccgcgcccggctgtgggtctctttttgcacagctgggacagggaagaagaaaacttgtgttcctctgccactgtttcctgcagaaatgggtgaatacagtaaatggtacggacgttcctcaaaaaaattaaaaatagaactactcgatgatccagcaagcatgcttctaggtatttatccaaaagataaatcggtctatgagagacatttgcacccccatgtttatggcagcagtattcacaatcaccaagatatggaatgaacccaagcgttcaatagatgaatggatgaagaaaatgcggtacagctgggtgcggtggctcaggcctggcgacagactgacactccgtctcaaacaaaaaaaaaagaaaatgcggtacacgcacacaatgggatactatgcagccttcaaaagaaggtagttgggccaggcgcggtgcctggaatcccagcaccttgggagactgaggcgggtggatcacttgcagttagttaggagtttgagaccagcccagccaacatggtgaaaccccgtgtccactaagaagtacaaaaattagccgggcatggtggcaggcacctgtaatctcagctacttgggaggctgaggcaagagaatcacttgaacttgggaggcggaggttgcagtgagctgagatcacgccactgcactccagactgggcgacagagtgacactcagtctcaaagaaagaaataaagaaaatgctgtaaatacacacaatgggatactttacagccttaaacggaaggtaattgggctgagcaaggtggctcacgcctgtaattccagcactttgggaggccgaggcgggcggatcacgaggtcagatcgagaccatcctggctaacagggtgaaaccccgtttccactaaaaatacaaaaaaattagccaggcgtggtggcaggcgcctgcagtcccagctactcaggaggctgaagcaggagaatggcgtgaacctgggaggtggagcttgcagtaagccgagatcgcgccactgcactccagcctgggcgacagagactctgtctcaagaaaaaaaataaaaaaagaacgtaattggccaggtgcagtggcccacgcctggtatcccagcactttgggaggctgaggcaggcagatcacttgcagttagttaggagtttgagaccagcctggccaacatggggaaacaccgtctctactaagaagtacaaaaattagccgggcatggtggcgggtgcctgtagtctcagctactccagaggctgaggcaggagaatcatttgaacttgggaggcggaggttgcagtgagccgagatcacgccactgcactgcagcctgggtgacagagcaagactccatctcaaaaaaagaaagaaaatgcagtacatacagacaatggaataccacgcagccttaaaaagaagggaattctgtcatttgccacaacatggatgaacctgggggatgttaacgtgaaatacaccagacacagagagacaaataccgcatgatgtcactgacatgtagaatctaaaatagtcaaattcacagaagcagacagtagaatgatggttttcagaagatgaggagagagggacgtagggagatgctgttccacaagtataaggttttggtatataacatgaatcagttctgcagtctgggtacaactgtgcacaccacagcagttgtgcctagagttaacaagaccgtattatacatgtaacactttgtcaagagggtggctctcatggtaagcgtttgaccgtgataaaataaaaatttcaacacgtatgtttattgcaatactatttataacagcaaagacttggaaccaacccaaatgtccatcaatgataagactggataaagaaaatgtggtatgtagacactatggaatactatgcagccataaaaaaggatgagttcatctcctctgcagggacatggatgaagctggaaactgttattctcagcaaactaacagaggaacagaaaaccaaacactgcctgttttcactcataagtgggagttgaacaatgagaacacatggacacagggaagggaacatcacacaccggggcctgtcagggagctgggggcaaggggagggagggcatcagggcaaatacttaatgcatgcagggcttaaaacgtagaagattggttgataggcgcagcaaaccaccatggcacacgcacacctatgtaacgaacctgcacgttctgcacatgtatcccagaacttagagtaaaattaaaaagaaagaaagtcaaagacagttttgtaaatgttcggctacatcgtaacattcaaaatgagactggccaactttccctatctgctttgatgagtccatcagaatacttgtaatatgtggactaagtctttaaataaaaacacctgcttataaatatgcctgaataacatgagctctggcacttgtcagcctcagacaggtcatgactcagtaaaggatggaacacttccttgctgacacagacttggagattgagaaagcaacacaggccacccaatgggagaaagaggacatggtacagtgaaaggccagtgtgctggacatggggagggccatgctatgcactctggtgtctggattaaccactgggaccagccctgacttcctgcatggctgaagaggaggctgatgatgcattgggagttggcatcctggctctcagtgctggaaccctggaccacctgggtgagactaccagactgagagccctccctgcccttactctgtcgcccaggctggagtgcagtggcgcaatcccaactcactgcaacctccacctcctcgattcaagcgattctccagcctcagcctcctgagtagctggaattacagatgcccaacactacacccggctaatttttgtatttttagtagagacagggttccaccataacagccaggctggtctcaaactcctgacctcaggtgatccacccgcctcggcctcccaaagtgctggggttacaggcgtgagtcaccgtgcccagcctggaacatttgttgtttcaataaacagctgtgcatttttgccccctaaaagcaccattggacaaccacaatcccaggcctgatgctggcagtcataggggatcagatgtcctcccgtattctctatccacaaaacaggaagcttagctgatgactcctggaggcacactcaaccctaaactatgatataatcctgcaggaaaataaatggtatcccaagatgttcagtatgaaaatgcatgtggctttgtgggtattttgcaaagaagcgaatgggatagtatctgttttcttcactacaatctcagggaatgactcatggaaacatcagtgatccgcaagcagattatggttaaactaaaactcctacgaggctgtctccaaaaacttgagctatctgaggtgcttcatcaacagaggtgtgaaaataccgtcctacttgccgggctgagggcctgggagcttacgggtgactcagctttgcttagtatcactgctcaccatgcgacaattctgtgaagttcttcagacatgcaggatcaacgcacagtgttacagatcatctgacacttcttcctaccaacaagtgtctgcaggcgtagctgctgggctgccttgctggaacttatcagggtggaaactctttggggtgagaataccacgtttcggcgtcttcaggggatacagcagaggtgtgttgaatgctacggtgatagctacaagcacaggcaaaggctcctacagcaaataaaacagacctacaagaccagccacagtagatgaagggctatagggaccagcatgggcattcggaccagcacgggcattgagaacagcagttcagcttaagccacaaaacttcaattctccttaaaatctacaagagtccatctgaaccaccaaagttttggccaaacccaagaccaagagtccaaaaccaggctggacgcagtggctcctgcctgtagtcccagaactttgggaagccatggcaggcaagatggcttgagctcgggagtttgagaccagcctgggacaaatggcaaaacctcatctttacaaaaaaaaatacaaatattagcagggcatggtagcacgtgcctacagtcgtagctactcgagagactgaggtgggaagattgcttgagcccggaggcagaaattgcagtgagccaagactgcactattacacttcagcctgggcgacagagccagaccctgtctcaaaaaaagaaaaagcgtccaacaccatcttcctgaagccatgtgtatgtcagtagaagaaaccttcaaccccctagagaatccaaaggggagtggggaactcaggtgctgtcctcatttaccccgaaatgaagttgtgcaggaaaaaaagaaaaaagcgtccaggaattcagaacatgcttattatcctagtgagacccaaggttccatttgctacagaagcctatgaaataattcctaggacaaagggtcactaagaagtcattcatcttttgggtaatagttgaaggagtcagaagacagtcacaccagtagtttagggaaggattatagctgattgcattttttttttttttttgagatggagtttcactcttgttgcccaggctggagtgcaatggcgcgatctcggctcacctcaatctccgcctcccgggttcaagcgattctcctgcctcagccccctgagtaggtgggactacaggcatgcaccaccacacccagctaattttgtttttttttagtagagatggggtctctccacgttggtcaggctggtctcgaactcctgacctcaggtgatcctcctgccttggcctcccaaattgctgggattacaggagccaggcctacacgtggtttttaagggccagcaaattatatgtatgcacacacctcagtttggaaggagaatgactgagtaccagtgggataccaggagagcccaggaagaaggcagcgtatcccttcacaagcccctttccatgacttttctacatgactccagcaagactatgctggggaggaggaggagacacagggcctcgcctgagtatgggtgctgacttggtgcaagaagagaagggtaggcatcgtctcctggtggccattcccaccctggaatggctccaacccaatggagcggagctctagtggttccagccactggaaacaccagacgtagcacaacaataatgaactgttgttggacggccatctactccagatgtcccatcactgggcagctgtccactggggccaagtcatcactggatggccgtccacttcggctgcaccatgttcctggcctacagcagcatggaacacgccactgctgggatgacaccagggattccctcagcttagagagcaggtgctcacagacaggggtcatggacagcaatcactacccacagcctccactccctgcccatccatcttttttgtttttgtttttgagatggaatctcgctctgtcagccaggctggagtgcagtggcgcaatctcggctcactggaacctctgtctcccgggttcacaccattctcctgcctcagcctcccgaatagctgggaccacaggcacccaccaccacgcctggctaacttttgtatttttagtagagatggggtttccccatattggccaggctggtctcgaactcctgaccttgtggtctgcccgcctcagcctcccaaagtgctgggactacaggtgtaagccactgcgctcggcctctgtccgtccatcttaagcagctgaagaactgaacggataaaacaaagccctcaaaaccacagacacgtgtgtccatgtctgaggtccacggggcaaggaggaaaaaagaaccaactcacgcatcctccaggggtgaagactgggcattaaaataaatgcccgtatggagggaaaatatccatcttgggactcatgggaaaaacaggcaaacacaaaaaacaggaaagtaatattccataaaaaagaaatgaagagcatcagttgaaatgaagatttatgtggggcgaggcagaaggacctgagaccactaatccttcactatctcaattatagcaagaaataggttggaaggaaaacacaaatatacagcctataaaagatacccacagaggagtaattcaggtggaacataaaagagatttaaaggtaaatagaaacgaaaagaaagtcagagtcaaaatattatcaggccgggcacaatggctcgcacctggaatccctgcattttgcgaagccgaggacgacggattgcttgagctcaggagtttgagactagcctgagcaacatagtgagagcctgtttctacaaaaaatacaaaaattagctatgcgttgtggcgcatgcctgtagtcccagctactcgggaggctgaggtgggacgatgtcttcagcctgggacgcaaaggttgcagtgaaccaagatggtgccactgcactcctgcctgggtgacaagagcgagaccccatctaaaaaaaaaaaaaaaaaaaaaaaaaaaaaaaaaagactatcattacttttaatggcaaaaacagcaattacttttgcaccaacctaatatattcatatcagataaaaaataataaattcagagcacaaaaatattaaacgtttaacaaaagggttaatgcggtaacataataagaagggtgccggaaacgagtaggagatataacatcacatcctagagaagcccggacaatagtagacagagggaagatcaaaatcaagaatgaggagactcagctgggtatggtggctcaccctgtaatcccagtactttgggaggttgaggtgggcagatcatctaaagtcgggagtttgagaccacccaggccaacatggtaaaaccccatctctactaaaaatacaaaatgtagccaggtgtggtggcaggtatatgtagttccagctactcgggaggctaaggcaggagaatcacttgaacccaggaggtggagtttgcagtgagccgagattgcgccattgcactccaccctgggcaacaagtgcgagactccgtctcaaaaaaaaaaaaaaaaatacaataattagccgggtctggtggtgtgcacctgtaatcccagcactttgggaggccgaggcaggcagatcaactgaagtcgggagttcgagaccaggcaggccaacatggtgaaacactgtcatactaaaaatacaaaatacagctgggtgtggtggtgggcacctgtaatcccagctactcacgaggctgaggcaggagaattgcttcaacccaggaggcagaggttgcagtgagccgtgatcgtgccactgcactccagcctgggtgacaaagcaagactctgtctcaaaaaaagaaaaaaaatgaatgtggagaatcatgtcaggggtgcagagggcaggcttgtggaagcgtgtagaatgtagaagaaaaagatgatgacatgaagtgattggagaaaagaacatgaaagagaaggaaaccagttgagaggcaacatccaatgttggtatctctgaagacaagaactgggagaaagagacacagaaacatagttgatccttcacaggtttggactgtacaggtcagttatatgtggattttcttctgcctctgccacccctgagaaagccagaccaacctccctcttcctccttctcctcctcagcctcctccatgtgaagatgatgaggatgaagacctcggggatgatccctttccatttgatgaatagtaaatgtagtttctctttctcatgattctcttggtaacgttttcttttctctagcttactttagtctaagcataaagtatgcaatacatagaacatagaaaatatgaatgagtgaatcacctgtttatgttattggcaagggttcctgtaaacagtaggctattaataattaagtttttggagaatcaaaaggtgcacatgggccaggcgtaggggctcacatctgtaatcccagcactttgggaggccaaagtgggtggatcacctgaggtcacaagttcaagaccagcctgaccaagatggtaaaaccccgtctctactgaaaatacaaaaattagccaggcatggtggcgtgcgcctgtaatgccagctactcaggaggctgaggcaggagaatcgcttgaacccaggaggcggagattgcagtgagctaagatcacaccattgcactctggcctgggcagtaacagtgaaactctgtctcgaaaaagaaaaaaaaagttacacatggatttttgactgtgtgaggggttggtgtccctaacccccatgtttttcaagggtcaattgtaaatggaaaggtttcgtgcaaagaaaaaaaaaatccctgagataaaaacccagatctgccattataagatgtatagtaagccatacgatttatttttaaatgcccatatgtccatcaacctcatcctgatgaaaccgtggagctttaaagatcaagagaaaatcctaaaagcatcaagggaggaacaaaaaggacatctgccaatggaaaagcaaatcaggtggaaagagctcttcgtcaatgtgagatttcagtaaggaataaagaaagagctacagagtcctgaatgacaaaggatctgaacaaataaccctagacccgatatgggaaaacgagatttgtctcaaacactttgggactcaggaaattaaaaaaaaaaaaaaaaaaaagaatcattgcttgtttctctaaaactgtgcccagacacacacacacactacagcaagctaagatttccaggcaaatcactaagccattcatagggaaagacaggcactgtgtgtcagatcaaggattcacctacataacggtggttatgaaatggaaaatagagaaacacatgtacatcactggggtgtggctaccatagtcaaaacagggtaactcttgagaaaaacatcctctctacaaaacgcttattttaaaaaactaattagagattgggacaaaaagaatcctcaaaacagcaatcagaatcaagtgatagcatgtggtggatggctagggttatgctactttgtcttcaaaaggcagaacctgttgttctaatttaatttctgaagttactcagttgagaaacggagttagctaacacttggtttaaagttacgaaagtttcaaagagcttctgcacagcccaggaaactatcaacagcgtgaacagacaacctacagaatgagagaaagtatctgccaactatgcatctgataaaggtttaatatccagaatttataaggaacttaaacaaatttacaaaacaaaacaaaaataaaaacaaaaaaaatcccattgaaagcacaccctttgccacgtcaggcaaaggacatgaacagacacttttcaaaagaagatacacatgcagctggccgggcgcggtggctcacacctgtcatcccagcactttgggaggccgaggcgggtggatcacaaggtcaggagatcaagaccatcctggctaacacggtgaaaccctgcctctactaagaatacaaaaaaaattagccaggcatggtggcggggttgagggcttgatatgtgggaggcatattactaaacaatttgattaccttgtttaacctttacaacattcttttgaggtagatcttactattcttcccatttcatagacgaggaaaatgaggcttagagaagttaactaaattgcacaatattccttagttagtaaatggcgaatttaaatccagtttggaaagacagatgtgctttgcttatgcataccttgatttctgaaaaagtgcatgtaactaaagtcaaaaaccaaagctacttgcgaggctgaggcaggagaatggcgtgaacccggggagcagaggttgcagtgagccgagatcgcgccaccgcactccagcctgggcgacagagtgagactctgtctcggaaaaaaaaaaaaaaaagacatacatccagccgacaagcctatgcaaaaacattcaacatcactgctcattagagacacgcaaatcaaaaccagaatgagataccatctcacaccagtcataaaggctattactaaaacatcaaaaaacaacagatgctggcaaggtggcagacaaaaaggaacacctaaacactgttggcgggagtgtaaattagttccaacattgtgtaagacagtgtggccattcctcaaagacctaaaaacagaaatatcattccactcagcaatcccatgcctgggtatatacccaaaggaacatcaatcattctgtcataaagacacatgcacgtgtatgttcgtggcagcacctttcacaatagcaaagacatgggatcaatctgaatgcccatcagtggtagacagaataaagaaaatatggtacataggccaggtgcggtggctcacgcctgtaattccagcactttgggaggccaaggcgggtggatcgcgaggtcaggagttcgagaccagtctggccaacacatggtgaaaccccgtctctactaaaaatacaaaaaaattagctgggcgtgggggcgtgcacctgtaatcccagctacttgggaggctgaggcagaggaattttcaagggtgcagtgagctgaggcagaggaattttcaagggtactgcactccagcagcctgggtgacacagcgagactccatatcaaaaaaaaagaaagaaagaaaaagaaaatatggtacatagacaccatggaatactatgcagccataaataagaacaagatcatgtcctttgcagaaacatggatggagctggaggcgattatcctcagcaaactatgtaggaacagcaaaaccaaattactacatgttctcacttataagtgagagctaaatgatgagaacatatggacacagagaggggaatagcattcattgaggcctatcagaaggtgggaggagggacaggatcaggaaaataactaatgggtactgggcttaatacctgggtgatgaaataatcatacaacaaacccccatgacacgagtttacctatgtaacaaacctgcacctgtatccctgaacttaaaaatggtttttaaaaattatggaagtttgaactataagaatcaaaatttccagaaggttggggtgatgaggcatgaagcttccctgagtgcaaaagaactcaccattgccacccacggcaaaaagaaaagtgacatagaagcaaaaaaaaagatacaaagcatagtaacatttattcaacatctcattaaacatttcgcaagagtgaaggatagactatgcaagagggttataatggggccaggcgtggtggctcacgcctgtaatcccagcactttgggaggccaaggtgggcggatcacgagggcaggagttcaagaccagcctgaccaacatggtgaaaccctgtctctactaaaaatacaaaaatgagccaggtgtggtggtgcgtgcctgtaatcccagctacttgggaggctgaggcaggagaatcgcttgaacccgggaggcggagattgcagtgagccaagatcgcgccactgcactccagcctgggcaacagagtgagactctgtttcaacaacaacaacaaaaaaatacacatcacccaccatttcttgggtatcaacatccacctctggaatgactgaagggttattaatctaggatggtaatggagccaggttatcgccaagtttggtaagaacatccttgcctttgtcactcactgctctcttggtggagttggtaccgagacacggcccgatgtgggcagatgcttagacagggaacatggcttcctcttcctggaatggcaagaacttcgaattctgccccctctctgccaacgttagatatgtcacggttgaatgactaaacaccaaatacatatccggagcgagaaatggcatgatgctttcagaggaaggatggagctggaatttggggaatgaggaaatggcttttccctctttgtgtgtttagtgatgataagagcaatcagttctgacagctcctactggctgctacctactggctggctggagcgttggctttggttagagaaaatggaacatttcaagaggagacactttccatacacattatcataaaagtttgtttgtgagatggagttttcactctgtcgccaggctggagtgcagtggtgcgatctcggctcactgcaacctccacctcccgggttcaagcgattctcctgcctcagcctcctgagtagctgggactacaggcgcccaccaccacacccaatttttgtatttttagtagagatgggatttcaccatgttggtcaggctagtctcaaactcctgacttcgtgatacacctgcctcagcctcccaaagtgccaggattacaggtgtgagctaccgcacccagctcaataaaagtttttaaaatgttatcagtaatgctataatgatcatcataacttatggtaggtacaaactatagaatccacaactgcttaccaaggtcttataaagacctaaatctgtggtttattgaggttctttgaaacccctcaattttcttcttggtattaatgattgaatttttaatggtggggcagaatctgcccaagtattagagggacaaagaaggatacagagagctggagttccatcagttcagcctggttaatgtgtcgtttctgagcacacagcaagccctaccctgtttatgtggtaaggtctcactcctatacagaacatggcatgattcaaattctaaaaagaagatgtctggataagcacttttgattgactgtctgattagaggtacttttaatggaataggcagaaaatgcaaatatctaatgaacatgctggagaggttcaccatcggcaagcatttcattttcttttcttcaaaaattaattacagagtgtggctgcgtttctgtggattcagtgtttctaattctttcttcaattagtcctttaattttcttcccaaggagacacatggatatacaacacgtaacacagtgacattttcttgtcactgaaagaaatttcaaagttcattttcaaattcaaagaaaaggaaggctggagtggattggaaaagaggctacaggctaagaacttttaagagccctagagagagtggggtgctggtgtcactgttatttcattgattttccttgtccacagccattttcaagactcatatttcagggccttagatggtttgtctcatatcactgctgtctgtagcaacaaccactctgtagaaggctcccagggaaagacccataaggtctaccttgtttttgtttgtttgtttttgaaacacagagtctcactctgttgaccaggttggaatgcagtggtgtgatcttggctcactgcaacctccgcctcccgggttcaagcaattcttctgcctcagcctcccaagtagctgggattacaggcgcccaccaccatatgccactaatttttgtatttttagtagagatggggtttcaccatgttggccagactggcctcgaaatcctgacctcgtgatccgcccaccacagcctcccaaagtgctaggattgccggcataagccaccatgcctggccaggtctgccttataagtgatatgagcataggtggaggagttgaacactggagaaggatggatcaataactccacccaaccacaggtgctcccatttctgggtgtctaatcccaacccttgagatcatgccgccattttatcaccgttctatggtatcatgccgccattttatcaccgttctatggtatcatgccgccattttatcaccgttctatggtatcatgcctccattttatcaccgttctatggtatcatgccgccattt

SEQ ID NO: 2540 - DNA, 165908 bp, Homo sapiens
  misc_feature (9201)..(109200): n is a, c, g, or t
aggagaattgcttgaacccgggaggcggaggttgcagtgagccaagatggcaccactggactccagcctgggtgacagagcaagattccatctaaaacaataaacaaacaaacaaaattctttgcatatgagcctgtaatggaagacaaactccatgggcaaccttcatatcttccccaacagcaggctgaaagctgtcactttgatgtcaaggggataactcctattatcacattgtccaaaaaggctcaaactcaagtctcagtaaggttggctctaggggagaagctattcttttgccttttgcagcttttagagctgtattcctttcatttcttggcctgtcgcccgttcctccaccttcaaagccagcaacatcgtacctcgttttagttctgacatcgcgtactctcttgctagtccagtctccctctgcctccttcttagaaagatgcttctgatgacattgaggatccacctcaataatccgatatcatcctcccatctcaagatcattaactgaaatgcatctttaaagtctgttaccatataatgtaacctattcgtgtttttattgttgttgtttgtttgtttatttttgtttttgagatgaagtcttgctctgttgcccaggctggagtgcagtggcgtgatctcagctcactgcaacctccacttcccaggttcaagtgagtctcctgcctcggcgtcctgagtagtcaggattacaggcccgtgccaccacatccagctaatttttattttattattatttttttgagacggagtctcactctgtcacccaggctggagtacagtggcaagacctcggctcactgcaagctccgcctcccaggttcacgccattctcctgcctcagcctcccgagtagccgggactacaggcacccaccactgcacccagctaattttttttttttttgtatttttagtaaagacggggtttcactgtgttagccaggatggtctcgatctcctgaccttgtgatccgcccgcctcagcctcccaaagtgctgggatgacaggcgtgagccaccatgcccggccaatttttgtatttttagtagagacggggtgtcgccatgtgggccaggctggtcttgaactcctgacctcaggtgatccacccacctcggcctcattacaggctattcatgggttttaaggataaggacctgtgtatgactgggggctgttattcagcatcccgcagcattgttttgtggatgcactctggctacaattccaagaaggcagcatgagaaatttcacagccaccctccagcagggagttgacaggcacagtccagcccggggcatcctactggcaggggagctgttgttgtgttgacttctgtcagatcaacataagtgacacagcttcctccgcacacaccgagggggacatgcttaagaatgtcattaggaggcccgggagatcacagcactagcttagctaaatggggtttcggcaatgagagtctggtgccaacaatatggatattatttaagatttttaataaagcaggggaaacaaagagaactgagaaggaggaataaagtgctgaaaaacatttatctgctcttaagcaatttcatttaaaggagaaagaaacggaggctcaaaccaaagatgaatattgacaatgatgttttttgttttgagacgtagtctcgcactgttgcccaggctggagtgcaatggcgcgatctcggctcactgcaacatccgcctcctgggttcgaacgattctcctgcctcagcctcctgagtagctgggactagagacgcctgccatcacactcagctaatttttgtatttttagtagacacggggtttcaccatgttggccaggctggtctcgaactcctgaccttgtgatctgcccacctcggcctcccaaagtgctgggattacaggcgtgagccaccaggcccggccctaacaatgatgtttaaataggcagaaaagtaaggctggttttggcaaagcagaaagcattaaaaggccctgggctcggtgtgtagagctttgactacaaagggaaaaagtcacagggaaactggtttatttacattatgaatacaaaatgctaaactggtggactgattaaacttatcagcaaaagactaaagaaagacattttctggaagcatttgcaagggttgggtaagccacatggtcactgggcagtgttcaaagcaactgctccttggagacctctgacctgagtatatcttgagggtttttccaggatggggttcagggaagtgtattaaggatccaaacatcattttggtttacaaaaaatcattatgaagagttcaaaatatacaaaaaaaaaaaaaaaaaaaaaaaaaaaaaaaaacagtcaaagagtaaaaacaaaccctcatggaaaaaaagaaaaaaattgtctctatttgacgatgatataattgtcttgatagaaaatatcaaataatctggaaaaaactttctagaactaataaatgagctcaataagttcacaggatgcaagataaatgtataaaaatcaattgtatttctatacagtgacaatggacaaggggaaaccaaaatataaactataatactattttaggccgggtgtggtggctcacgcctgtaatcccagcactttgggaggccgaggggggcgtggatcacctgaggtcaggagtttgagaccagcctggccaacatggtgaaacccagtctctacaaaaaatacaaaaaaattagctgggcgaggtggcaggtgcctgtagtcccagctactcgggaggctaaggcaggagaatcacttgaactcgggaggtagaggttgcagagagccaagatcgtgtcatcgtattccagcctgggctatagaacgagactctgtctcaaagaaaaaaaaaaaaaaaactattttaaattgctccaaagagaacgaaatacttatatataaatctcaccaagcatatgtagttctgtatgataaaaattataaaattctgatgaaaaatatcaacgaagatccaattaaggaaaggcatactgagttcctggagcacaatcactatagtaaagatgtaagttctccttaaactgatttacagagttaacacaattcaggctgagtgcagtggctcgcgcctctaatcccagcacttcaggaggctgaggcgggtggatcacctgaggccaggagtttgagaccagcctggccaacatgatgaaaccatgtctctaataaaaatacaaaaattgcctgggtgtggtggagggcacctgtaattccagctactcgggaggctgaggcagaagaattgcttgaacccaggaggtggaggttgcagtgagctaagattgtgtcagtaaactccagcctgggcgacagagcaagactccatctcaaaaaacaaacaaacaaacaaaattcacataaaaatcccagcattttaaaaatatacctagaaaaaattttaaaaatagacatagaaaagattattataacatttataaagtaatggaaaagctctgtaagagttgaaaccattttgagaaagaattaagtgacagaaatcacacactctttgggattactatattgctgggataaaatggagagagtatggcactgaacaaagataagacacataaataaatggaacagcatagagaacccagaaacagatacctgcaatgatgtccgactaatgtttgagaatggagcaaaagtaatttaatggaagaggaatatccatttcactgaaatttctggagcaaggagacatgacgaacaacatcaaaaaatgaatcgcaacctaaacctcatagcttttatacaaattaactcaaaataaatcatggacttaaatgtaaaccacaaaaccatggtgtgctgttgcatctatgatctcaaaaagaatgatggattgcatttaacgatgatatcttctacaggaggccaagcgactaagacaattcttttttatttttattttttgagatggagtcgcactcttgtcgcccaggctggagtgcagtggcgccatctcggctcactgcaacctccactgcccgggttcaagcgattctcctgcctcagccttccgagtatctgggactacaggcacctaccaccatgccaggctaattttttattttattttttgtacttttagtagagacggggtttcaccatattggccaggctggtcttgaactcctgaccttgtgatccacccgccttggcctaccaacgtgttgggattacaggtgttgggccaccacgcccagccaacgagtctttttttcatggtcaaaaccaaaatctagattgcaaaattcagataaagcaattttacggcttataaggtacctacataggcctgatgttttgcagtgagggaggaaaagtcgcaaaaaaaaaaaaaaaagaaatactctgaagaaagtgaaaagacaagccacagaatgtaagaaactattgggaagacatatatctcctaaaggacttgtggccaacatttaggaagcatagttacaagtcatacgaagatggcacctgacccgataaaaattaggaaatagagctgaaaggacttgtcagtaaataagacgtataagtggcaaaataagtctatgaagcgggtctgtgtttcttggggggttctggaatgcagacaccgagacagagttagaaacgcaaaggtggggcatggtggctcacgcctgacatcccagcactatgggaggccgaggtgggtggatcacctgaggtcaggagttcgagaccagcctggccaacgtgatgaaaccccgtctctactagaaatacaaaaattagctgtgcatggtggcaggtccaggaatcccagctacctgggagtctgagaaaggagaattgcttgaacccaggaagcagaggctgcggttagccaagattgcaccattgaactccagcctgggtaacaagagcaaaactccgtctcaaaatataaataaataaataaaatttaaaaagggaaacatttccggccaggcgcagtggctcacacctttaatcccagcactttgggaggccaagacgagtggatcacctgagaccaggagttcaagaccagcctggccaacatagtgaaatcccgtctctactaaaattacaaaaaattagctgggcgtggtggtgtgtgcctgtaatctcagctacttgggaggggaggctgaggcaggagaattgcttgaacctaggaagcagaggctgcagtgagccaagattgcaccactgcactccagcctggataacaagagcaaaactgcgtctcaaaaaaaaaaaaagaaagaaagaaagaaagatttccggccagcctcagtggctcacacctttaatcccagcactttgggaggccaagacgagtggatcacctgaggccaggagttcaagaccagcctggccaacatagtgaaatcccatcactactaaaattacaaaagattagccgggcatggtggcgggtgcctgtaatctcagctacctgggaggctgaggcaggagaatcacttgaacccaggaagcagaggctgcagtgagccaagatcacgccactgcactccagcctgggagacaaagcgagacactatctcaataaataaataaaaatgaatagaaggatgagaaaaacagacactagggatttcaaaaggagtgtggatggagagcagtaagggttcaaaaactaccaactggggggtacgctgactacctgggtgttgggattattagaagcccaaacctcagcatcacacaatatacctaagtcacacccctgcacacacaccccttcatctgaaatttaaaacgggggcgggtgcagtggctcatgtctgtcatcccaggactttgggaggctgaggcaggaggatcacttgagcacaggagttcgagaccagcctgagcaagatacggtagacctcattgctatgaaaacatttttttaaacactagctgggtgcggtggtgcgcaccggtattcccagctacttgggaggccgaggcaggagaattgcttgagctcaggagttcaagggtgcagggagctatgatcacgccactgccctccagcctgggtgacagagcaagaccttatctcaaaatgaataaataaattaattcaattttaacataaaatacaaaacatctataatataatcatttttaaaagttaaacaatgtctaaaaaaggagttgtatttttctatatgtatacctgtagaaataaatatatatatttcctgtgtctgtgtatatataaaatatttttctaatataacatatataaacattatatatgtaatatattatataatataatatacaatatataacataagcaatattaaaaattatatataatatatattatattatatattatattatattatatattatattatattatatattacattatatattatattatattatatattatattatatattatattatatgttatataatatataatacatatttatttatatattaatatacattatacattaatatatatttttatatatttattaatatataaatatataatatgtttatatattatatatgtatactatataaaatatataatataaatatatatgtattgtataatataaattatatataaatatataaatatataatataaattatatataaatatatttatataaatatattatagaatatataatatattaatagtatgtaatataatattaatatattataaataaatatattataaatataatatataatacatatgtaatataaatatatataatacatatgtaatataatatacatattttatagttaatttattaactataactattattatatatgcataatatattaaatatattttatatatatttgtaatatttatatataatgtacacacaggaaatatatattttatattatgaatataaaatatttataattttttattttctattattttatgtatatatatgccatgcgaactctaacgcgtacgttctttaatcacgtttttcgtgtcttgttttacggttccatctggacttggagctgccctttgaaaaagccacagctgctgtgtcaagtctggtgaacgtgacatcctgactaaattctcgaaaggaaagagatgaaactcagggacatgtacctgggtcacctggagaaccagcaatgggcaccgtctgtggttggttgcctttgtaacctccgtgtatgtatatatatatatatatatacatatatatatatatatatatatatatatatatatatgcacacatagcatgtacatcgctcaaagcccaggtttttggacatcagtgtaactgacctgctgattagcgtatggtgaggactgccagccggaacacaccagggaaaggataaaaaaagtgggcagagcgaggagctattttagtcctggtccagggtccaccaccatgtggctgcattttaatgacacacgcgcttcaccctcccagatgctgaattcacctgcaacatcacactcctcaaggagacgtttagcagacattatctgagggctccgtgcagagcagagcctggtcactgactgttttctcaggaaaagataggtgcagaaggtaggggaaggacctgagtcccaggggaatcagccactaagaattcagcatctggccaagttgctcaaagaaattgttcttgtttagcctctctcttgaatcagtggatgtttactggaacctggaaggaaagggaagacagccagaagctatggtgtatgtgtgtgtggctgagcagggaaaggaaagaggtggagagaaggagggagagaagaaggaataagacaggggaggaggagaggggaggaagaaagaggaggagaaggaggagggggagaaggaggaggagtaaaaagagaagtggtaggagagggtagaaggaggaggaggagagggaggaggaagagaaaaggagaggaggaggaggggaggaggagatgggaggaggaggaggaaaggagagaaggaggaagagggggaggaggaggaggaaaggagagaaggaggaagagggggaggaggagagagaaggaggggagacaggaggaggaggggagaggggaggaggaggggagaggggaggaggaggggagaggggaggaagaggggagaggggaggaggagggaggggaggaggagacaggaggaggaggaggagaaggagaagggaggaggaggaagagaggggaggaggaggaagaggagggggaggagagggtagaaggaggagggaggaggaggacaaggacagacagtgggaggaggagaaatagtaaatgaagaaggagaacaagaaaagatgaaaaaagagagggagtagaaggaaaaggagaaggaggaagaggagaagaaggagtatcaaatggtacaatttctaaaatccaatctgaccaagtctagaccttctccaaaagaaatcgccaagtaagcagtaacaagtaaaatgaaagagaggatagtctttaagagacaaacctagtaggtcagattttttttttttaaggaagcttagtttttattggatacactttcatctttatagctcattgattgtgaaaaggcttatggaataatataattaccaaacaacaaaataaataaacagttgtagacttatgctacacaataaatgacaaaaccgcacacacacaaaaaaggaggggaatatttaaaacttagttacgtttccttcgacacatttttcactgggtggaaggaaaagcccagcatcaaatactttctttgaagtctctaaaagctttctcagtgatgagattaaacttgcaaaagctttcttgctgtggggaggcaacaacgacagctctaattacaggggttctgcactcagggtgttatggttctctgaaacaaggaagagaggcgtgcatacattaatccaaggatacgtcccagccagtaatgagccaccgcttgcagtggaaagcagggagttgtgagcttgtgtcatagaatatacaatttccttgtggtgtcccacaaaaagctatctcccattcagattgttcctacgtagttgtgccagtcataacaagaaccaagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccttccaggatggtccttctcctgaaggttaatccataggcagatgaatcggatattgattcctgttcttggaataatctagaggatctttagaatccattgggattcataatcacagctatgccgatgccatcatcaccggcttagccctttctgaaaacacagtcatcatctacccccattggaatcacgatgcaaaaaacctgtcccaaagcggtggtttcctatgtgattcttgcatccaggacaaatgacagtcagcagagaggcgccctgttccatcttttggtttgatccagttaaaggcacacacgtgagcacccaacgtttgccaactcagcactgggcagagcctggcctctgaggaaattggcatcttcgtaatcaatatattattatgttttattgaaatgtaagtcattgccgattcagtggctcatgcctgtaatcccaacattttgggaggccaaagagaggggattgcttgagtccaggagtttgagacaagcctgggcaacacagtgagacctcatgtctattaaaaaacaattagatgtggtggcatgtacctgaagtccaacctactatggaggctgaggtgggaggatccctcgagcccaggaggtagaggctgcggtaagctgggattgcaccactgcattccagcttgggcaacagagggagaccctatctcaaaaaaataaaaaggaaatataagtcacataacataaaatgaaccattttaggccgggcgcggtggctgacgtctgtaatcccagcactttgggaggccgaggcaggtggatcacaaggccaggagttcgagaccatcctggccaacatggtgaaaccctgtgtctactaaaatacaaaaaaaaaaaattagccgggaatggtggtgcgtgcctgtaatcccagctactcgggaggctgaggcaggggaatcacttgaatccgggaggtggaggttgcagtgagccgagatcgtgcctctgcactccaggcctggtgacataccaagactctgtctcaaaaaaaaaaaaaaaaaaattaaccatttaatgtgtacaattctgtgacattcaggatgttcaccatgttgggcaaccatcatcactcttgagttccaaaacattttcatcaccccaaaagaaacgccatatacaacagcagccactcccattccccgggccctattccacggcaaccactaatctagtttctgtctctttgaactgaactattctgctactttacagacctggaatcatacaggtgacctattgcgtctggcttctttcacttacgataatactttttgaggttcatctgtgtggtggcatgtatccacacttcattccttttttatggctaagtaatattccatcgcatggatgtaaaatgatgcattgtttttttagagaccagttcttgctctgtggaccaggctggagtgcaatggcatgatcatagctcactgcagcctccacttcctgagctcaaacgatcctcccacctcagcctcctgagtagctgggattataggtgcacatcttcacatccagccaactatttttatgttttgtagagatgggatcttgctatgctgcccaggctggtctcaaactcctggcctcaagcaatcctcccacctcagcctcctgaagcactgggattacaggtgtaagctactgagtctggcatatatatatgtgtgtgtgtatatatatatgtatatatatgtgtatatatatatatggatatataggatatagatagatagatagatagagatagatatatatttttttgagacagtgtcactctgtcacccaggctggagtgcagtggtgcaatctcagctcactgcaacctccacctccagggttcaagcgattctcctgcctcagcctcccaagtagctgggactacaggtgtgcaccaccacacctggctaattcttgtattttcagtagagacgaggtttcaccatgttggccagagtggtctcgaattcctggactcagtgatccacccaccacggcctcccaaagtgctgggattacaggtgtgagccactgtgcaaggccccaaaatgtatttttaattcccgctttactcttctaaaaaatgaaatcatccttactatcaccctaagaaaatttaataatatcctaatatccacatcatgcaaattataataaaggaatatgtggccgggcgcggtggctcacgcctgtaatcccagaagtttgggaggccgaggcgggcggatcacctgtggtcgggagtttgagaccagcctgaccaacatggcaaaaccccgtctctactaaaaaaaaatatatatatagatatatatatgtgtgtgtgtgtatatatatatgtatgtatgtgtatatatatgtgtgtgtgtatatatatgtatgtgtgtatacatatgtatgtatgtgtatgtgtgtgtgtgtatatatatatatatgtatgtatgtatgtatgtatataaaattagccaggcgtggtggtgggcgcctgtaatcccagctactcaggaggctgaggcaggagaatcacttgaactcaggaagcgtaggaagcgtaggttgcggtgagccgagattgtgccattgcactccagcctgggcaacaagagcaaaattccgtctcaaaaaataaataaataaataaataataaagcaacatgcattggtacatctcaacttttgggcttacctctaccctggaaataacgaggcagtaatatgcgtcgtgcctctatgtgttgaatccacaagatgatatgatcatcatctaccccattagacgactgggtggccgacggcaatcacaggccgccctggcctggtgtcctggtaactcgaacaccatgagtcctctcctgtcctctgatttccccaaatggtgatgaaacgcagccagtccaatcgtctctctgttaacgcagtgttttttttttttgactggaaaatcaatcctttgtatttatgtgtaagccgagttaagtgctacgctcaggtgaatcgtaaacaggttttttgtctttgtggccatctgggtcccacactcatgagtcatgtgggtcaggggtgtgttctctgctaggtagcattgccctgtactctgcgacgagtcgaaatcccaggcttcccccaaccaaatgccagtggaggcacttgattcttttgcccacccagcaacccacccacccccaacttcccatatgctctgcagagaacagccagcccccctcaccacatatcgagaaaaaacaccagatcatcaggacaatttcatggaaccaaacctcccactgcagccaaactcacatagaaaacatcctttgcagcctgaaaacccttttaggacctttctgtcactgagtcttataaacctataaagattcattgaacagaaccagagactcaggctcccggaaaagcttgacaaagtcacgcagtgcattagtccattcttgcattgctataaagaaatatccgaggctaggtaatttatttttaattttttggagagagaatcttgctctgttgcctaggctggagtgcaatggcacgatcttggctcactgcaacctccgtttcccagattcaagcgattctcctgcctcagcctcctgagtagctgcaattacaggtgcccaccaccacacccagctaattttttggtatttttactagagttggggtttcaccatgttggccaggctggtctccaaatcctgaccttggatgatccacccgtctcagcctcccaaagtgctgggattataggcgtgagccaccacacccggcccaagtcttataaacctatgaatattcactgaacagaaccagagactcaggctcctggagaagcttgacaaagttacgcagtgtaatatgccattcttgcattgctataaagaaatatctgaggctgggtaatttgttttttattttttggagatggagtcttgctctgtcacccaggctggagtgcagtggtgcgatctcagttcactgcaacttccgcctcctgggttcaagcgattctcctgcctcagcctcccaagtagctgcgattacaggtgcccgccaccacgccaggctaatttttcatatttttagtagagacatagtttcaccatgttgtccaggctggtctcgaactcctgagctcaggcaatctaccccgtgaggctaatttataaagaagagaggtttcattggcttggctgatagttctgcaggctatacacgaagcatggtgccagcatgtgctcagcctctggtgaggtatgaggaagcttacagtcatggcggaaggcaacgtgggagaaggcatgtcacgtggtgagtgtgggagctggatatgggggagaggtgctacacactttattttatttttatgtatttatgagacggagtctcactctgttgcccaggcttgaatgcagtggagcaatcttggctcactcccggattcaagcgattctcctgcctcagcctcccaagtagctgggattacaggcaccagccaccacgcctggctaatttttgtatttttggtagagacggtgtttcaccatgttggccaggctggtctcgaacttctgacctcaggtgatccacctgcctcggcctcccaaagtgctgggattacaggcacctgccaccatgcccagctgatttttgtatttttagtagagaccgggtttcaccatgttggccaggctggtctcgaacttctgacctcaggtgatccacctgcctcggcctcccaaagtgctgggattacaggcacctgccaccatgcccagctgatttttgtatttttagtagagaccgggtttcaccatgttggccaggctggtctcaaacttctgacctcaggtgatccgcctgcctcggcctcccaaagtgctgggattacaggcgtaagccaccgtgctcccagcctttaaacaaccagatcccgagagaactgactcactaccgcaagatcagcaccaaaccatgagggatctgcctctcagatccaacatctctcaccaggctcccagctttgaggatgacaagtgaacacgagattggagccgggacagatatcagaacttttatcatgccgtcagccacagacaagcttctgttgttgttttattttcctaaacaaatcacatgtccctcctacgatgccacagacttttattttattattgttattatttatttatttatttatttattgagatggattgttgctctgtcgcccaggctggagtgcagtggcgcgatctcggctcactgcaacctcggcctcccgggttcaagccattctcctgcctcagcctcctgagtagctgggactacaggcgcccgccaccacgcccggctaattttttgtattttttagtggagatggggtttcaccgtgttagccaggatggtctcaatctcctgacctcatgatctgcctgcctcagccttccaaactgctgggatgacaggtgtgagccaccacgcccagcttttattattattattattttgagatggagtcttgttctgtcacccaggctggagtgcagtggtgcgacctcggtttactacaacctccgcctcccaggttaaagcaattctcctgcctcagccccctgagtagctgggattacaggcgtgtgccaccacacctggctaatttttatatttttactagagacgaggtttcaccatgtcgctcaggctggtctcgaactcccgacctcaggtgatccgcctgcctcggcctcctaaagtgctgggatgacaggtgtaagctaccgcgcccggccctctgtctgcttttatcctagctgtgctggcagctgatcaaatgatgcctgtccagatggagggtgggtctgtctagccctgtccactgactcaaatgttaatctcctttatcaacaacctcccaggaacacctatgatcaatactttgcttcaattcagtcaggttgacactcaatagtaaccatcacagtaaagaaacagcaaaacggaatgccgaccccgtgggctgggcacagtggctcatgcctgtcatcccagcactttgggaggccgaggcaggtggataacctgaggtcaggagttcaagaccagcctggccaacatgcggaaaccacctctctactaaaaatacgaaaattagccaggagtggtggcaggtgcctgtaatcccagctactcgggaggctgaggcagaagaatcgcttgaaccggggaggtggagcttgcagtgagctgagagtgcaccactgcactccagcctgggagacagggtgagactccttcaaaaaaacaaagaaaagaaaagaaaagaaaagaaaagaaaagaaaggaaaggaaagggaaagggaaagggaaagggaaagggaaagggaaagggaaaggaagaagggaatacagaccgtgtaaggattgttgctgtgctctgtcagccacctcctcccaaatactccagagctgaaattgcagaaaacaaaactatgtggtgtgggagtggcagaagtcaaggtcctttcttgtggggaaggatggtgttgatgttggttatcttggtggggggatgttagtttgggagtaaattaaagggaaccagtggaaagggaaatagatgaaagaacaatcaggaagagaaactgaacaaatggaacaaaaacatcggctgggcgcggtggctcacgcctgtaatcccagcagtttgggaggccgaggcaggcagatcacatgaggtcaggagttcgaggccagcctgaccaacatgatgaaaccccgtctctactaaaaatacaaaaattagccaggcctggtggcgggtccctgtaatcccagctactcaggaggctgaggcaggagaatcgtttgaaccggggaggcggaggttgcagtgagctgagatcacgcctctgcactccagcctgggaaacagagcgagactccatctcaaaaaaaaaaaacaaaaaaaacttcatccattgaagcaggaactgtgtgtgtgtgtgtgtgtgcgtgtgtgtgtgtgtgtgtgcgtgtgttggttgacaatagtcaccctattgtgctatgtcttatttattctttccaatttttgtacctattaaccatccccacctcccccactccaaccccctttgtaaccgcaaggataaatgcttgaggagatggacaccctattctccatgatgtgctttttacacattgcatgcctgtatcaaaacatctcatgtaagctacaaatatatacacacctactatggacccacaacaattttttaaaataattcaatttttttttttggttgaaactgagtcttgtgctgtcacccaggctggagtgcaatggcgtgaccttggctcactgtaacctccacctcccgggttcaagtgattctcctgcctcagcctcccgcatagctgggattacaggcacctgccactatgcccagctaatttttgtatttttagtagagacagggtttcaccatgttggtcaggctggtctcgaactccagaccttgtgattcgcctgcctcggtctccccaaagtgcaaaaatttttttttaattgcatacgatgaaatacttgcaaacacacccacacccacatacaactaaaagagaaaatctgaaaaggcggccgggtgcggtggctcaggcctgtattccccagcactttgggaggccaaggcaggcggatcacgatgtcaagagatcgagaccatcctggccaacatggtgaaaccccatctctactaaaaatacgaaaattagcctggcatggtggggctcacctgtagtcccagctactcagcaggctgaggtaagagaatcgcttgaacccgggaagcggaggttgcagggagccgagatctcgccaccacactccagcttggtgatggagtgagactccatctgaagaaaaaaaaaaaagaaaagaaaatctgaagaagcaggtcagattgtatcaatgtctgtatctggttgagcgatttactggagttttgcaagatgttctaattgcaggaaggttggtaaaggtacatgggatgactctgtactacctcttacaactgcatgtgaatttacacatctttgcatacaatttatgtgttagttcaggctgctgggataaaacaccatagagtcggaagcttaaactgttaacattcctgtatcccacttctggaggctggaggtctgagacaagggtgccagtatggttggttcctggtgagaactctcttcttggcctcctttttctttgtttttaattttttttttattatactttaagttctggggtacatgtgcagaacgtgcaggtttgttacgtaggtatacacgtgccatggtggtttgctgcacccatcaacctgtcatctacattaggtatttctcctaatgctctccctcccctatccccccaccccccgacaggccctggtgtgtgatgttcccctccttgtgtccatgtgttctcattgttcaacttccactgatgagtgagaacatgccgtgtttggttttctgttcttgtgttagtttgctgagaatgatggtttccagcttcatccctgtccctgcaaaggacatgaactcattcttttttctggctgcatagtattccatagtgcatatgtgccacattttctttatccagtctatcattgatgggcatttgggttggtcccaagtctttgctattgtgaacagttggctgcctttttcctgtgtgctcacaaggcagtgggacagtgagctcactctgagctcatcatccttttataagggcaggaatctcatgcatgaggctccatccctcattaggctccaccctcatgacaccatcacctcccaaagcctccacttcctaacgccatccccttgggggggtgacaatttctacaaaagaatttggaaggacaccaatgttcggtcgatagcatagtcaataaaaataggagatgatataaaaagatgttaatatctaattgtcagtggatttgtgaactatctgatggtaaatatcagataaaagatagttaaggatagaacatcaaagaaccaaagctaaatctatttttttttttttgagacagagtttcgctcttgttgcccaggctggagtgcagtggtgtgatctcagcccaccgcaacctctacctcccaggttcatgcgattctcctgcctcagcctcccaaggagctgggatgctaaatcttttacagtaataataataaaataacaaactaataaaagaagcattacaccaagaagacagtataatcatgaacctgtaggtctctagtactgcagccctaaaatatctaaagcagagagtgacagagatttccagaactctctctacaaaagacaggataaatacattacatttcataacatgattaaaatttcaatttatagaaatttcaatttatagaaacataagtctataaaaccataagtctgtaaaaccaggagatcgtgaccatcctggctaacacggtgaaaccccatctctactaaaaatacaaaaaaattagccgggcatggtggcaggtgcctgtagtccccactactcgggagggtgaggcaggagaatggcatgaacccagaggcggagcttgcagtgagctgatatcgtgccactgctctccagctttagggagagagcaaggctctgtctcaaaaaaaataaataaataaaaaataaaaaggcaaaaaaaaaatcactaattttaattctacacctttggaaatattaaaataccctcttcatccattggtcaaatcaggcaaaatgaaaacaacgacttcattctaagtctatgaaatgcagccccaggggtcaggaaaaaaatgagttcacaatacatttgttacgattagaaggaagaaaacaaacaaacaaaaaaagatggcatgtatcgaggcaagaaaatagacaacatattccagaatgaaggcaaagaattataagaggataaaacagcagtaactaaaaatgataagtaagcgataaacacaatgatgagtaaaatgtctactcctgaatccgagacggtgcttcacaaagacagcttcagaggccacaattccaaagcttttttctacgtacagatattctccccgatgcctgggttaatggcgcccgaactgcagaaaacataacctcaaccgagttttctgcttcaatgacaaatgacaccagagccccaccaccaaaccatggctggcatctatttagttctgagcactgctctgacagaatgcatcagtcttgctttgctctcagcaaaactgggtgcagaggggacggctgttagcctggtcgttgctaatgaggagatgaggagttggaaagatagagacgcaatggcttaactacggcacctgatgcaagacttgctacctccccagttccagcccaaatggagaaatgggtatgatgcaccttctgtgatctggggatcagttctgatgtctgcggtccagccccccaacctgtcctgcctttgaaaatgtggtgtgtcccttctatgacagtttctcctaacagccaagatgagagataccacatgttcatgacaaagacactctcaaaatcaaggtggcgtccagacacacatctagactgtgatgtgttccccacacaccagcctttgttgactgcacacattcccgctaaaagacacacaccagcctttgctgactgcacatgttcctgctaaaagtcccacaccagtctttgttgacgcacacattcctgctaaaagtccctgtgactacatgagacaatactgccagtttccaggctgttaggacctgctatctttggggacttcctctgttgactacagcctccagctcctttaggacacaagccctgttcttccgacttcgagtcccagtatttgggtataacacttaacacttatttactgaaaacatgactacatggatgaatggatggatggatgaatggatggatggatggatggatggacagatgcatggatggatggatagatgaatgaatgaatgagatggtcccatccattgctggacctgaataaaacctattcatggctactggaagggcataaaagagtagcttcactgggacatccatgcactctaggtccaagtattgaatcaaggtttgccaaagaaaagaaactcattcctcctggttcgtacagagctctaatggcacacatgctactcacccaacaatccacgcggtttcccctgctgggaagtgtctccaggaaattgcacagtgtccaggaaatggcacaatcaggtatcaaggaacacaggcgaacttctccagaattatgctcttggtttccctgggaggaacggtcacataagggttaccatgaaacacagaggaatagtgtgaggctggagtcgtacaacattcggatcgctctcacagctcatctgtcagcctggggaatgcggtgtctgtcattttccagagtgcttgttcagtcagcggtatcaattgtcagctttaggagataggagacatcctgtcaccccatccagagcctgtacttggaactacctttatgacgatgatgaagagcagctgcggccgggcgtggtggcttacgcctctaatcccggcactttgggaggcagagacggggtgatcacttgaggccaggagttcgagaccagcctggccaacttggcgaaactccgtctctactaaaaatacaaaaaaaaaaaaaaatagctgggcgtaggggtgggcgcctgtaatcccagctactcaggaggctgaggcgacagaatcacttgaacctgcgaggtgagggttgcagtgagctgagattgtgccactgcactccagcctgggtgaaacagtcagaatcctctaaaaaataaataaaataaaaaattaaaaataaaagagcagctggcacttcttgcaagagcttcaagctgcaaaaggctcttggatgatgtgcaactgtacagaggtggagatatttttagaactgaagatttggtgcatagtcctggctgtttggaaacacttttcagatgaacgcatgctgcgatcctggtttaatggaggaagtcactcccattcagaaacacatctgtctgggctccacggcttagcagaacctctgggaagtacaaggtgtttgaaatgatcctgtatgaaagacgccagaggtgtagatgctgagggctggaaactgcagttgacatttgcctggctcagggaatctcaaacttggctgaacaacaacaaaaaaacatgacctggtgccgggcgcagtggctcatgcctgtcatcccagcattttgggaggccaaggcaggtggatcgctttgagctcaggagttcaagaccagcctgggcaacatggcaaaaccgtgtctctattaaaaaaatacagatggtcagacgtggtggtgcacgcctctggtcccagctacttgagaggctgaggcaggagagttgcttgagcctagacggtcgaggctgcagtgagcagagattgcatcactgcactacagcctgggtaacatagtgagaccctgttgaaagaaaaaaaaaatggaagaaagaaaaaaaggaaagaagaaacagagaaagaagagagaaggagagagagagagagagagagagaaagaaagaaaggaaggaaggaaggagagagagagagaaagggagggaggagggaaggaagggagggagggagggataacagaaggaaataaggaagggaaggagggagagatgaaggaaggaagggagggagggagataaaggaaggaaaggaaagaagggaagggaaggaaagaagcaaggaagggaaggaggaagtaaggaaaggaaaggaagaaggaagggaaggaggaaggaagggaagggaaggaggaaggaagggaaggaggaaggaaaggaaaggaagaaggaagggaaggaggaaggaagggaagggaaggaggaaggaagggaaggaggaaggaaggaaggaggaaggaaggaaggagggaggaaggaaggagggaggaagggaaggaggaaggaagggaaggaggaaggaagggaggaaggaagggaaggaggaaggaagggaagggaaggaagaaggaagggaaggaggaagtaaggaaaggaaaggaagaaggaagggaaggaggaaggaagggaaggaggaaggaagggaaggaggaaggaagggaaggaggaaggaaggaaggaggaaggaaggaaggaggaaggaaggaaggaggaaggaagggaaggaggaaggaaggaaggaggaaggaaggaaggaggaaggaagggaaggaggaaggaagggaaggaggaaggaagggaaggaggaaggaaggaaggaggaaggaaggaaggaggaaggaagggaaggaggaaggaagggaaggaggaaggaagggaggaaggaagggaaggaggaaggaagggaagggaaggaagaaggaagggaaggaggaagtaaggaaaggaaaggaagaaggaaaggaaggaggaaggaagggaagggaaggaggaaggaagggaaggaggaaggaagggaaggaggaaggaagggaaggaggaaggaaggaggaaggaagggaaggaggaaggaagggaaggaggaaggaagggaaggaggaaggaaggaaggaggaaggaagggaaggaggaaggaagggaggaaggaaggaaggaaggaggaaggaagggaaggaggaaggaaggaaggaggaaggaagggaaggaggaaggaagggaaggaggaaggaagggaaggaggaaggaagggaaggaggaaggaagggaaggaggaaggaagggaggaaggaaggaagggaaggaggaaggaagggaaggaggaaggaaggaggaaggaagggaaggaggaaggaagggaaggaggaaggaagggaaggaggaaggaaggaaggaggaaggaagggaaggaggaaggaagggaaggaggaaggaagggaaggaggaaggaaggaagggaggaaggaagggaaggaggaaggaaggaaggaggaaggaagggaaggaggaaggaagggaaggaggaaggaaggaagggaaggaggaaggaagggaaggaggaaggaaggagaaagggagaaagagagaaagaagaaaaaacgaggaaggaaaataaagagaatgaaagaaggaagaaaggagagaaagaaagaaaggaagaaagcaaaagaaaaagaaaagaaagaaaaagaaaggagaaagaaagatggagaaagagagaaaaagaaagtaaggaaaagaaagcaaaacaacttggggaattcaaaacaaatgctgatgaccagaagaattgactgcggaactttctcgcggatggggctgaccgtcagtcattttcagaggttggcccagtgagcatcaaaagcccactagctttcctggatatttggggagaccgtcacagatagtgagaggcctgagctcaccagtggttttacacaaggctcactggggattggggatgtccagtttcagacctgctgcctgtccttgaagagggaagacgcatgaacagagatggctacaccaattgcaagctcagcgcaaaatgagaagaaggactccttgttcaaacctaattaacaatttccaggcgggggcagcagacagttaaagcaatatggcgcccttccgtgcgtggggaccctgtgtgagttacgcaaggtgcggactcatgaaacttgaggtgtagataacagaagctatccacctccgaggctttccgggtctctagaaatggaaagaatattttccgcactcacatggcatctggtccctgtggccaatagtagattgaatactgtctcccaaaaagatatgactaaggcctaatccctggtatccgtgaatgggaccttattcacagaaagggtcttgccaggtgtcattgagtaaaggatcttgaaatgagatcatctggattatccaggtgggccataaatccaatatcaagtgtccttattagaaacaggaagagacacagatacagggagaaggccacgtggagatggaggcagagagtgcagtgatgcggccacaagcctagggatgcctgcagcccccaggagctgggagaggcagaaaagatcctctcctagagcctctggagggaactgcacccaattgtagtggactgaactgtggtctcccaaaaagatctatctataccctaatacccagagcctgggaatgagaagttatttggaaataaggatctttgaagatgcagtgaattaaagatcttgagatgagatcatcctggagtagggtaggccctaaatccaatgacaggtgtccttctaagagacagaagacacacagacacagaggagaaggccacgtggagacagaggcagagactgcagtgatgcggccacaagctcagggacacctggagaccccaggagctgggagaggcaggaaggatcctctcctagagcctctggatggaactggacacaattgtagtggactgaactgtggtctcccacaaagatctgtctatatcctaatatccagagcctgggaatgagacttcatttgggaataaggatctttgaaggtgcaatgagttaaagatcttgagacgagatcatcctggagtagggtgggccctaaatccaatgagagatgtcttttttttcttttgagacggagtctcactctttcgcccaggccggactgcagtggtgctatctcggctcactgcaagctctgcctcccaggttcacgccattctcctgtctcagcttcctgggtagctgggactacaggtgcctgcaaccgtgcctggctaattttttgtatttttagtagaaatggggtttcaccatgttagccaggatggtctcgatctcccgacctcgtgatccacccgcctcggcctcccaaagtgctgggattacaggtgtgagccaccgtgcccggctgagaggtgtccttctaagagacagaagacacacagacacagaggagaagaccatgtggagacagaggcagagactggagtgatgtggccacaagcccaaggaatgtctggagcccccaggagatgggaggggcaggaatgttcttctcttagagcctctggagggaactggacacaattgtagtggactgaactgtggtctcccaaaaagatctgtctataccctaatacccagagcctgggaatgagaacttatttggaaataaggatctttgaagatgcagtgaattaaagatcttgagatgagatcatcctggagtagggtaggccctaaatccaatgacaggtgtccttctaagagacagaagaagacacacagacacagaggagaaggccacgtggagacagaggcagagactacagtgatgcgggcacaagctcagggacacctggagaccccaggagctgggagaggcaggaagcatcctctcctagagcctctggatggaactggacacaattgtagtggactgaactgtggtctcccacaaagatctgtctatatcctaatatccagagcctgggaatgagacttcatttggaaataaggatttttttttgagacagagtttcactcttgttgcccaggctgggttgcgatggcgagatctcggctcaccgcaacctccacctcctgggttcaagcaattctcctgtctcagtctcccgagtagctgtgattacaggcatgtgacaccatgtctggctaattttgtatttttacaaaattacagaattttgtaatgatggggttaaaaatttttgtaatgatggggtagagatggggtttctccatgttggtcaggctggtgtcgaactcctgacctcaggtgatttgcccacctcaccctcccaaagtgctgagattacaggtgtgagccactgtgcctggctggaaataaggatctttgaagatgcaatgagttaagatcttgagatgagatcattctggagtagggtgggccctaaatccaatgacaggcttccttctaagagacagaagaagacacacacacacagaggagaaggccacgtggagacagaggcagagactgcagtgatgcggccacaagcccagggatgcctggagcccccaggagctgggagaggcaggaaggatcctctcctcgagcctctggatggaactggacgcaactgtagtggactgaactgtggtctcccaaaaagatctgcctatatcataatacccagagcctgggaataagactttatttggaaataaggattttttttttttttttgagacggagtttcactcgtttcccaggctggattgcaatggcgtgatctcggctcaccgcaacctccacctcctgggttcaagcaattctcctgtctcagcctcccaagtagctgggattacacgcatgtgacactggagtcatgcaaccacaagtcaaagggatgcctggagcccctaggaactaagagaggcaggaattgatccttccttagaacctccggatggagcagagccctgagacatcttgatctcaatcttctggtctccagagctgggagaggagaaataattccttttgtcatgaggtccctagttgtggttacttgttacagcaggcctggaaaactgatcaatgtcataacctgcaatgggctgtctgaacacacagccatctcatgggaccatctacatcatcttcacacagagacctaagccccatgggaagcttggcagatgtgatgttggggcctctacagatccagatgtgggggtttagtcaggctggtggggaaaattttagttatagtagacacaaaccctctgggaaggcctgagcgtttgtataacttcagtaataaacctggctgaaggcagcctagtccccttacctttagttaaataaattagagtagaagcaaaggaatgtggggaatgtctctaactaacttgtttactcatgtggtcctaagactaaccttttatgtatcgcaggtgcttcattgctttctacttagggaagtccgcaatgtcaatttccctctagtggtgttgactcacaacctttgtcaattaatctttactgaataaatgcaagtcttgctgactgatcgaggccacggctgctactaagtggcttggatgctcagccaaactggcaaagcagaatagctgtgtgtcaatgtacttcattcacccatcacttggtcagggtctgtgggacagacccctgcaccataaatcttgttgcaagttttcaccgttgggcttcacgtctccctgcagcaccatgaatccagctacactagggaggtgaatatcatgcatgtttcctgcaagtttcattgttccttgtaacctctggcaacctctccttcccggaggctgtttcctggcctgttagtctggttgtatcattcatggttttcctatgaagggtctcaggatataagcagacattctgcacagagactgcatctttctgcagaaggggcttgagctcattctttctgcactgagagtcctgggtattgaggtctgagctctgcccgaaacagaagcataccgattgttagggtcaccccaaccagaccgttcccttccccttccacaggccttacaatacagtcccttgcactctccacacagctcccccagggctaaagacaaacgccccccgccttcactgacccctccagtaactgtttgtccagacagttacaggatgtggttagcatgtctgtgaaccttgcataacaaagctggtgaaaaacatctccaggatgcggtcaagacacttgcaccccctactcagctcccccaccccaacccaatcctcctgcaccctcgactcagctcccccaccccgacctggttctggccctataaaaccctgctatagtctgtaagtggggctgcctccactaactgtggtggagcagccaagcagctcagtaaagtttgcttgcctgactttaggtctcctcatcctctctctcggctgaccttacaccgatgatgtagtaagcatctaacgtgaatatcccagggaacaaatccacatttcttatccttttgtaccaaggaaggtcccctgtctagtgggtccatgacataaaattcctggttttctgtaaaggaacaacagaaatccaggcatcctggttatctaccaaggaaaatcaccatctgtggtgacaaacccattcccggaggatgaatgattttttttttaaagaggccaaacaatacatttattattttcatttaagttgcttatcagggcaaccttccccatctgggaacaatctagcagtcatgtaagaagcacatgcccccacaattagtttgaactccatcctggaattgcagctggttgtgattctaaggtacaggcatgccaggagcctggatttgaatagtcagtgggattttgtcacttagtggaatggataataagccaaccaatggtcatcagtctcacacataaggagtgcaggctcgtagggtatacacagtactttctcaaaagcattgcaaatgactgatttctctatgttgaaatttgaaaacccaacatctatctctctaacaccaaaggattgagccttccttgcctggctggtgagtaagagtgagcctctataccaaggatgtaccctttggctgtgtgaggttttcagaagtatcagaagctgtatacatttcctgtggttgctgtaacaagtgactaccaatttgttggagccttaaaacaagaaagatttattctctctccgttctggggaccagaagtctaaagtcaagacgtcagaggggccaagattgctctgaggggtataagggagaatccttcctgcctgtcccagctcctggtggctccaggcattgcttggcttgtggtggcatcactccagtctctgtctgcatcatcacacgaatatcttgtcttctgtactcaaatctccctctacctgtctctgataagaaccctcgtgatggcattaggttcactgggatgatccataatgacccatctcaaaattcttaattctatctgcaaagattcttttccaaataaagtaatatttataggttctgagggttagggcatgaacatatcttttgagggctaccatttgatccatagctgttcagcggtttacattctcggatttgacagtggcatgcttcacttgtgactgtgccattctggaatgaggttgaccagatggtgctgctggccacgtcaaactcatcctacaggctgtagcaagcaaggctcacacctccccatgtctgacacctgtgaatcacagctgggtctctggaaaaatgagtgagtgcaggaacaaaatcaaacaggagacctcatccaccactaggtctcagagaggacattgcagcccctgaaaagagagcatctctcttggaacttttgtactcagttgtattaacgcggcaaggaaaatggcacatttatgttggaaaatgtaattatttatggcacctgtgacaactgggcactttggaatcacaaagtttatggttgaagaccacttggggtgattatcctccaaaatgtttatttggcttcttgaagttctgcagaggttgaggcagctgtctcaaaactagaggacagagccctgtgggcaggtgggtgtgagaaactcaaacaccgcagtcttcacagacccacaagctattggcaggtgcaatgtgtttcttggggcagcagctatcctgagacaggatatcacagggtcacatcaaggaccccagtcatctcacaactcttagaccacagctgctgctgcagtttctggttgtaggtgacgtggagggacttggtctctttctcgttgtataggtaatggccaccaactccttccagctctggggtgactgctgcgtagatggaagtccacgctccttcatcgggggtctggtggaagaagaaaagaaggctacgatgagtcaaatttctgagcaggaaacaggagtctcaggactcacatggatgctgcagggacaggtggaatatactcatcagctgcactgagaaatgtatgcaaaaagcgaggttgggtgatcaatctgaaccacagcttttctgctgttgggtttctttacaacaggcactgacaataacgtacccaagtgggttgcatttcagtggtgggttaatccatctcactaggcagatgcatattaaaatccctgatgtacgtatttaatcacgcactctttatgggaccgaaatgcttattaattgactagaagcagatgagtgagtgcttggcttctgtatttaataaacaatatttagcaattagatgaaacatcaggacatcaaaaagattcttgttttcaattcagcaaggcatgctacatcggagaattgaggcatttatgagctgtgatcgtatgtttcatggaaacagacgtttcaaaaaggaacttgagatgcagaaaaaggtttttcaaagactggggattttaccctagtggaaggcgataatcttgaaacacagcacaccctggttttctgcagtgggagttggcccttggtcatggtcagtgggatggaagaaatgtaggattctcagaggaattagaagttgtgggacctgagaaccttcagagctaggatgcaataatccaggaaccaacacagtgcatcttaacttctgtcacaatgaagatgtttcagaagttgtctcttgtaataagcttctgggaatctggtgaacgtatccaccatgtggggacacagtaatgaggcaccgtctgtgaaccagaaagcaggtcccttccagacacagaatctgccatgcattgatcttgaacttccagcctccagaactgtgagcaacaaatgtttaccggttgcccagcctatgttgttttgtgatagcaacacaaacagactaagacatttgatgtccagagtttttactggggtctcattgcataggtatgattaagtcattggccacataatcagattcaacctccagttcctctttcctccccagaggtcaggctggcctgaaattccaacctcctaatgacatggttggtgtttctggtggccagccccatcttgaagccatttaggaaacagcaaatatcacctcattatacaaccagggaattgctagcatttgtgaaattgcgagagttttagaagctcctccttgttacagaaccaggaataaagaccagatattgcctttgttatgtcccctctagtcttctgggagtgatgatccatttgcccgaactgatttcacctctcaccagtgcccctagcactgcagtggctcaggcctgtaatcccagtgctttgggagaacaaggcaggaggactgcttgagtccaggagttcaagatgagtgtgggccacatggcaaaacctagcactggtgagagttcaggcacacaccctccaaaaaggaaaagggtggactctgtggggtggcctgtgacacccagtcacttcagaaattctgctgctgtcagttcactgcctcctggtcttgacttcagcagccagtgtgacgtggaaaggcatggtagacaatccagtgtgcccaccagcccatcctctgggtgccgagcaaggggaacaggaaggctggaccccagtagaggaacagagctgccagactcctgagattgtttcccactgacttgcctctgctcttctgctgcctaaaaagaaatggatggagctagagaacttcccaagtctggaaatcacctaggggtgcccagagatcttgcaaacccaaagtgtcctgggagatttggaggctgatacggtttggctgtgtccccacccaaatttcatcttgaactgtagctcccataattcccatgtgtcaagggagggagccagtgggaggtaattgaatcatgggagatctttctcgtgctgttctcatgataatgaataagtcccatgacatctgatggttttataaaaggccgctcccctgcacacactctcttgcctgctgccatgtaagacatgcctttgctcctccttcaccttccgccatgattgtcaggcctccccagccacatggaactgagtccattaagcctctttcctctataaatcacccagtcttgggcatgtctttattagcagcatgagaacagactaatagagagactgtatctgaaaacatctcgggggcggatgcaggcgccatggcttggctcttgcaggggagccctgtgtcccgtgtcttgccctgggcatctaaagaccaaaagtaaaggcgaaagggatggaaagaggaagggaggaaggacagaacagagcaggaggaaagggagagggaaggcaggggccaagtgaaggcacccatggtgtttgagggtctttctctggggcagccttcaacgcagaaagaggttttattgatctgtttcatgcttctctcttttgcggctgtgttctgcccaatttccaggcaggatctgctcccaaagccggcattcttcttccttctccatcatcttgtagctggaaaatacggagtctttctggggcccagcccacttccatataaaaggcagggacaccaagcactgcagctgtgaatccaacatggtgccccttcccacactgctgctctggacaaagtgatcagagaggccagatgggggccaccctgggtccccaggagagaccatggttcctgctgcgcagaaatgagcatttacacctcacgctggtgcctgagatgttcacccacactgtgttatatttagtgctgtgccttctttgcaaacaaatccttaaatcagctcctggaacaagttttgtgttgttgtctgccatcattgacactgaggattcaggggctcatgccccaaatacccgacctgtgtcttgaccatgtagtatgatgcctccacccggagaggcccctgtgttctgcagctgcagcttaggccgctcctgggttctcctgcatcgtccctattgttgaacaaactcagcactctctggaaggaggcttcctctttgtggttcccctgtgggcagtgtctgggggcttctgtttctaccatattttgaaaaatcctcttatctgagtaagagttcttgggctatgcatattcaattgcgacacaagtactaccgttttagggggcaagataccacctgtgctatgttgaaaatgagcttgtgatttctagaagacagcaagcgcattgtgctgaaaatgtaggtatttctggggacacagagatgacgacgtgatgaagttctattggatgattttttttctgtaagaaaaacacacgcacacacatattcatgtgcgcatggtcacttacatgctgacatgcacacatacattcgtatgtactcacatgcacacaaatatatatacacatatggacacacacatactcatgcatacgcacacacacatgcacacttacttgcacatgcatactcacactcattcacatgcacacatgctcatttacatgtacacaaactcacatgaacacatgctcacatatactcattcacatgcacacaaattcgcatgcacacagctcacacgcacacatgctcacactcgcacacacacacgtacacacacattcacatgcactcattcacatgtacacagctcacacacatgctcacattcacatgcacactaattcacatgcacacacacatgctcacactcattcacatgcacacagctcacattcacacatgcattcacatttacatattcacatgcactcacatgctcactcattcacatgcacacagctcacacacatgcacacactcattcacatgcactcattcacatgtacacacattcacatgcactcacacacgcacacagctcacacatgcacacatttgcatgcacattcacatgtacacacattcacatgcagtcacacatgctcacactcattcacatgcacacagctcacacacatgcactttcacatgtacacacattcacatgcacacatacacatgcacgcaccctcattcacaagtacgcacatacacatgcacacatgctcacactcattcacatgcacacatgctcatccacgtgtacattcacatactcattcacatgcatacttatacacatgcaaacatgcttatatattcatttgcatgcacacactcatacacatgcacagattatttatcctaatattgcaaaatatgaaaccaaggagagaggcctcaggaggaaccagccctgcccacaccttgatcttagacctccagcctccaggactgtgggagaatcaatgtatgtcgtttctaagccacccagtctatggtattctgtgacagcagccagaactggactaagacatgtcataagaaaaggagatgaggacacagacacacacagagggacaaccctgtgaggacacagggaaaagacggcgtctccaagcccaggagagagacctcaggaggaaccagccctgcccacaccttgatgtcagacttccagcctccaggactgtgggagagtcaacgtctgttgtttataagccacccagtctatggtattctgtgatagcagcctgaaatggactgagacagctcataagaagaggagatgaggagaaaacagacatgcacagagggacgaccctgtgaggacacagtgagaagacagcatctacaacccaaggagagaggcctcgggaggagcccgcccagcccacaccttcatcttggacttccagcctccaggacggtgggaaaatcagtgtctgttgtctaagctgcccagtctatgggacgtcaggctggcaaccccggcagatggagaccaagcccaggtgacttctctcctgactgggattggcgcaggctgctgtgtgcatatgtcaagaaagcctcttttccaggaaacaggcaattatacccacacttacctgctacctcaagagtcagggaggggagagacttcaggagcatgagcaattactcgagttcccctcccaagtcatttcaatctcctgttggttacctggctcattcagtctgccccacagctctattgcaaacagagccctctgtgttcatgggactgttcaagaacaccaagggttcctgccagcatttgtctctctaatgccacgttctgcaaagcagaccttggactggcccagccctttgtgatctttttccccaaagaaaacacaggcgcggtagctcacgcctgtcaccccagcactttgggaggccgaggcaggcggatcgcgaggtcaggagatcaagaccatcctggctaacacagtgaaaccccgtctctactaaaaaacacaaaaaattagccgggcatggtggcgagcgcctgtagtcccagctactcgggaggcaggagaatggcgtgaacccgggaggcggggcttgcagtgagccgagatggcgccactgcactccagcctgggcgacagagcgagatgccatctcaaaaaaaaaagaaagaaaaaaaagaaaacacccagaccatgggcacggtttctcgtgttagggcagcacagagaatgtgacaggtagggaaaacagcaaagcaactcatcgttctcagagtcgcttttgttagaggggaagctctgggacctgtctcagagctgctgcagaataagaagggttcgagtcagccttcctcctgctgacaatgaatacctcagttttccctccggaggcagccccttttcctcctaactccatgaaatgtctttccggaaggtgcagctggagcaccctgcacctgcaccccagccagccctgcacccacatctgtacatgccaggcagtgctgagaaccgggcaggaagggaggggacagacgtgtctgcacagaatcctgcacctgctgggaacaactcagtgtcatcagctatggcctgggtcaaagcacctttgttttgggtattcaaaggtcagtgaagggttgagtgaaagggaaggagaaagacagagaaacaaaaaaaatcaatggaaggaagaaagagaaggagaaagaaaaagaggaagaagaaaggaggaaatagagaaaggaattaaggaaggaaagaaggaagcataatgggagggaaggaaggagtgacacagagagagagggagggaggcagtaagaaaggaaggaagcagagaacaagacagaaaagagggaaggaaggagagagaaaggaagcagagaagaaaggagggaggaagaaaaaagggagaaaggagggaagaagggaggaagggaaggatgaaaaaagaaaaaaaaacaggaaggaagcaaagaaggaagggaggcaggaagcaaagaaggaaaggaggaaggaaggaaaagagacagaaagaaaaaaaaagaagagaaacaaagaaccaaagagaaggaaggatgggagggagggagggagggaaggatgggaaggaggaaggaagggagggagggaggggggaagggaggggggaagggagggagggaagggagggagggagggagggagagagggagggagagagggagggagagagggagggagggagggagggagagagggagggagggagggagggagggagggagggaagggagggagggaggaagggagggagggaggaagggagggagggagggaagggagggagggagggagggaagggagggagggagggagggaagggagggagggagggagggagggagggaggaaggggggaagggagggagggagggagggaggaagggagaggggaagggagggagggaaggagggaggaagggagggagggagggaagggagggagggagggagggaagggagggagggagggagggaggggggaagggagggagggaggggggaaggggggaagggagggagggagggagggagagagggagggagagagggagggagagagggagggaggaagggagggagggagggagggaagggagggagggagggaggaagggagggagggaggaagggagggagggagggagggaggaagggagggagggagggaggaaggaagggagggagggagggaggaatgaagggagggagggaggaagggagggagggagggagggaggaaggaagggagggagggagggagggaagggagggagggagggagggagggaggaaggaaggaaggaagggaggaaggaaggaaaaaagggaggcaaaaggaaggactggaggaaaaaagagaagataagaggaaggaagggagggaggaatttattcctcagagcctttgctgcatttaccaattctggttctgcccctatttgaccaaatatctgtggtgactctgagaattctgatttctaagataaggcagatattgtgaatttgaaatagcaaatcccttttgtgtcattcaaaccacgatttcctttttgttagagctcctgttctccagatagcacccagggcacacagagatatttgcctgtgactcttcaaagagcttcagaaagctgttccctctgaactccacacttaacttgtattagacatgctgggctttgcagaagagacacacacagggcttccctttgtccttgggacggatcccctgtgctgtctgcaaggaaactacctaacgctccactgccaggagcagagggcagcaggaatggcatcacccgggatgtctcctagggaggaggctagcagggcttgggcggcaaacgctcagctctctgcaaggcacgcagaggctcgttcgccttctggaaatgttgctatttgaatgcagacgctgttagtagatccttgagttgtgctgagagagatctgagggcacatgtatttattttagcaccgtccacatcttagggcagaaactcacactcagggaagtggctggcaagtaaagagactcctagctgagcttcccaaggagagtttccacgccccaaagttgtggaagaggggacggagtaatgctgtggtcaaagagaaattcagagacttctgcccaggctcagctgccttcctggaagaatgttctgaacattctacaaaggcaacacttcctctccatacctctgctccagccacccagggatcctgctgcttctgccacgatgtcccctgcctcttgcctctctgtacctgctgcttgctccttctggaatgttctggaaaataggtttcggggctggatgttttctgggatgctgactcacacgcaaatcatagggtgacataatgtgtgcatgtgtgtgtgtgcacagatatgcataggtacgcatttatgtggatgtgtgtgtacttgtgggtagatgtgtattgtatgattgtatgtgcatgtctgtatgtatatgtatatgtatgtgcacgtgcatgaatgcacacgttaatgggtacgtgtgtgtattcatgcatgtgtttggataaatatatgtgcatgcatgtgtgtgggggcgcagatgtgcgggtatgggcctgcgtgtgtttgcacatgtgtatatgtatgcatgcatgtgaatgtgtacttgagggatgtgtattgtatgagtgtatgtgcatgtctgtatgtatatggatatgtgtgagtacatgtacgtacatgcatgtgcatgaatgcacatgtgaatatgtgcatgtgtcgataggaatatacatttgcataaatgtgtgcatgtgtgtttgctcatgcatatgtgcacacatgcatgtgggcacagatgtgtggatatacgcatgtctgtgtgcatgggtttgcacgtgtatatgtgcatgtgtgtctatgcatgtgaaggtgtgtgtgcatttatgcacgtgagcatgtgtgcacatactatgcatgtgtgggaggggtgcaggtgcgcgcatgtgtttgcatctatatgtgtgtatttgtacatgtgtgcatgtatgtgtgcatgagtgtgcacatgtgtacgtgcacacacgtgctctcaactccccaatgagagctgtgggttgtgctaaacttctagggatgtttcatggcctcagtgaccacctgaagcagagaggattaagaaaaccttcctttaactacaatctcgtaagacacacacacaaacctgctcttaccaggaataaacactcacctgacagacaacagagaggagatggcttgtgctgtttaatgtcaggtaacacaggtcttaagtgggctctgtgatgattgagttcacgtatcaattggctgggctatggtgcccagacatttggtcaagcaccagactgggtagtttgtggatatcattaacatttacaaatcagttgcatttaagcgaaggagaggacgcttcacaatgtgggtgggcctcacctcatcaggagaaggccttcacagcaaacactgacacttactagaaaaggaattccactccagactgtgacagggcaatcctgcctgagtgtccagcctgccctgcagattttaggctcaaggctgcaatgtcaaatcttggccaggtctccagcctgccagccagcctaccaattttggacttgcccgcccctacaatcccaagagtcaattaaactaaatctttctctatgcatagatcctattggtcctgtttttcttgagaactgcgactaatacaaaattgaacggtctcaatggcagagagtctgggcattctgaaaccaggaagaaatgccgggctccaggaatgatcttggctcatctcttagcttgagtcactggaaggtctcgcacagagaccttcaatcaaaagcacagagactgctggctggcttttaaggctaaaccaaaggagggcatttatccactcaagggaagaagtttcccatccaaagaggacacttctttttagggtggcagcctcagagcctatgatgtctttgttcctggggagtctgttagagccaccagagagtccatcacagacataccctgtggaaaggagagatggcatctccttggacaaaacggcccttcccagttctgtaacttctgtggcatttccaatgtgtacctcaaactgatctgggtggcatcacctctgagcctgagagaacctccctctttccctccctctctctcacacccttctccttcctcctttgcttcctcttcctttttctctttttctctctctattcctctttctcttcctcccccatcttatcctcctcctctttcatttcttccttctccttctctttcccccttatcctcctcctattcttctatcccttcctcttcctttttctctcttcttcctcctccatcgtatcctcctttttcttttttcccttattctcctttcccatctctttctccctttctcttctctctctgccttttcttctttttttctttctcctcttttctcttcttgccttttcactctctattcctctttttttctcctccatcttctcttcttcctcctccacctcgtcctcttcctcctttctgccttatcctcctcctgtttttctctctatccctctctctcccttcctcttcctttctttctcctctttctcattttctccctcttcttcctcctccatcttctccaacttcttcctcctcctcctctttctcttatcttcttcttttcctctatctttctcttcctcttctctcctccttctcttttctttctgcccttctttccttttctctattcctccctttttcctcctccttcatcttctcctccttcttccttctcctcctttttctctttctatccctctgtcttcctccttttattttttctccttttcctcatcttcctttttctctctctcccttcccttcctcctcttccccttcctctttctcctcctctctctctgccccctctattatcaatttacagtataatccagcttttcctaaaaaaaaactagacaaccttcacactacacccttctgtttctaaaagtcttcctctgaatcgaaatcactcttgttcacttgtgtgaggctgggggattcctgaatgaacttgtatccacttgttttgaaaacaacaacaactaaagcaacagaacttcctttaggattcatatagagcattcatatggaattaccgagaactatcttcttttgtccacagccccaaagctggggctcaatcccctgcagtcctggggtctggggtcctcacgcttagcactcaagagaatgggccagagagcttgtaaaaacaactgcacccctggtatttctaactcagtggatcttaggaggcccaagaatcagcatttttttttattttttattatttatttatttatttgagatgccagggctggagtgcagtggcatgatcttggctcactgcaacctccgcctcccaagttcaagcaattctcctgcctcagcctcccgagtagctgggattacaggtgcctgccactacatccagctaattttttgtatttttagtagagacaggatttcaccatgttggccaggctggtctcgaactcctgacctcatgattcgcccatgtcagcctccaaaagtgctgagattacaggcatgagccatcgtgcccgacccaagaatctgcatttctaacgagctcccagaggctgctggtctcagagaccacgctgggaacctcactcattctagcttcttatgcagctctgcaaactatacaccatgggcaaaattcagcctgtacctgtttctgtacaggctactagctaagaatggttttatactcttaaagtgttgttaagaaaaagaaagaaagaaagaaagaaagaaatatgccaaagagactagaggtggcccacgaagactaagacacttcctatctggccgacctcctgtgtagagcaaggaactgtggcttcgcggcagaatttcattatctgccgctgtgcagctgtggctgacagacgctgtcttccacacattctcggaatgatgaagtgggcttgcttggtgacgccttgtgcagggaaatgaaagttgtcttctgaatacacaagacggtcctgtaaatcatgctccctgtggcttaaataacacatcctgttttatctacagcttttttttttttttaaatgacaatctttagagactggcaagaggacagaagatgtataaatgtgaacccaaatccaagaacgcagtgtgttcccttttaacagacacaagagcatctttgaagttccagacgcccggctggggggcgctggggagacggtgcagcaccatttatggtaaaatctgcatcaagccactcttgagtcctggagagtgttggagctgcaagctacagaaaccatttcaacttcattcagtccaatgaatgtttattaaatgctcacccgtattttgccagctcttggggcaaaggaagagaatttcagaaataacccctgctgcccaggagcttccaatagacatgggcagtgggtggatggtgaggcacaagtgcaggaaaaaaaaaagatgaaacacacacaaaatagaagatagagtttcaagtgtactaaatagagccacaagcaatatagtcagagagaggaatgaatggctcataattacataattacacagagctttacagtggagaaaatggtttcccatatattctgtcggcaatgttcacaacactcttatgtgatattattatccagaattaacaaattagaaaaatgagaggcatagcagggaaggagaggagaagggagctgttgcaggaaatagccactgcctgattcttccagggacccctccctcgtcatctcccttctttctctgctttgctatcatgagccctgatccatgcacacagctggatccatgcacatgcattcaatatctccctccctgccttcacccatgcacacagccctgatccatgcacacagctggctccatacacatgcattctgcagctgcctccctgcctgcatccatgcacacagccctgatccacgcacacagctggctccatgcatgtgcattcaatatctccctccctgccttcacccatgcacacagccctgatccatgcacatgcattcaatatttccctccctgccttcatccatgcacacagccctgatccatgcacacagcccagatccatgcacacagctagacccacacacacacattcagtacctccttccctgccttccaggcacagagccctgatccacgcacacagctgttttaggttttttgcagtagtattcagaacagcaaagatatgcaatcaacctaagtgtctgtcagcagaggactggctaatataaagaaagtacagtatagtatatacacaccatggaatattatgcagtcatatcaaagaatgaaatcatgtcttttgcagtgacatggacaaacactgcacgtttccactttttattttattattttactttttattttttgagacggagtctcactctgttgcccaggctggagtgcagtggcacgatcccggcttactgcagtctctacctcccatgttcaagcgattctcctgcctcagcttcccgagtagctgggactacaggcgtgtgccaccatgctgagctaatttttgtatttttagtagagacggggtttcaccatattggtcaggctggtcttgaactcatgacctcaggtgatccacccgcctcagcctcccaaagtgctgggattacaggcatgatccaccatgcccagcctgtttccactttctaaggtccctagagtcatcagattcatcaagacagaaggcagaatggtgttgctaggagctaggaacagcagggaaattggaagttgtattttaatggaaacagagcttcagtttgaaaagcaggccgttctcctaacaaacaactcagatactgaaagtcaaacactgatcctgccatgttctcacttgcaagtgggagttcaccagtgggtctacacagacacagagggtggattgacgatgaggaccctgaaaggtgggaggttggcaggaggtggaggatgaaaaaaatcacctacaggtatagtattcacagctggggtgaggggttcactagaagccgggacttcaccgctgtgcaatgtctccatgcaagaaatccgcacctgtactccttaaatttataataaataagtgaatcaataaatacataagccgggctgggtacggtggctcacacctgtcatcccagcactctgggaggccgaggccggcggatcacaaggtcaagagatcaagaccatcccggccaacatggtgaaaccccacctctattaaaaatataaaaattagctgggtgtggtgagacatgcctataatcccagctactcgggaggctgaggcaggagaatggcttgaacccgggaggcaggtgttgcagtgagccaaaatcatgccactacactccagcctgggcaacagagcatctcaggggaaaaaaaaaaaaaaaagggaacaaaaaaagaaatccgcacctgtactctttaaatttataataaataagcaaatcaataaatacataagccaggacgggtgcggtggctcacacctgtcatcccagcactttgggagaccgaggcgggcggatcacgaggtcaagagatcaagaccatcccggccaacatggtgaaaccccatctctattaaaaatataaaaattagctgggtgtggtgggacatgcctataatcccagctactcgggaggctgaggcaggagaatcgcttgaacctgggacgcaggggttgcagtgagctgagatcgcgccattgtactccagcctgggtgacagggtgagactccgtctcaaagaaaaaaaataaataaataaaataaataaatccgcacctgtactccttaaatttataataaataagtgaatcgataaatacataagccaattggtgagatgacccataaagacaaacaaagctttgtgaggggaaagcaagcgcccaggagaagccctgtcttcggaggttttggcgcaggcctgaatgaagggaaggagagggattggatacctgggggaagggcgtgcgtggaggaggaaacagccagggctgaggcctgcacattgcagggaaagggtgaagtccctggtggctctacctggagcaatttcttcttattttttctttttttgagatggagtttcactcttgtcacccaggctggagtgcagtggcgcgatctcggctcactgcaacctcctgctcccgggttcaagcgattctcctgcctcagcctcccgagtagctgggattacaggcgtccgccaccatgcctggctaatttctgtatttttagtagagacggggtttcaccacgttggccaggctggtctcgaactcctggcctcatgtgatccacccgcctcagcctcccaaagtgctgggatgacaggtgtgagccactgcgcccggccacctggagcattttcagtggagcatgggggactggaagtgaattgtatgagcaattcctgtatggggatttgctgcagcggagactgtagtcagggacagtccccaggggaaatagaaggtccagagagggtggttagatttgtttattaataaaaaaaaaaaaagaaatgggggggctgggtagggtgtctcatgcctgtaatcccagcacttcggcaggccgaggcaggcggctcactcgagactgtgagttcgagatcagcctgagtaacatatcgaaaccccgtctctactgaaaatgtaaaaattagccaggcgtgctgggaggtagctgaggtcccagctacccaggaggatgaggccgaattgcttgaacccaggaggcggaggttgcagtgagccgagatcgcaccactgcactccagcctgggcaacagagagaggttccatcttaaaaaaaataaaaataaaaaaattcccagtacctgcatccttgatttgattaattaacctgtcaccctctcggcacatcaatccaagttccaatcaaccctaagacagactttcattagactgcatggcggatacaaatacatgcttaagacaagcaatgatacgagtggtctacttcatggtgaagtgggcgcagtctacactgcaaatttgttcattttgatggcaggcctgatcacatgatttcaaagtggtcaggacttgctggacatgagccctgaatggtggagctgatacactcagcatttacaatagctttctatttttttttttttttgagatggagtttcgctcttgtcgtccaggctggagtgcagtggcatgatctgggctcaccacaatttccgcccccgggttcaagcgattctcctgcctcagcctcctgagtagctgggattacaggtgactgccaccacgcctggctaatttctgtatttttagtagagactgggtttctccatgttggttaggctggtcttgaactcctaacctcacatgatcctccccctcagcctcccaaagtgttgggattacaggcatgagccaccactcccagccgatagctcttttttgtaacacccattgatcttgagacaactggggtgggaagagaggtaatagccacgttcatttgctccctaggaggggtatacattgtagggggtactgagtttcactgatgaagctgcgaggagcttcctagaggtctgaagagcacacatgccctctgaaatactaagctactctcctacggaggctgagaccatctgcatgtctcagcatgaagaatggcctgatgcatttgtatacaggacaaatcaaacctctcatctttataaatgcacaaatcataatcccaacactttgggaggccacagcaggaggatcgcttggggctaggaactggagacccggctggacaacatagcaagacctcggctctaccaaaaaattttaaaaaattagccaggcatgctggtgcattcgtgtagtcccagctactcgggaggtggaggtggggtgatcgtttcagtccagcaggtcgaggctgctgtgagctgtgattgtaccactgcactccagcctgggtgacagggcgagaccccatctcaaaaacaaaccaatcaacctcctagtttttcttctggtaccgactggtcgcccaggttactggccgtgaatttggaatcgagtccatgtgttctgatgagacagaggatagaggtttcagagtgacatacaaccatgccctcagatgatatgaaacatcacagagatatgtatgtcacacagattctccccagggaccctggacagatcctgcaaggtttttcttctttcttttttttttttttgagacggagtttcactcttttcacccaggctggagtgcaatggcgccatctcggcttactgcaacctccgcctcccaggttcaagcgattcccctgcctcagcctcccgagtagctggaatgacacacacgcgccaccacactcggctaattttttttttttttaatagagatggtgtttcaccatgtttgacagtctggtctcgaactcctgacctcaagtaatccactcaccttggcctcccaaagtgctgggattacaggcatgagacacggcacccagctgatcttccaagtcttaatatacaatgcatgcatgcatgcatgcatacacactagtaaataatacatacacagcaatacagaattatcattacaaagacagcatcaagctactgcagctgtatagccttttctttaaaattcttacattattttaatttcatttccaggctaatgcatattcttctgctctataattttaaagtttccacaatgttgtctcttatataaaggcagtatcactcgagcaatgccccgtggttatttttaatccaaatttgcagatgatgatcaaaggattaaagaatgattcatgtggctaaagttgcagtttgcttgttaaatatttagaaagaaataatgtcaaggccagccatggtggctcatgcctgtcatcccagcactttgggaggcagaggtgggagaatcacttgaggccaggatttcaaggttgcagccagtgattgtgtcataattccagcgcacaagaccaacctgggcgaacagcaagatgccgtttctacaaaaaaaaaaaaaaatgcacagcagccagggtgacagagcaagacctggtctctaaaaaatttaaaagaggccgggcgtggtggctcacgcctgtaatcccaacactttgagaggccgaggcaggtggatcacgaggtcaggagatcaagaccatcctggccaacatggtgaaaccccgtctctactaaaaaaaaataaaaaataaaaaaaaaattagccagacgtggtggcgggcacctgtggtcccatttactcgggaggctgaggcaggagaacggcatgaacctgggaggcggagcttgcagtgagctgagatcgcgccaacgcactccagcctgggcaacagagcaagactcagtctcaaaaaaaataaataaattaaataaaataaaaaaacagcaaatgctctccttggatactgaagtcactctctgagggattcatgggggttttataaggatgaaatgtatcctagtgttggtgtattgctagcgaatacttagtgcttaataaaataactaatattttgaaattcctttgcttgaggaattagagatgtgaagaacaacagatcagaaagcaaactgcaaaataagggatgtacagctgggcgcggtggctcacgcctgtaatcccatcacttaggaaggccgaggtgggcggatcacccgaagtcaggagttcgagaccagcctgggcaacataatgaaaccccgtccctactaaaaacacaacacttagccaggcttgatggcaggtgcctgcagtcccagctactcaggaggctgaggcaggagaatcacttgaacccaggaggcggaggttgcagtgagctgagatcgcgccagtgcactgcagcctggtgacagagcgagactctatctcaaaaaaaaaaagaaaaagaaaaagaaaaaaagaaattcctttgcttgaggaatgagagattcgaagaacaactgataagaaagcaaactgcaaaataagggaagtaattaatcccctcaaaaagtccacattgggggcgggcagctcatatcatgagagactttcagacgaaatcaagagcaatgccaggagtccaacagggagaaaagagaatttgtaaccaagctcattaattccaaagcttgatgaaacagacaattacctaaagggaaaagctgtctaaactgactcagaaagaggtgggaaacttcaacaagcagtagacgcccaaggaattttgaaagctgagttagaatcgctcttccgaaaattcctcaacccatgcggttttgaaggtgaatcgtggcggtgtttcaaaagcagacacttttaaaaatgctaattagacgattctgcaatgtaaagggagaaatagaaaagcttctcaaggttctttctttgttttgtaaacaaattattaaaactttagtatcccgacttgagatagataggaaagaaagtaaatctatagctcccagatacatatcacttcaaaagacctcaaggaggacaggcacggtggctcactactgtatcccagcacttcgggagaccgaggcgggcagattacttgaggtaggtcaggagttcgagaccagcttggccaacatggtgaaaccctgtctttactaaaaatacaaaaactagccgggcatggtggcgcacacctgcaatcccagctactcaggaggctgaggcaggagaatcacttgaacccgggaggcagaggctgcagcgagccgagatcacaccacggcactccagcctggtgatagagctagactccatctcaaacaaacaaacaaaaaaacccaagggaatggctggggcatgaaatcttgcagtgcttaagaagttaatgcatcacgacaacgaagatcattgcagaaatgtgggagctttcagctgctgggtcttaaaaaccaacaccccaaagtacggtgctttgtcctgctgaactgaagaagcctcaagatctctctaacttccccctcctgcttcctctgtgtctcccgatgcacaggatgaagttgttctctgaagtttcctgaagtctggacatgtcaaagaaggaaaaatgaccagtgtccccttccctgagtttctgaacccacatcgcggaggaaagactgatgtctgtcaacagccctgcagagactcctcataaaccactgtctgttctgagggttccacagcctctgtccctgcagagactcgtcataaaccattatctgaggccaggcgcagtggctcacacctatcatcccagcactttgggagcccgaggcgggtggatcacctgaggtccagagttcgtgaccagcctggtcagcgtgatgaaaccccgtctctactaaaaatacaaaattagccaggcgtggtgtcacatgcctgtaatcccagctactcgggaagctgaggcaggagaatcgcttgaacccaggaggcagaggttgcactgggcagaggtcccgccactgcactccactctgggcaacacagaacgaaactccgtctcaaaaaaaacaagcaaacaaacaacaataacaaaaaacattatctgttttcgggccactgtacattgttcaaacccattgacttctctttaaaatcatttactatttggaatcctatattcacccccaattccccactccccttccgctaagaagaagaggacacaagcgtctgtacccctttgtgtaatggggcaattcctctgacattctcctccatggatgagaatacatttgcctgtcatttcctttattcatgtttcaaaaagggcaattgtattttgtgcgttgatttttcagcaaaccttcaaatggcaaagggggatgtttttcccttggcccctaccacagcatccccaaacggtctccagctcctaagaagattcatttatgggcactacctagctacacagcgtcacccaccgagctcgcacacaaccaaggctttggggtgagaatgtacaaatacatcacggaatccaagcccccaacaccgcacacgcagcctggaagtggttgtgtcagagctgtgtgaaccagcgtgactccatcttgaataggggctgggtaacacgaggctgagacctgctgggctgcattcccaggcggttaaggtatgctaagtcgcaggatgagataagaggttgctacaaggtacaggtcataaaaaccttgctgatacaacagcttgcagtaaagaagcgggccaaaacccacaaaaagcaaaatggcgacaagagtgacctccggctgtcgtgacggctacattcccaccagcgccaggacagttacaaatgccacggcaatgtcaggaagttaccctctacggtctaaaaaggggaggcatgaataatccccccctcgtttagcatatcatcaagaaatcaccgtaaaaatggccaaccagcggccgccggggatgctttgtctgcggaggagccattcatttactcctctaccttctcaataacttgcttctctttccaccactgagccgtcctgaattctttcttgcacgagatccaagaaccctcccttggggtctggactggggaccccctttcctgtagcatcttcaggtgcagccgtgaatcagagaagcagaaggggcttaccttgaaaagcaaccagccgagaagcttcttcgccagacgggtggcccagaacacgtgcttgtagacgtccgtgttgaccaccccggggtccaccacgttggcggtcacgtggcttccctcagccgccagcagccgctggaggtggtaggtgaacaggacaagggccagcttgctctgggcgtaggctgcgtggggtgagtagcaggcactgtggggcaagcaggagaaggtgtaagaggctgacggcgttcacgcctaagtgcttcatcccagcagcatctgtacctgcggccacggccacgtctatacgcagccacctcccctagacccatgtgtgatcatgccatctgttggccagttttccaacgcgtgtggatttttctagttcacctttttattataaactcatcccttaattgtattggggtcagatatgttaaattatgttactaattttttatttatttatttatttattttggagacagagtcccccctctgtcgcccaggctggagtgcagtggtgcaatcttggctcactgcaacctccacctgcccggttcaagtgattctcctacctcagcctccccagtagctgggactacaggtgcccgccaccacaccctgctaattttttgtattttcagcaaagatggaagttttaccatgttggccaggctgctctcgaactcctgacctcaaattatccacccgcttcagcctcccaaagtgctgggattacaggcaggagccactatgctccctgttttttttttttttttttttttttttttttttttgagacagattctcactctgtcacccaggctgcagcctcccgggttcaagcgaatctcgtgcctcagcctccagagtagctgggattacaggctcctgtcaccacgcccggctaattttttgtatttttagtgggaacagggtttcaccatgttggccaggctggtcttgaactcctgacctcgggtgatccaccctccttggcctcccaaagtgctgggatgacaggcatgagccaccgcgcctggccacatgtggtcttcttgatgagtctcaaatcataaaagacaaccacacaagcaatttggcaaacttcccaagctatcataaattttcctcacatctactgcaagctctgtagtgtgctaagcacatgttaaactctttgcaccttggttcaagcagtttagagaaatgttttagtatcacaggacatagtgataaaaatcgatccgataaccgcggtaaagtgagtaacgtgcctctctctctctctctggtaacctcaatcaccagaaacacagaaaactggatgtttccagctttgctcctgtaaatatgttctactttttctatgtatgccttagaaacactttttaaagagatgttatttgcggtgttacataacgtcccttgaaggcacacaaccaccatagactccttttagaatttaatgctaggcacagatcattagccttagaattggcctcatagttcttttcaataagacaaggagaagtatttgagcaataatgtttttctttcctctggggctccaaagatgcccagaggcgatcaatttgctacacaattatcgtaacaacatttcaaggtggctgaaggttcatatcgcttgcttcttttatatatatatatatttttaaattttatttttatttatttatttttgagacagagtcttgctctgtcaacccagctggagtacagtggcgtgatctcggctcactgcaagctcctcctctcgggttcaagtcattctcctgcctcagcctcccaagtagctgggactataggcgcctgccacctgcctggctaattttttgtatttttagtagagacgaggtttcaccatgttagctaggatggtctcgatctcctgaccacgtgatctgcccacctcggcctcccaaagtgctgggattacaggcatgagccactgtgcccggcctaattttctgaattaaccacatggtatatgtatcctgatggaagctgtgaacagaaaatatctgggcaccccaaaagcgggaagctcaaaggaaaagtccagctggaacctgctgaaggcaaacctgcctcccactctgttcaaagtcacccctgtgctcactgagatagatgcatatctgatcacctcctttgggaaggctcatcacaaacccaaaagaatgtaaccatctgtgtctcacctacctgtgagctggaagccccctccctgcttccagttgtccctgcttttcaaggactatacttcttatttttttgagacagagttttgctcatattgcccaggctggagtgcagtggcacaatcttggctcactgcaacctctacctcctgggttcaagccattctcctgcctcagcctcccgagtagctgggattaccagcgcccgccaccacgcccggctaattttttgtatttttagtagacatggggtttcaccatgttggccaggctggtctcgaactcctgacctcaggtgatccgcctgcctcggcctcccaaagtgctgggattacaggcgtgagccaccgcacccaccccaacgtagctcttacatatattgattgatgtctcctgtctccctaaaatgtataaaaccaagctatggccagacgcagtggctcatgcctgtaatctcagcactttgggaggccaaggcgggcggatcacaaggtcaggagtttgagaccaggctggccaacatggtgaaaccctgtctctactaaaaaaaaaaattaaaaaattagccaggcatggtggcatgtgcctgtagtcccagctactccggaggctgaggcaggataattgcttgaacctgggaggcaaagggtgcagtgagctgagattgtaccactgcactccagcctgggcaagagagtgagactccatctcaaaaaaaacaaaaaaacaaaaaaacacacaaacaaaaaaaaaacaagctgtgacctgaccacgttgcacacgtcatcaggactttctgaggctatgtcacaggctcacgtccttaaatttggcaaaacaaactctaaattaactgagacctgtctcaaattttcagggttcacaaagccatctcagatatagtttgaatatcagcatgatatttatgctaaaaaactaaagataagatcaaaaagcctaaaagaatgtttaacacattcaaaagatcaaaagaaagacatccgtcatcatatgcgtttcagaaaaagcttctgaaaatccaatgcctcttaccaacaaaagctgttcctaaataagaatacaatattgagggctgggtgcgttggctcatgcctgtaatcccagcgctttgggaggctgaggtgggcagatcaccaggtcatgagtttgagaccatcctggttaacatggtgaaaccccatctctactaaaaatacaaaaaattagctggacgtgctggcgggtgcctgtagacccaactacttgggaggctgaggcaggagaatcacttgaacccgggaggtggaggttgcagtgacacgagatcacgccattgtactccagcctgggcaacagagtgaaagtctgtcaaaaaaagaaagaaagaaagacagaaagagagaaagaaagaaaagaaagaaaagaaagaaagaaaaagaaaagaaaagaaagaaagagaaagaaagaaagaaagaaagaaagaaagaaagaaagaaagaaaaagaaagaaaataaaagaatagaaaattgaaataaatgaagtaaactttgacctaaggatctggagaagaaaaatgaaaatgctttcctaaggaaaacacataaaagaaaaccaaaaagatcaaagcaaatgagaaatacagaaagaaaacagtataaacataaatgataccactggggaacagagactgatgttggtttttgttgttgttgtttgagaaggagtcttgctctgtcacccaggctggagtgcagtggcgccatctcagctcactgcaacctctgcctcctaggttcaagcaattctcctgcctcagcctcctgagtagctgggattacaggcatacaccaccatgcccagataatttttgcatttttagtagagacggggtttcatcaggttagccaggctggtctggaacttctgaccccaagtgatccacccaccttggccttccaaagtgctgggattacaggtgtgagccactgtacatggccctggtattggtttctaaacctcctctccctgttataaaatgtccaatatacactatattttgcagatgaaaagtagaatattacaattacagagcagaccctgaaactataaaaaaaaaattagggctgggtgcagtggctcacacctctaatcccagcactttgggaggccgagatgggcagatcccgaggtcaggagatcgagaccatcctggctaacatggtgaaacctcgtctctactaaaaaaacaaaaaattacccgggcatggtggcgggcgcctgtagtcccagctactcgggaagctgaggcaggagaatggcgtgaacccgggaggcggagcttgcagtgagccgagattgcgccactgcactccagccttggtgatagagtgaaactccgtctcacaaaaaaaaaaaaaaaaaaaaaattagataccctctatattcatgtattcattttttcataaaataaatgaacaaaaccaataatgcatgcctatgctggggctcagagaacagtaacctaaaatgaagacctcagaagcagcatcagaagcaaacctttcttgctgaccttctcctaccctcctgtctctcagacccatttcgccccaagggcaccacggaaactggaatccttcttccccaaggtgggtcccgaaaaccaaagcacctttcccccaaggccagccagaaaccctataaataggactctaagtttccctacaccctgagtatataaaaactcgccataaagaaatttcctatcatcgtgcagtggctcacggctataatcccggcactttgggaggccaaggcaggtggatcacttgagatcaggagttcgagaccagcctgcccaacacagggaaacatcacctctactgaaaatacaaacattaggccgggcacggtggctcacgtctgtaatcccagcactctgggaggccaaggtgggcagaccacaaggtcaggagatcgagactatcttggctaatacggtgaaacccggtctctactaaaaatacaaaaaattaactgggtgtggtggtgggcgcccgtagtcctagctacttgggaggctgaggcaggagaatggtgtgaacccaggaggcggagcttgcagtgagtggagattgcgccactgcattccagcctgggcgacagagcgagactctgtctcaaaaaaaaaaagaaaaaagaaaatacaaacattagccaagtgtggtggcgggcacctgtagtcccagctactcgggaggctgaggcaggaaaattgcttgaacccagaaggtggaggctgcaatgagccaagattgcgccattgcactccagccagggcgacaagagcaagactctgtctcaaaaaaaaaaaaagaaaaagaaaagaaaagaaaaagaaagaaaagaaaaggaaaaggaaattccttgacctgccttgtttgaatgtaggttctacgacccccttcccagagagggtcccaccccacccccagaaggaaggcgcactgctcagaggccaaaaaaatctagacaggcctgtctgtttccccactcagaccgtcagccttagatcacaccctcttcctccaatcctattcctacacggatttcgttcagacgtcgttgaacctaagcataaaaatagacggtttcccctgcatctttgggtcttccctctgaaggctgctgtatgtatccatcgagtaaactttgtatgccttttctcctattcatctgcttttgcaagttgatttttcagcttgcaaaatcagagggaatgaccctccatctgttctcctatcacactgtcatcatttccactgtgaagaacatggggaaaactggccagacaaccaaaggaagggcgtgcacatacatttgcacatcttttgggagagcaacttcacaacatgcaactcaatctttaaaatcataaatctttttttttttttttttttgagacagagtcttgttctgtcgcccaggctagagtacagtggcacaatcctggctcactgcaaccaccccctcctgggttcacaccattctcctgccttaacctcctgagtagctgggactacaggcacctgccaccatgcccggctttttttttttttttgtatttttagtagagacggggtttcaccgtgttagccaggatggtctcgatctcctgacctcgtgatctgcccacctcggcctcccaaagtgctggaatgacagacgtgatgtgagccaccacgctcagccctttttgtgccttttttttttttttttttttttttttttgagacagagtctcgctctgtagcccaggctggagtgcggtggcgcaatctcagctcactgcgacctccacctcccgggttcaagtgattctcctgcctcagcctcccaagtagctgggactacaggcgcctaccatcacgcccagctaatttttgtatttgcagtagagatggggtgtcactgtgttggccaggccagtctcgaactcctgacttcaagtgaaccgcccgccttggcctcccaaagtgctgggattacaagcgtgagccaacgcacctggcctatgaatatcttttagtaacatcactacttgaaattgatcttaaaaaaataaaccttgggccaggcatggtggctcacgtctgtaatcccaggactttgggaggccaaggctggcagatcacgaggtcaggagatcgagaccatcctggctaacacggtgaaaccccgtctctattaaaaatacaaaaagttagccaggagtggtggcgcatgcctgtaatcccagctacttgggtgctgaggcaggagaatcgcttgaacccgggaggtgaagattgcagtgagccgagatcacgccactgcactccagcctgggcaacagagtgagactccatctcaaaaaaaaaaaaaaaaaaaattaagcattgattcaaaaagtcttttctggctgggtgcagtggctcacatctgtaatcccagcagaactttgggaggcagaggtgggcggatcacctgatcctttcaggggtttgaaagggttcttggatctcgtgagaaagaactccgagtgggtccatagagtaaagtgaaagcaagtttattatgaaagtagaagaataaagaatgtgtactccatagatggagcatcccgagagctgctggtggcctatttttatggttatttctctatcatatgctaaacaacgggtggattactcatgagttttctgggacaggggtgaccaattcccggagctgaaggttcatcccccttttagaccatgtcatggcatctgtaaaccgtctcttatcagctaatgcattagaattagcgtatcatgaccagagaggatgaccagaggtcagtcgtcaccatcttggtttcggtgggatttggctggctttaccacaacctggtttatcagcagggcctttgtgacctgtgtcttgtgctgacctcctctgtcatcctgtgacttagaatgcctcatccacctccagagaaggcagcccaagcaggtctcagcctcatgttacgcagcccctattcaagatggcagagttgctctggttctaatgcctctgaaaaatttaggggattgttttctgagccccaacactgtgatcttagcaactgagcaattttcccaccttcatgtaaccaaagacagagtggatcacagagcttggaaagctcgtacccgggaaatcgcagcctgcagctgacatgttctgagatgtgccttgccgttgtgcaaaaggcatgtttgaatgcttgcatgaggacaagtgactcccccattaacacctccaggggctcagttctgcctccagccactgtctcatcacgcagccatgggtagcagaaagccacatgccaaaatctgacatcgggcctgtaaaaaataaaggttcctgttcaaagactttcctccccatctaattaggaataaatagtaacttctctgagaagcaaacttcattcaaagacttgtgctaacattcctaaatatctgctagccgtgataaagaaatcaatgtactttatgctcttagctcccacaatttaacctaagtatcagccctggcatgcttatactggtccaagcaagcattacgtcacagcctgttcctcttctttatctaaaagtgctttttcctttctcagcattccacaagttacttcctccttcctttgttctcctctgcctttgcctcttttaaatagttccaaggtgctggccaatcgggacaaatacagaatgtgaggtcccattccagccctggaaactggacacagcagtagggcggacgcatcaagtgataaatgaccctgtcccctttgttcgctgtactctcctggcaaaactgctggagagtgtaccctttctgcagaaagtaaaaaaaatggccttgctgaggaaattaatgttcaagtgctatttctttatggcactggggaacaagcatttcaaacagacctgaggtttacccgatttctgctggaaaagaaacctcaggtctgctgccttagaaataaataagggcaggacagaaagggtgacaagggggtccttagccatggagactttgcaaaataatgaacaatcaaaacataactttttgggggttggggtggggtaggaggggactggaaaggctgactgcataataaagagattggaagaattggctgggtatggtggcttatgtctgtaatcccagcactttgggaggctgaggtgggtggatcacctgaggccaggagttcgagactagcctggccaacatggtgaaaccccgtctctactaaaaatacaaaaattagcagggcgtggtggcaggtgcctgtaatcccagctactcgggaggctgaggcaggagaatccttgaacccgggaggtagaggttgcagtgagctgataccacgccattgcactccagcctgggtgacaagagcaaaactctgtctcaaaaataaataaataaaaagaaatctaagagactggaagaattaagacagggaaattgagtagttcagagctgaagtcccatctctgatccaagataaactgtaaacctccaattactgtcaagatatctttttaaggcaaacttctccaatctcctcaccccaggggaagagaagagtccaggaaacagatagttactaagtgcagagaggcaaagactggctttcctgctggcatgatcgttttttaaatatcagctacaagcattcggttctgaatctccagcatttgattgatgggtaagaggaatggttacttgaaaaagcagaaaatgcatcatccaaaggcagatttttccagagtaaatggaggggttggttctgtaattatggttttacacagtagcgtggagaagagagaactaagattgtttaaaaatacggtgtgggggcaggcgaaaagccaatacatttctctacaggaggtgaagaaatgaatccaagaggggcacgtagtttcaggagagattccctggggtgggggttagggatgaagaaatatccaccccagaaatgggaaagaatgaaagcaaatacgtaggaggaaatgcccattaaggtctgtaaatgaaaccctaaggactctgacaaaagtcgttggtattaggccgggagtggtggctcgcgcatgtaatctgagcacttaggggacactaaggcaggcaggtcgcttgagcccaggagttcaagaccagactggggagtatagtaagaccttatctctacaaaaaatacaaaaagtacctgggtgtggtaaagcacacctgtagtcccagctaattgtgaggctgaggtgggagcagatcatttgagcctgggaggcgcacatggcagcaagccaagatagcgtcactgcacggcctgggaggcagatatggcagtgagccaagatggcgccactgcacggcctgggaggcggacatggccttgagccaagatggcgccacggcactccagcctaggaggcggacgtggtcgtgagccaagatggcgccacggcactgcagcctgggaggtggacatggccttgagccaagatggcgtggccgcactgcagcctgggaggcggacatggccgtgagccaagatggcgccacggcactccagcctaggaggcggacatggccgtgagccaagatgtcgcggccgcactgcagcctgggaggtggacatggcagtgagccaagatggcgccaccacactccagcctgggaggcggacatggccgtgagccaatcagcaaagatggcgccactgcactccagtctgggtgagacagggagactgccaaaaaacaaaatgaaacaaaaaatcattcaatgagctttcctgttgaataagaaactgaacaaaagccacctgctactaaatctggaccttataaaagggtatttgagttctccattttttgctgattaaagcattactctcttcttgttattaaaaatcgtgaagactgaacatacttttgagtgtttataagaccgggcgcggtggctcacgcctgtaatcccagcactttgggaggccgaggcgggcggatcacgaggtcagaatatcgagaccatcctggctaacagggtgaaaccccgtctctaataaaaatacaaaaaaattagccgggtgtggtggcagacgcctgtagtcccagctactcgggaggttgaggcaggagaatggcgtgaacccggaaggcggagcttgcagtgagctgagatcacaccctgcactccagcctgggcaacaaagcaagactctgtctcaaaaaaaaacaaaaagaaaggagccctttataagttattgtgatggatactgtaggatgtaaacgtgtcatatctcggtctcccaacagccagtctccgtaggcggtgtccttttatatggatcaacaggcagtttttgcattgattatttatccactttgagaggtacttgtgtagaagcaaggacaactgagtttttatgttaacttcctacgaatccgttgcattgcaacgtatttccattgcaggacattgttgcataatcaaattgccaatgcaattagggaaactcaatcgactgctcataacctagttgactggagctatttttccagtgctcattaaacctgatgacaatcactgttttaatgagtaagtatgggtggcattcaatatatttataagtattataacaatccttcatgtctaaattgaattttccctttggcagtacaaacaactccattacattctttctaggatatctacgcttaatattcttgataactatcatctacatttaatattcttgataacgatccgcctaccaggaactcagaaaatactgcgaataaagagaggttttttttgtttgtttgtttttttgaaacagggtctcgctctgttgctagggtggagtgcagtggtgcgatctcggctcactgcaatctccgcctcccggattcaagtgattctcctgtcttagccttccgagtagctgggactacaggtgcccgccaccacactcagctaattttggtatttttagcacagtggggtttcaccacattggccaggatggtcttgatctcctgaccttgtgatccaccccctaggcctcccatagtggtgggattacaggtgtgagccactgtgcctgccccacgcccccccccttttttttctttttttttttttgagagggagtcttgctctgttgcccaggccgggctggagtgcagtgctatgatcttggcttgctgcaacttccacctcccgggttcaagtgattctcctgcctcagcctcctgagtagctgggactacagtcacccgtcaccacacccagctaatttttgtatttttagtagagacgggtttttaccacattggcctggatggtgtcgatctcaaagagaggtctttgactttttccgctaagagaaaacaaccaaaacaacacaggacattgcaggtatcttgtgaattccagctgcatccaaacaccctgatactttcgctcatagacacatagtgagtgtgtcagctgtccgacatatctcagaacacagggggaacatgtgaaaccttgagtgaaatccgaatcgagatgggataccacactcaaaacacgttacacaacttagtctatactggatgatttcacgggatgtgaattcatggttaggaataaaataatgaagaagtcacccaaagttacataagttgagaaactcaaaccaagacagccatgttcacagtgaggcacgcccatgcctataacaactccatgactgagggacgtcagagtgaaataaagaatttcttaaataggtagagaatctatcatggccaggcacggtgggtcacacctgtaatcccagcacattgggaagtcgaagtgggcagatcattcgaggtcaggagttcgagaccagcctgaccaacatggtgaaaacccagctctacaaaaaaaaaacacaaaaattaggtgggcatggtggcggtgcctgtagtcccagctacccgggaggctgagacaggagaatcacttgaacccacgaggcagaggttgtagtgagctgagattgcgccactgcactccagcctcgatgcctgggtgacaaaagcgaaactctgtctcaaataaaataaaataaaacaaaacaaatttaagggtctcacaggaaagaaatcttaaagaatagaaaatgattttggaaggtatgtgtccctcttttttttttttttttctctccaggctggagtgcagtggtgcgatcttggctcattgcaacctccacctccccggttcaagcaattctcctgcctcagcctccccagtagctgggactacagggacatgccaccatgcctggctaattttttatattttagtagagacggggtttcaccatgttggccaggatggtcttgatctcctgaccttgcgatccacccctctcagcctcccaaagtgctgggatgacagacttaagccactgtgcctgcccttttttttctttttttgagagggagtcttgctctggagtgcaagctgggctggagtgcagtagcatgatcttggcccactgcaacctccacctcccgggttcaaacaattctcctgcttcagcctccaaagcagctgagattacaggcacatgccaccatgcctggctaacttttgcatttttagtagagacggggtttccccatgttgaccaggctggtctcgaactcctgacctcaggtgatacgcccgcctcggcctcccaaagtgctttctattgaaatttatttcaccatggggatgattcggtacagccaagttgaggagacatgttctctcatgtgtaaaaactcttggatttttggaatatgttacaacactgtgatttattcctttacaagaacgctaattttccaagccagtaaatcaatcttggcaattaacactaattactggcaatgattatatcaggcaaaagccaagaaccacatctttcatccaaaaaaaaaaagcagtatattttaaattcaagtggttctcatattttagcatgcatcagaattcccccaaagaccttctccttgccaacccctgttctccaaacttcgggttta

SEQ ID NO: 2541 - DNA, 262138 bp, Homo sapiens
  misc_feature (1)..(50): n is a, c, g, or t
nnnnnnnnnnnnnnnnnnnnnnnnnnnnnnnnnnnnnnnnnnnnnnnnnncccttccaggatggtccttctcctgaaggttaatccataggcagatgaatcggatattgattcctgttcttggaataatctagaggatctttagaatccattgggattcataatcacagctatgccgatgccatcatcaccggcttagccctttctgaaaacacagtcatcatctacccccattggaatcacgatgcaaaaaacctgtcccaaagcggtggtttcctatgtgattcttgcatccaggacaaatgacagtcagcagagaggcgccctgttccatcttttggtttgatccagttaaaggcacacacgtgagcacccaacgtttgccaactcagcactgggcagagcctggcctctgaggaaattggcatcttcgtaatcaatatattattatgttttattgaaatgtaagtcattgccgattcagtggctcatgcctgtaatcccaacattttgggaggccaaagagaggggattgcttgagtccaggagtttgagacaagcctgggcaacacagtgagacctcatgtctattaaaaaacaattagatgtggtggcatgtacctgaagtccaacctactatggaggctgaggtgggaggatccctcgagcccaggaggtagaggctgcggtaagctgggattgcaccactgcattccagcttgggcaacagagggagaccctatctcaaaaaaataaaaaggaaatataagtcacataacataaaatgaaccattttaggccgggcgcggtggctgacgtctgtaatcccagcactttgggaggccgaggcaggtggatcacaaggccaggagttcgagaccatcctggccaacatggtgaaaccctgtgtctactaaaatacaaaaaaaaaaaattagccgggaatggtggtgcgtgcctgtaatcccagctactcgggaggctgaggcaggggaatcacttgaatccgggaggtggaggttgcagtgagccgagatcgtgcctctgcactccaggcctggtgacataccaagactctgtctcaaaaaaaaaaaaaaaaaaattaaccatttaatgtgtacaattctgtgacattcaggatgttcaccatgttgggcaaccatcatcactcttgagttccaaaacattttcatcaccccaaaagaaacgccatatacaacagcagccactcccattccccgggccctattccacggcaaccactaatctagtttctgtctctttgaactgaactattctgctactttacagacctggaatcatacaggtgacctattgcgtctggcttctttcacttacgataatactttttgaggttcatctgtgtggtggcatgtatccacacttcattccttttttatggctaagtaatattccatcgcatggatgtaaaatgatgcattgtttttttagagaccagttcttgctctgtggaccaggctggagtgcaatggcatgatcatagctcactgcagcctccacttcctgagctcaaacgatcctcccacctcagcctcctgagtagctgggattataggtgcacatcttcacatccagccaactatttttatgttttgtagagatgggatcttgctatgctgcccaggctggtctcaaactcctggcctcaagcaatcctcccacctcagcctcctgaagcactgggattacaggtgtaagctactgagtctggcatatatatatgtgtgtgtgtatatatatatgtatatatatgtgtatatatatatatggatatataggatatagatagatagatagatagagatagatatatatttttttgagacagtgtcactctgtcacccaggctggagtgcagtggtgcaatctcagctcactgcaacctccacctccagggttcaagcgattctcctgcctcagcctcccaagtagctgggactacaggtgtgcaccaccacacctggctaattcttgtattttcagtagagacgaggtttcaccatgttggccagagtggtctcgaattcctggactcagtgatccacccaccacggcctcccaaagtgctgggattacaggtgtgagccactgtgcaaggccccaaaatgtatttttaattcccgctttactcttctaaaaaatgaaatcatccttactatcaccctaagaaaatttaataatatcctaatatccacatcatgcaaattataataaaggaatatgtggccgggcgcggtggctcacgcctgtaatcccagaagtttgggaggccgaggcgggcggatcacctgtggtcgggagtttgagaccagcctgaccaacatggcaaaaccccgtctctactaaaaaaaaatatatatatagatatatatatgtgtgtgtgtgtatatatatatgtatgtatgtgtatatatatgtgtgtgtgtatatatatgtatgtgtgtatacatatgtatgtatgtgtatgtgtgtgtgtgtatatatatatatatgtatgtatgtatgtatgtatataaaattagccaggcgtggtggtgggcgcctgtaatcccagctactcaggaggctgaggcaggagaatcacttgaactcaggaagcgtaggaagcgtaggttgcggtgagccgagattgtgccattgcactccagcctgggcaacaagagcaaaattccgtctcaaaaaataaataaataaataaataataaagcaacatgcattggtacatctcaacttttgggcttacctctaccctggaaataacgaggcagtaatatgcgtcgtgcctctatgtgttgaatccacaagatgatatgatcatcatctaccccattagacgactgggtggccgacggcaatcacaggccgccctggcctggtgtcctggtaactcgaacaccatgagtcctctcctgtcctctgatttccccaaatggtgatgaaacgcagccagtccaatcgtctctctgttaacgcagtgttttttttttttgactggaaaatcaatcctttgtatttatgtgtaagccgagttaagtgctacgctcaggtgaatcgtaaacaggttttttgtctttgtggccatctgggtcccacactcatgagtcatgtgggtcaggggtgtgttctctgctaggtagcattgccctgtactctgcgacgagtcgaaatcccaggcttcccccaaccaaatgccagtggaggcacttgattcttttgcccacccagcaacccacccacccccaacttcccatatgctctgcagagaacagccagcccccctcaccacatatcgagaaaaaacaccagatcatcaggacaatttcatggaaccaaacctcccactgcagccaaactcacatagaaaacatcctttgcagcctgaaaacccttttaggacctttctgtcactgagtcttataaacctataaagattcattgaacagaaccagagactcaggctcccggaaaagcttgacaaagtcacgcagtgcattagtccattcttgcattgctataaagaaatatccgaggctaggtaatttatttttaattttttggagagagaatcttgctctgttgcctaggctggagtgcaatggcacgatcttggctcactgcaacctccgtttcccagattcaagcgattctcctgcctcagcctcctgagtagctgcaattacaggtgcccaccaccacacccagctaattttttggtatttttactagagttggggtttcaccatgttggccaggctggtctccaaatcctgaccttggatgatccacccgtctcagcctcccaaagtgctgggattataggcgtgagccaccacacccggcccaagtcttataaacctatgaatattcactgaacagaaccagagactcaggctcctggagaagcttgacaaagttacgcagtgtaatatgccattcttgcattgctataaagaaatatctgaggctgggtaatttgttttttattttttggagatggagtcttgctctgtcacccaggctggagtgcagtggtgcgatctcagttcactgcaacttccgcctcctgggttcaagcgattctcctgcctcagcctcccaagtagctgcgattacaggtgcccgccaccacgccaggctaatttttcatatttttagtagagacatagtttcaccatgttgtccaggctggtctcgaactcctgagctcaggcaatctaccccgtgaggctaatttataaagaagagaggtttcattggcttggctgatagttctgcaggctatacacgaagcatggtgccagcatgtgctcagcctctggtgaggtatgaggaagcttacagtcatggcggaaggcaacgtgggagaaggcatgtcacgtggtgagtgtgggagctggatatgggggagaggtgctacacactttattttatttttatgtatttatgagacggagtctcactctgttgcccaggcttgaatgcagtggagcaatcttggctcactcccggattcaagcgattctcctgcctcagcctcccaagtagctgggattacaggcaccagccaccacgcctggctaatttttgtatttttggtagagacggtgtttcaccatgttggccaggctggtctcgaacttctgacctcaggtgatccacctgcctcggcctcccaaagtgctgggattacaggcacctgccaccatgcccagctgatttttgtatttttagtagagaccgggtttcaccatgttggccaggctggtctcgaacttctgacctcaggtgatccacctgcctcggcctcccaaagtgctgggattacaggcacctgccaccatgcccagctgatttttgtatttttagtagagaccgggtttcaccatgttggccaggctggtctcaaacttctgacctcaggtgatccgcctgcctcggcctcccaaagtgctgggattacaggcgtaagccaccgtgctcccagcctttaaacaaccagatcccgagagaactgactcactaccgcaagatcagcaccaaaccatgagggatctgcctctcagatccaacatctctcaccaggctcccagctttgaggatgacaagtgaacacgagattggagccgggacagatatcagaacttttatcatgccgtcagccacagacaagcttctgttgttgttttattttcctaaacaaatcacatgtccctcctacgatgccacagacttttattttattattgttattatttatttatttatttatttattgagatggattgttgctctgtcgcccaggctggagtgcagtggcgcgatctcggctcactgcaacctcggcctcccgggttcaagccattctcctgcctcagcctcctgagtagctgggactacaggcgcccgccaccacgcccggctaattttttgtattttttagtggagatggggtttcaccgtgttagccaggatggtctcaatctcctgacctcatgatctgcctgcctcagccttccaaactgctgggatgacaggtgtgagccaccacgcccagcttttattattattattattttgagatggagtcttgttctgtcacccaggctggagtgcagtggtgcgacctcggtttactacaacctccgcctcccaggttaaagcaattctcctgcctcagccccctgagtagctgggattacaggcgtgtgccaccacacctggctaatttttatatttttactagagacgaggtttcaccatgtcgctcaggctggtctcgaactcccgacctcaggtgatccgcctgcctcggcctcctaaagtgctgggatgacaggtgtaagctaccgcgcccggccctctgtctgcttttatcctagctgtgctggcagctgatcaaatgatgcctgtccagatggagggtgggtctgtctagccctgtccactgactcaaatgttaatctcctttatcaacaacctcccaggaacacctatgatcaatactttgcttcaattcagtcaggttgacactcaatagtaaccatcacagtaaagaaacagcaaaacggaatgccgaccccgtgggctgggcacagtggctcatgcctgtcatcccagcactttgggaggccgaggcaggtggataacctgaggtcaggagttcaagaccagcctggccaacatgcggaaaccacctctctactaaaaatacgaaaattagccaggagtggtggcaggtgcctgtaatcccagctactcgggaggctgaggcagaagaatcgcttgaaccggggaggtggagcttgcagtgagctgagagtgcaccactgcactccagcctgggagacagggtgagactccttcaaaaaaacaaagaaaagaaaagaaaagaaaagaaaagaaaagaaaggaaaggaaagggaaagggaaagggaaagggaaagggaaagggaaagggaaaggaagaagggaatacagaccgtgtaaggattgttgctgtgctctgtcagccacctcctcccaaatactccagagctgaaattgcagaaaacaaaactatgtggtgtgggagtggcagaagtcaaggtcctttcttgtggggaaggatggtgttgatgttggttatcttggtggggggatgttagtttgggagtaaattaaagggaaccagtggaaagggaaatagatgaaagaacaatcaggaagagaaactgaacaaatggaacaaaaacatcggctgggcgcggtggctcacgcctgtaatcccagcagtttgggaggccgaggcaggcagatcacatgaggtcaggagttcgaggccagcctgaccaacatgatgaaaccccgtctctactaaaaatacaaaaattagccaggcctggtggcgggtccctgtaatcccagctactcaggaggctgaggcaggagaatcgtttgaaccggggaggcggaggttgcagtgagctgagatcacgcctctgcactccagcctgggaaacagagcgagactccatctcaaaaaaaaaaaacaaaaaaaacttcatccattgaagcaggaactgtgtgtgtgtgtgtgtgtgcgtgtgtgtgtgtgtgtgtgcgtgtgttggttgacaatagtcaccctattgtgctatgtcttatttattctttccaatttttgtacctattaaccatccccacctcccccactccaaccccctttgtaaccgcaaggataaatgcttgaggagatggacaccctattctccatgatgtgctttttacacattgcatgcctgtatcaaaacatctcatgtaagctacaaatatatacacacctactatggacccacaacaattttttaaaataattcaatttttttttttggttgaaactgagtcttgtgctgtcacccaggctggagtgcaatggcgtgaccttggctcactgtaacctccacctcccgggttcaagtgattctcctgcctcagcctcccgcatagctgggattacaggcacctgccactatgcccagctaatttttgtatttttagtagagacagggtttcaccatgttggtcaggctggtctcgaactccagaccttgtgattcgcctgcctcggtctccccaaagtgcaaaaatttttttttaattgcatacgatgaaatacttgcaaacacacccacacccacatacaactaaaagagaaaatctgaaaaggcggccgggtgcggtggctcaggcctgtattccccagcactttgggaggccaaggcaggcggatcacgatgtcaagagatcgagaccatcctggccaacatggtgaaaccccatctctactaaaaatacgaaaattagcctggcatggtggggctcacctgtagtcccagctactcagcaggctgaggtaagagaatcgcttgaacccgggaagcggaggttgcagggagccgagatctcgccaccacactccagcttggtgatggagtgagactccatctgaagaaaaaaaaaaaagaaaagaaaatctgaagaagcaggtcagattgtatcaatgtctgtatctggttgagcgatttactggagttttgcaagatgttctaattgcaggaaggttggtaaaggtacatgggatgactctgtactacctcttacaactgcatgtgaatttacacatctttgcatacaatttatgtgttagttcaggctgctgggataaaacaccatagagtcggaagcttaaactgttaacattcctgtatcccacttctggaggctggaggtctgagacaagggtgccagtatggttggttcctggtgagaactctcttcttggcctcctttttctttgtttttaattttttttttattatactttaagttctggggtacatgtgcagaacgtgcaggtttgttacgtaggtatacacgtgccatggtggtttgctgcacccatcaacctgtcatctacattaggtatttctcctaatgctctccctcccctatccccccaccccccgacaggccctggtgtgtgatgttcccctccttgtgtccatgtgttctcattgttcaacttccactgatgagtgagaacatgccgtgtttggttttctgttcttgtgttagtttgctgagaatgatggtttccagcttcatccctgtccctgcaaaggacatgaactcattcttttttctggctgcatagtattccatagtgcatatgtgccacattttctttatccagtctatcattgatgggcatttgggttggtcccaagtctttgctattgtgaacagttggctgcctttttcctgtgtgctcacaaggcagtgggacagtgagctcactctgagctcatcatccttttataagggcaggaatctcatgcatgaggctccatccctcattaggctccaccctcatgacaccatcacctcccaaagcctccacttcctaacgccatccccttgggggggtgacaatttctacaaaagaatttggaaggacaccaatgttcggtcgatagcatagtcaataaaaataggagatgatataaaaagatgttaatatctaattgtcagtggatttgtgaactatctgatggtaaatatcagataaaagatagttaaggatagaacatcaaagaaccaaagctaaatctatttttttttttttgagacagagtttcgctcttgttgcccaggctggagtgcagtggtgtgatctcagcccaccgcaacctctacctcccaggttcatgcgattctcctgcctcagcctcccaaggagctgggatgctaaatcttttacagtaataataataaaataacaaactaataaaagaagcattacaccaagaagacagtataatcatgaacctgtaggtctctagtactgcagccctaaaatatctaaagcagagagtgacagagatttccagaactctctctacaaaagacaggataaatacattacatttcataacatgattaaaatttcaatttatagaaatttcaatttatagaaacataagtctataaaaccataagtctgtaaaaccaggagatcgtgaccatcctggctaacacggtgaaaccccatctctactaaaaatacaaaaaaattagccgggcatggtggcaggtgcctgtagtccccactactcgggagggtgaggcaggagaatggcatgaacccagaggcggagcttgcagtgagctgatatcgtgccactgctctccagctttagggagagagcaaggctctgtctcaaaaaaaataaataaataaaaaataaaaaggcaaaaaaaaaatcactaattttaattctacacctttggaaatattaaaataccctcttcatccattggtcaaatcaggcaaaatgaaaacaacgacttcattctaagtctatgaaatgcagccccaggggtcaggaaaaaaatgagttcacaatacatttgttacgattagaaggaagaaaacaaacaaacaaaaaaagatggcatgtatcgaggcaagaaaatagacaacatattccagaatgaaggcaaagaattataagaggataaaacagcagtaactaaaaatgataagtaagcgataaacacaatgatgagtaaaatgtctactcctgaatccgagacggtgcttcacaaagacagcttcagaggccacaattccaaagcttttttctacgtacagatattctccccgatgcctgggttaatggcgcccgaactgcagaaaacataacctcaaccgagttttctgcttcaatgacaaatgacaccagagccccaccaccaaaccatggctggcatctatttagttctgagcactgctctgacagaatgcatcagtcttgctttgctctcagcaaaactgggtgcagaggggacggctgttagcctggtcgttgctaatgaggagatgaggagttggaaagatagagacgcaatggcttaactacggcacctgatgcaagacttgctacctccccagttccagcccaaatggagaaatgggtatgatgcaccttctgtgatctggggatcagttctgatgtctgcggtccagccccccaacctgtcctgcctttgaaaatgtggtgtgtcccttctatgacagtttctcctaacagccaagatgagagataccacatgttcatgacaaagacactctcaaaatcaaggtggcgtccagacacacatctagactgtgatgtgttccccacacaccagcctttgttgactgcacacattcccgctaaaagacacacaccagcctttgctgactgcacatgttcctgctaaaagtcccacaccagtctttgttgacgcacacattcctgctaaaagtccctgtgactacatgagacaatactgccagtttccaggctgttaggacctgctatctttggggacttcctctgttgactacagcctccagctcctttaggacacaagccctgttcttccgacttcgagtcccagtatttgggtataacacttaacacttatttactgaaaacatgactacatggatgaatggatggatggatgaatggatggatggatggatggatggacagatgcatggatggatggatagatgaatgaatgaatgagatggtcccatccattgctggacctgaataaaacctattcatggctactggaagggcataaaagagtagcttcactgggacatccatgcactctaggtccaagtattgaatcaaggtttgccaaagaaaagaaactcattcctcctggttcgtacagagctctaatggcacacatgctactcacccaacaatccacgcggtttcccctgctgggaagtgtctccaggaaattgcacagtgtccaggaaatggcacaatcaggtatcaaggaacacaggcgaacttctccagaattatgctcttggtttccctgggaggaacggtcacataagggttaccatgaaacacagaggaatagtgtgaggctggagtcgtacaacattcggatcgctctcacagctcatctgtcagcctggggaatgcggtgtctgtcattttccagagtgcttgttcagtcagcggtatcaattgtcagctttaggagataggagacatcctgtcaccccatccagagcctgtacttggaactacctttatgacgatgatgaagagcagctgcggccgggcgtggtggcttacgcctctaatcccggcactttgggaggcagagacggggtgatcacttgaggccaggagttcgagaccagcctggccaacttggcgaaactccgtctctactaaaaatacaaaaaaaaaaaaaaatagctgggcgtaggggtgggcgcctgtaatcccagctactcaggaggctgaggcgacagaatcacttgaacctgcgaggtgagggttgcagtgagctgagattgtgccactgcactccagcctgggtgaaacagtcagaatcctctaaaaaataaataaaataaaaaattaaaaataaaagagcagctggcacttcttgcaagagcttcaagctgcaaaaggctcttggatgatgtgcaactgtacagaggtggagatatttttagaactgaagatttggtgcatagtcctggctgtttggaaacacttttcagatgaacgcatgctgcgatcctggtttaatggaggaagtcactcccattcagaaacacatctgtctgggctccacggcttagcagaacctctgggaagtacaaggtgtttgaaatgatcctgtatgaaagacgccagaggtgtagatgctgagggctggaaactgcagttgacatttgcctggctcagggaatctcaaacttggctgaacaacaacaaaaaaacatgacctggtgccgggcgcagtggctcatgcctgtcatcccagcattttgggaggccaaggcaggtggatcgctttgagctcaggagttcaagaccagcctgggcaacatggcaaaaccgtgtctctattaaaaaaatacagatggtcagacgtggtggtgcacgcctctggtcccagctacttgagaggctgaggcaggagagttgcttgagcctagacggtcgaggctgcagtgagcagagattgcatcactgcactacagcctgggtaacatagtgagaccctgttgaaagaaaaaaaaaatggaagaaagaaaaaaaggaaagaagaaacagagaaagaagagagaaggagagagagagagagagagagagaaagaaagaaaggaaggaaggaaggagagagagagagaaagggagggaggagggaaggaagggagggagggagggataacagaaggaaataaggaagggaaggagggagagatgaaggaaggaagggagggagggagataaaggaaggaaaggaaagaagggaagggaaggaaagaagcaaggaagggaaggaggaagtaaggaaaggaaaggaagaaggaagggaaggaggaaggaagggaagggaaggaggaaggaagggaaggaggaaggaaaggaaaggaagaaggaagggaaggaggaaggaagggaagggaaggaggaaggaagggaaggaggaaggaaggaaggaggaaggaaggaaggagggaggaaggaaggagggaggaagggaaggaggaaggaagggaaggaggaaggaagggaggaaggaagggaaggaggaaggaagggaagggaaggaagaaggaagggaaggaggaagtaaggaaaggaaaggaagaaggaagggaaggaggaaggaagggaaggaggaaggaagggaaggaggaaggaagggaaggaggaaggaaggaaggaggaaggaaggaaggaggaaggaaggaaggaggaaggaagggaaggaggaaggaaggaaggaggaaggaaggaaggaggaaggaagggaaggaggaaggaagggaaggaggaaggaagggaaggaggaaggaaggaaggaggaaggaaggaaggaggaaggaagggaaggaggaaggaagggaaggaggaaggaagggaggaaggaagggaaggaggaaggaagggaagggaaggaagaaggaagggaaggaggaagtaaggaaaggaaaggaagaaggaaaggaaggaggaaggaagggaagggaaggaggaaggaagggaaggaggaaggaagggaaggaggaaggaagggaaggaggaaggaaggaggaaggaagggaaggaggaaggaagggaaggaggaaggaagggaaggaggaaggaaggaaggaggaaggaagggaaggaggaaggaagggaggaaggaaggaaggaaggaggaaggaagggaaggaggaaggaaggaaggaggaaggaagggaaggaggaaggaagggaaggaggaaggaagggaaggaggaaggaagggaaggaggaaggaagggaaggaggaaggaagggaggaaggaaggaagggaaggaggaaggaagggaaggaggaaggaaggaggaaggaagggaaggaggaaggaagggaaggaggaaggaagggaaggaggaaggaaggaaggaggaaggaagggaaggaggaaggaagggaaggaggaaggaagggaaggaggaaggaaggaagggaggaaggaagggaaggaggaaggaaggaaggaggaaggaagggaaggaggaaggaagggaaggaggaaggaaggaagggaaggaggaaggaagggaaggaggaaggaaggagaaagggagaaagagagaaagaagaaaaaacgaggaaggaaaataaagagaatgaaagaaggaagaaaggagagaaagaaagaaaggaagaaagcaaaagaaaaagaaaagaaagaaaaagaaaggagaaagaaagatggagaaagagagaaaaagaaagtaaggaaaagaaagcaaaacaacttggggaattcaaaacaaatgctgatgaccagaagaattgactgcggaactttctcgcggatggggctgaccgtcagtcattttcagaggttggcccagtgagcatcaaaagcccactagctttcctggatatttggggagaccgtcacagatagtgagaggcctgagctcaccagtggttttacacaaggctcactggggattggggatgtccagtttcagacctgctgcctgtccttgaagagggaagacgcatgaacagagatggctacaccaattgcaagctcagcgcaaaatgagaagaaggactccttgttcaaacctaattaacaatttccaggcgggggcagcagacagttaaagcaatatggcgcccttccgtgcgtggggaccctgtgtgagttacgcaaggtgcggactcatgaaacttgaggtgtagataacagaagctatccacctccgaggctttccgggtctctagaaatggaaagaatattttccgcactcacatggcatctggtccctgtggccaatagtagattgaatactgtctcccaaaaagatatgactaaggcctaatccctggtatccgtgaatgggaccttattcacagaaagggtcttgccaggtgtcattgagtaaaggatcttgaaatgagatcatctggattatccaggtgggccataaatccaatatcaagtgtccttattagaaacaggaagagacacagatacagggagaaggccacgtggagatggaggcagagagtgcagtgatgcggccacaagcctagggatgcctgcagcccccaggagctgggagaggcagaaaagatcctctcctagagcctctggagggaactgcacccaattgtagtggactgaactgtggtctcccaaaaagatctatctataccctaatacccagagcctgggaatgagaagttatttggaaataaggatctttgaagatgcagtgaattaaagatcttgagatgagatcatcctggagtagggtaggccctaaatccaatgacaggtgtccttctaagagacagaagacacacagacacagaggagaaggccacgtggagacagaggcagagactgcagtgatgcggccacaagctcagggacacctggagaccccaggagctgggagaggcaggaaggatcctctcctagagcctctggatggaactggacacaattgtagtggactgaactgtggtctcccacaaagatctgtctatatcctaatatccagagcctgggaatgagacttcatttgggaataaggatctttgaaggtgcaatgagttaaagatcttgagacgagatcatcctggagtagggtgggccctaaatccaatgagagatgtcttttttttcttttgagacggagtctcactctttcgcccaggccggactgcagtggtgctatctcggctcactgcaagctctgcctcccaggttcacgccattctcctgtctcagcttcctgggtagctgggactacaggtgcctgcaaccgtgcctggctaattttttgtatttttagtagaaatggggtttcaccatgttagccaggatggtctcgatctcccgacctcgtgatccacccgcctcggcctcccaaagtgctgggattacaggtgtgagccaccgtgcccggctgagaggtgtccttctaagagacagaagacacacagacacagaggagaagaccatgtggagacagaggcagagactggagtgatgtggccacaagcccaaggaatgtctggagcccccaggagatgggaggggcaggaatgttcttctcttagagcctctggagggaactggacacaattgtagtggactgaactgtggtctcccaaaaagatctgtctataccctaatacccagagcctgggaatgagaacttatttggaaataaggatctttgaagatgcagtgaattaaagatcttgagatgagatcatcctggagtagggtaggccctaaatccaatgacaggtgtccttctaagagacagaagaagacacacagacacagaggagaaggccacgtggagacagaggcagagactacagtgatgcgggcacaagctcagggacacctggagaccccaggagctgggagaggcaggaagcatcctctcctagagcctctggatggaactggacacaattgtagtggactgaactgtggtctcccacaaagatctgtctatatcctaatatccagagcctgggaatgagacttcatttggaaataaggatttttttttgagacagagtttcactcttgttgcccaggctgggttgcgatggcgagatctcggctcaccgcaacctccacctcctgggttcaagcaattctcctgtctcagtctcccgagtagctgtgattacaggcatgtgacaccatgtctggctaattttgtatttttacaaaattacagaattttgtaatgatggggttaaaaatttttgtaatgatggggtagagatggggtttctccatgttggtcaggctggtgtcgaactcctgacctcaggtgatttgcccacctcaccctcccaaagtgctgagattacaggtgtgagccactgtgcctggctggaaataaggatctttgaagatgcaatgagttaagatcttgagatgagatcattctggagtagggtgggccctaaatccaatgacaggcttccttctaagagacagaagaagacacacacacacagaggagaaggccacgtggagacagaggcagagactgcagtgatgcggccacaagcccagggatgcctggagcccccaggagctgggagaggcaggaaggatcctctcctcgagcctctggatggaactggacgcaactgtagtggactgaactgtggtctcccaaaaagatctgcctatatcataatacccagagcctgggaataagactttatttggaaataaggattttttttttttttttgagacggagtttcactcgtttcccaggctggattgcaatggcgtgatctcggctcaccgcaacctccacctcctgggttcaagcaattctcctgtctcagcctcccaagtagctgggattacacgcatgtgacactggagtcatgcaaccacaagtcaaagggatgcctggagcccctaggaactaagagaggcaggaattgatccttccttagaacctccggatggagcagagccctgagacatcttgatctcaatcttctggtctccagagctgggagaggagaaataattccttttgtcatgaggtccctagttgtggttacttgttacagcaggcctggaaaactgatcaatgtcataacctgcaatgggctgtctgaacacacagccatctcatgggaccatctacatcatcttcacacagagacctaagccccatgggaagcttggcagatgtgatgttggggcctctacagatccagatgtgggggtttagtcaggctggtggggaaaattttagttatagtagacacaaaccctctgggaaggcctgagcgtttgtataacttcagtaataaacctggctgaaggcagcctagtccccttacctttagttaaataaattagagtagaagcaaaggaatgtggggaatgtctctaactaacttgtttactcatgtggtcctaagactaaccttttatgtatcgcaggtgcttcattgctttctacttagggaagtccgcaatgtcaatttccctctagtggtgttgactcacaacctttgtcaattaatctttactgaataaatgcaagtcttgctgactgatcgaggccacggctgctactaagtggcttggatgctcagccaaactggcaaagcagaatagctgtgtgtcaatgtacttcattcacccatcacttggtcagggtctgtgggacagacccctgcaccataaatcttgttgcaagttttcaccgttgggcttcacgtctccctgcagcaccatgaatccagctacactagggaggtgaatatcatgcatgtttcctgcaagtttcattgttccttgtaacctctggcaacctctccttcccggaggctgtttcctggcctgttagtctggttgtatcattcatggttttcctatgaagggtctcaggatataagcagacattctgcacagagactgcatctttctgcagaaggggcttgagctcattctttctgcactgagagtcctgggtattgaggtctgagctctgcccgaaacagaagcataccgattgttagggtcaccccaaccagaccgttcccttccccttccacaggccttacaatacagtcccttgcactctccacacagctcccccagggctaaagacaaacgccccccgccttcactgacccctccagtaactgtttgtccagacagttacaggatgtggttagcatgtctgtgaaccttgcataacaaagctggtgaaaaacatctccaggatgcggtcaagacacttgcaccccctactcagctcccccaccccaacccaatcctcctgcaccctcgactcagctcccccaccccgacctggttctggccctataaaaccctgctatagtctgtaagtggggctgcctccactaactgtggtggagcagccaagcagctcagtaaagtttgcttgcctgactttaggtctcctcatcctctctctcggctgaccttacaccgatgatgtagtaagcatctaacgtgaatatcccagggaacaaatccacatttcttatccttttgtaccaaggaaggtcccctgtctagtgggtccatgacataaaattcctggttttctgtaaaggaacaacagaaatccaggcatcctggttatctaccaaggaaaatcaccatctgtggtgacaaacccattcccggaggatgaatgattttttttttaaagaggccaaacaatacatttattattttcatttaagttgcttatcagggcaaccttccccatctgggaacaatctagcagtcatgtaagaagcacatgcccccacaattagtttgaactccatcctggaattgcagctggttgtgattctaaggtacaggcatgccaggagcctggatttgaatagtcagtgggattttgtcacttagtggaatggataataagccaaccaatggtcatcagtctcacacataaggagtgcaggctcgtagggtatacacagtactttctcaaaagcattgcaaatgactgatttctctatgttgaaatttgaaaacccaacatctatctctctaacaccaaaggattgagccttccttgcctggctggtgagtaagagtgagcctctataccaaggatgtaccctttggctgtgtgaggttttcagaagtatcagaagctgtatacatttcctgtggttgctgtaacaagtgactaccaatttgttggagccttaaaacaagaaagatttattctctctccgttctggggaccagaagtctaaagtcaagacgtcagaggggccaagattgctctgaggggtataagggagaatccttcctgcctgtcccagctcctggtggctccaggcattgcttggcttgtggtggcatcactccagtctctgtctgcatcatcacacgaatatcttgtcttctgtactcaaatctccctctacctgtctctgataagaaccctcgtgatggcattaggttcactgggatgatccataatgacccatctcaaaattcttaattctatctgcaaagattcttttccaaataaagtaatatttataggttctgagggttagggcatgaacatatcttttgagggctaccatttgatccatagctgttcagcggtttacattctcggatttgacagtggcatgcttcacttgtgactgtgccattctggaatgaggttgaccagatggtgctgctggccacgtcaaactcatcctacaggctgtagcaagcaaggctcacacctccccatgtctgacacctgtgaatcacagctgggtctctggaaaaatgagtgagtgcaggaacaaaatcaaacaggagacctcatccaccactaggtctcagagaggacattgcagcccctgaaaagagagcatctctcttggaacttttgtactcagttgtattaacgcggcaaggaaaatggcacatttatgttggaaaatgtaattatttatggcacctgtgacaactgggcactttggaatcacaaagtttatggttgaagaccacttggggtgattatcctccaaaatgtttatttggcttcttgaagttctgcagaggttgaggcagctgtctcaaaactagaggacagagccctgtgggcaggtgggtgtgagaaactcaaacaccgcagtcttcacagacccacaagctattggcaggtgcaatgtgtttcttggggcagcagctatcctgagacaggatatcacagggtcacatcaaggaccccagtcatctcacaactcttagaccacagctgctgctgcagtttctggttgtaggtgacgtggagggacttggtctctttctcgttgtataggtaatggccaccaactccttccagctctggggtgactgctgcgtagatggaagtccacgctccttcatcgggggtctggtggaagaagaaaagaaggctacgatgagtcaaatttctgagcaggaaacaggagtctcaggactcacatggatgctgcagggacaggtggaatatactcatcagctgcactgagaaatgtatgcaaaaagcgaggttgggtgatcaatctgaaccacagcttttctgctgttgggtttctttacaacaggcactgacaataacgtacccaagtgggttgcatttcagtggtgggttaatccatctcactaggcagatgcatattaaaatccctgatgtacgtatttaatcacgcactctttatgggaccgaaatgcttattaattgactagaagcagatgagtgagtgcttggcttctgtatttaataaacaatatttagcaattagatgaaacatcaggacatcaaaaagattcttgttttcaattcagcaaggcatgctacatcggagaattgaggcatttatgagctgtgatcgtatgtttcatggaaacagacgtttcaaaaaggaacttgagatgcagaaaaaggtttttcaaagactggggattttaccctagtggaaggcgataatcttgaaacacagcacaccctggttttctgcagtgggagttggcccttggtcatggtcagtgggatggaagaaatgtaggattctcagaggaattagaagttgtgggacctgagaaccttcagagctaggatgcaataatccaggaaccaacacagtgcatcttaacttctgtcacaatgaagatgtttcagaagttgtctcttgtaataagcttctgggaatctggtgaacgtatccaccatgtggggacacagtaatgaggcaccgtctgtgaaccagaaagcaggtcccttccagacacagaatctgccatgcattgatcttgaacttccagcctccagaactgtgagcaacaaatgtttaccggttgcccagcctatgttgttttgtgatagcaacacaaacagactaagacatttgatgtccagagtttttactggggtctcattgcataggtatgattaagtcattggccacataatcagattcaacctccagttcctctttcctccccagaggtcaggctggcctgaaattccaacctcctaatgacatggttggtgtttctggtggccagccccatcttgaagccatttaggaaacagcaaatatcacctcattatacaaccagggaattgctagcatttgtgaaattgcgagagttttagaagctcctccttgttacagaaccaggaataaagaccagatattgcctttgttatgtcccctctagtcttctgggagtgatgatccatttgcccgaactgatttcacctctcaccagtgcccctagcactgcagtggctcaggcctgtaatcccagtgctttgggagaacaaggcaggaggactgcttgagtccaggagttcaagatgagtgtgggccacatggcaaaacctagcactggtgagagttcaggcacacaccctccaaaaaggaaaagggtggactctgtggggtggcctgtgacacccagtcacttcagaaattctgctgctgtcagttcactgcctcctggtcttgacttcagcagccagtgtgacgtggaaaggcatggtagacaatccagtgtgcccaccagcccatcctctgggtgccgagcaaggggaacaggaaggctggaccccagtagaggaacagagctgccagactcctgagattgtttcccactgacttgcctctgctcttctgctgcctaaaaagaaatggatggagctagagaacttcccaagtctggaaatcacctaggggtgcccagagatcttgcaaacccaaagtgtcctgggagatttggaggctgatacggtttggctgtgtccccacccaaatttcatcttgaactgtagctcccataattcccatgtgtcaagggagggagccagtgggaggtaattgaatcatgggagatctttctcgtgctgttctcatgataatgaataagtcccatgacatctgatggttttataaaaggccgctcccctgcacacactctcttgcctgctgccatgtaagacatgcctttgctcctccttcaccttccgccatgattgtcaggcctccccagccacatggaactgagtccattaagcctctttcctctataaatcacccagtcttgggcatgtctttattagcagcatgagaacagactaatagagagactgtatctgaaaacatctcgggggcggatgcaggcgccatggcttggctcttgcaggggagccctgtgtcccgtgtcttgccctgggcatctaaagaccaaaagtaaaggcgaaagggatggaaagaggaagggaggaaggacagaacagagcaggaggaaagggagagggaaggcaggggccaagtgaaggcacccatggtgtttgagggtctttctctggggcagccttcaacgcagaaagaggttttattgatctgtttcatgcttctctcttttgcggctgtgttctgcccaatttccaggcaggatctgctcccaaagccggcattcttcttccttctccatcatcttgtagctggaaaatacggagtctttctggggcccagcccacttccatataaaaggcagggacaccaagcactgcagctgtgaatccaacatggtgccccttcccacactgctgctctggacaaagtgatcagagaggccagatgggggccaccctgggtccccaggagagaccatggttcctgctgcgcagaaatgagcatttacacctcacgctggtgcctgagatgttcacccacactgtgttatatttagtgctgtgccttctttgcaaacaaatccttaaatcagctcctggaacaagttttgtgttgttgtctgccatcattgacactgaggattcaggggctcatgccccaaatacccgacctgtgtcttgaccatgtagtatgatgcctccacccggagaggcccctgtgttctgcagctgcagcttaggccgctcctgggttctcctgcatcgtccctattgttgaacaaactcagcactctctggaaggaggcttcctctttgtggttcccctgtgggcagtgtctgggggcttctgtttctaccatattttgaaaaatcctcttatctgagtaagagttcttgggctatgcatattcaattgcgacacaagtactaccgttttagggggcaagataccacctgtgctatgttgaaaatgagcttgtgatttctagaagacagcaagcgcattgtgctgaaaatgtaggtatttctggggacacagagatgacgacgtgatgaagttctattggatgattttttttctgtaagaaaaacacacgcacacacatattcatgtgcgcatggtcacttacatgctgacatgcacacatacattcgtatgtactcacatgcacacaaatatatatacacatatggacacacacatactcatgcatacgcacacacacatgcacacttacttgcacatgcatactcacactcattcacatgcacacatgctcatttacatgtacacaaactcacatgaacacatgctcacatatactcattcacatgcacacaaattcgcatgcacacagctcacacgcacacatgctcacactcgcacacacacacgtacacacacattcacatgcactcattcacatgtacacagctcacacacatgctcacattcacatgcacactaattcacatgcacacacacatgctcacactcattcacatgcacacagctcacattcacacatgcattcacatttacatattcacatgcactcacatgctcactcattcacatgcacacagctcacacacatgcacacactcattcacatgcactcattcacatgtacacacattcacatgcactcacacacgcacacagctcacacatgcacacatttgcatgcacattcacatgtacacacattcacatgcagtcacacatgctcacactcattcacatgcacacagctcacacacatgcactttcacatgtacacacattcacatgcacacatacacatgcacgcaccctcattcacaagtacgcacatacacatgcacacatgctcacactcattcacatgcacacatgctcatccacgtgtacattcacatactcattcacatgcatacttatacacatgcaaacatgcttatatattcatttgcatgcacacactcatacacatgcacagattatttatcctaatattgcaaaatatgaaaccaaggagagaggcctcaggaggaaccagccctgcccacaccttgatcttagacctccagcctccaggactgtgggagaatcaatgtatgtcgtttctaagccacccagtctatggtattctgtgacagcagccagaactggactaagacatgtcataagaaaaggagatgaggacacagacacacacagagggacaaccctgtgaggacacagggaaaagacggcgtctccaagcccaggagagagacctcaggaggaaccagccctgcccacaccttgatgtcagacttccagcctccaggactgtgggagagtcaacgtctgttgtttataagccacccagtctatggtattctgtgatagcagcctgaaatggactgagacagctcataagaagaggagatgaggagaaaacagacatgcacagagggacgaccctgtgaggacacagtgagaagacagcatctacaacccaaggagagaggcctcgggaggagcccgcccagcccacaccttcatcttggacttccagcctccaggacggtgggaaaatcagtgtctgttgtctaagctgcccagtctatgggacgtcaggctggcaaccccggcagatggagaccaagcccaggtgacttctctcctgactgggattggcgcaggctgctgtgtgcatatgtcaagaaagcctcttttccaggaaacaggcaattatacccacacttacctgctacctcaagagtcagggaggggagagacttcaggagcatgagcaattactcgagttcccctcccaagtcatttcaatctcctgttggttacctggctcattcagtctgccccacagctctattgcaaacagagccctctgtgttcatgggactgttcaagaacaccaagggttcctgccagcatttgtctctctaatgccacgttctgcaaagcagaccttggactggcccagccctttgtgatctttttccccaaagaaaacacaggcgcggtagctcacgcctgtcaccccagcactttgggaggccgaggcaggcggatcgcgaggtcaggagatcaagaccatcctggctaacacagtgaaaccccgtctctactaaaaaacacaaaaaattagccgggcatggtggcgagcgcctgtagtcccagctactcgggaggcaggagaatggcgtgaacccgggaggcggggcttgcagtgagccgagatggcgccactgcactccagcctgggcgacagagcgagatgccatctcaaaaaaaaaagaaagaaaaaaaagaaaacacccagaccatgggcacggtttctcgtgttagggcagcacagagaatgtgacaggtagggaaaacagcaaagcaactcatcgttctcagagtcgcttttgttagaggggaagctctgggacctgtctcagagctgctgcagaataagaagggttcgagtcagccttcctcctgctgacaatgaatacctcagttttccctccggaggcagccccttttcctcctaactccatgaaatgtctttccggaaggtgcagctggagcaccctgcacctgcaccccagccagccctgcacccacatctgtacatgccaggcagtgctgagaaccgggcaggaagggaggggacagacgtgtctgcacagaatcctgcacctgctgggaacaactcagtgtcatcagctatggcctgggtcaaagcacctttgttttgggtattcaaaggtcagtgaagggttgagtgaaagggaaggagaaagacagagaaacaaaaaaaatcaatggaaggaagaaagagaaggagaaagaaaaagaggaagaagaaaggaggaaatagagaaaggaattaaggaaggaaagaaggaagcataatgggagggaaggaaggagtgacacagagagagagggagggaggcagtaagaaaggaaggaagcagagaacaagacagaaaagagggaaggaaggagagagaaaggaagcagagaagaaaggagggaggaagaaaaaagggagaaaggagggaagaagggaggaagggaaggatgaaaaaagaaaaaaaaacaggaaggaagcaaagaaggaagggaggcaggaagcaaagaaggaaaggaggaaggaaggaaaagagacagaaagaaaaaaaaagaagagaaacaaagaaccaaagagaaggaaggatgggagggagggagggagggaaggatgggaaggaggaaggaagggagggagggaggggggaagggaggggggaagggagggagggaagggagggagggagggagggagagagggagggagagagggagggagagagggagggagggagggagggagagagggagggagggagggagggagggagggagggaagggagggagggaggaagggagggagggaggaagggagggagggagggaagggagggagggagggagggaagggagggagggagggagggaagggagggagggagggagggagggagggaggaaggggggaagggagggagggagggagggaggaagggagaggggaagggagggagggaaggagggaggaagggagggagggagggaagggagggagggagggagggaagggagggagggagggagggaggggggaagggagggagggaggggggaaggggggaagggagggagggagggagggagagagggagggagagagggagggagagagggagggaggaagggagggagggagggagggaagggagggagggagggaggaagggagggagggaggaagggagggagggagggagggaggaagggagggagggagggaggaaggaagggagggagggagggaggaatgaagggagggagggaggaagggagggagggagggagggaggaaggaagggagggagggagggagggaagggagggagggagggagggagggaggaaggaaggaaggaagggaggaaggaaggaaaaaagggaggcaaaaggaaggactggaggaaaaaagagaagataagaggaaggaagggagggaggaatttattcctcagagcctttgctgcatttaccaattctggttctgcccctatttgaccaaatatctgtggtgactctgagaattctgatttctaagataaggcagatattgtgaatttgaaatagcaaatcccttttgtgtcattcaaaccacgatttcctttttgttagagctcctgttctccagatagcacccagggcacacagagatatttgcctgtgactcttcaaagagcttcagaaagctgttccctctgaactccacacttaacttgtattagacatgctgggctttgcagaagagacacacacagggcttccctttgtccttgggacggatcccctgtgctgtctgcaaggaaactacctaacgctccactgccaggagcagagggcagcaggaatggcatcacccgggatgtctcctagggaggaggctagcagggcttgggcggcaaacgctcagctctctgcaaggcacgcagaggctcgttcgccttctggaaatgttgctatttgaatgcagacgctgttagtagatccttgagttgtgctgagagagatctgagggcacatgtatttattttagcaccgtccacatcttagggcagaaactcacactcagggaagtggctggcaagtaaagagactcctagctgagcttcccaaggagagtttccacgccccaaagttgtggaagaggggacggagtaatgctgtggtcaaagagaaattcagagacttctgcccaggctcagctgccttcctggaagaatgttctgaacattctacaaaggcaacacttcctctccatacctctgctccagccacccagggatcctgctgcttctgccacgatgtcccctgcctcttgcctctctgtacctgctgcttgctccttctggaatgttctggaaaataggtttcggggctggatgttttctgggatgctgactcacacgcaaatcatagggtgacataatgtgtgcatgtgtgtgtgtgcacagatatgcataggtacgcatttatgtggatgtgtgtgtacttgtgggtagatgtgtattgtatgattgtatgtgcatgtctgtatgtatatgtatatgtatgtgcacgtgcatgaatgcacacgttaatgggtacgtgtgtgtattcatgcatgtgtttggataaatatatgtgcatgcatgtgtgtgggggcgcagatgtgcgggtatgggcctgcgtgtgtttgcacatgtgtatatgtatgcatgcatgtgaatgtgtacttgagggatgtgtattgtatgagtgtatgtgcatgtctgtatgtatatggatatgtgtgagtacatgtacgtacatgcatgtgcatgaatgcacatgtgaatatgtgcatgtgtcgataggaatatacatttgcataaatgtgtgcatgtgtgtttgctcatgcatatgtgcacacatgcatgtgggcacagatgtgtggatatacgcatgtctgtgtgcatgggtttgcacgtgtatatgtgcatgtgtgtctatgcatgtgaaggtgtgtgtgcatttatgcacgtgagcatgtgtgcacatactatgcatgtgtgggaggggtgcaggtgcgcgcatgtgtttgcatctatatgtgtgtatttgtacatgtgtgcatgtatgtgtgcatgagtgtgcacatgtgtacgtgcacacacgtgctctcaactccccaatgagagctgtgggttgtgctaaacttctagggatgtttcatggcctcagtgaccacctgaagcagagaggattaagaaaaccttcctttaactacaatctcgtaagacacacacacaaacctgctcttaccaggaataaacactcacctgacagacaacagagaggagatggcttgtgctgtttaatgtcaggtaacacaggtcttaagtgggctctgtgatgattgagttcacgtatcaattggctgggctatggtgcccagacatttggtcaagcaccagactgggtagtttgtggatatcattaacatttacaaatcagttgcatttaagcgaaggagaggacgcttcacaatgtgggtgggcctcacctcatcaggagaaggccttcacagcaaacactgacacttactagaaaaggaattccactccagactgtgacagggcaatcctgcctgagtgtccagcctgccctgcagattttaggctcaaggctgcaatgtcaaatcttggccaggtctccagcctgccagccagcctaccaattttggacttgcccgcccctacaatcccaagagtcaattaaactaaatctttctctatgcatagatcctattggtcctgtttttcttgagaactgcgactaatacaaaattgaacggtctcaatggcagagagtctgggcattctgaaaccaggaagaaatgccgggctccaggaatgatcttggctcatctcttagcttgagtcactggaaggtctcgcacagagaccttcaatcaaaagcacagagactgctggctggcttttaaggctaaaccaaaggagggcatttatccactcaagggaagaagtttcccatccaaagaggacacttctttttagggtggcagcctcagagcctatgatgtctttgttcctggggagtctgttagagccaccagagagtccatcacagacataccctgtggaaaggagagatggcatctccttggacaaaacggcccttcccagttctgtaacttctgtggcatttccaatgtgtacctcaaactgatctgggtggcatcacctctgagcctgagagaacctccctctttccctccctctctctcacacccttctccttcctcctttgcttcctcttcctttttctctttttctctctctattcctctttctcttcctcccccatcttatcctcctcctctttcatttcttccttctccttctctttcccccttatcctcctcctattcttctatcccttcctcttcctttttctctcttcttcctcctccatcgtatcctcctttttcttttttcccttattctcctttcccatctctttctccctttctcttctctctctgccttttcttctttttttctttctcctcttttctcttcttgccttttcactctctattcctctttttttctcctccatcttctcttcttcctcctccacctcgtcctcttcctcctttctgccttatcctcctcctgtttttctctctatccctctctctcccttcctcttcctttctttctcctctttctcattttctccctcttcttcctcctccatcttctccaacttcttcctcctcctcctctttctcttatcttcttcttttcctctatctttctcttcctcttctctcctccttctcttttctttctgcccttctttccttttctctattcctccctttttcctcctccttcatcttctcctccttcttccttctcctcctttttctctttctatccctctgtcttcctccttttattttttctccttttcctcatcttcctttttctctctctcccttcccttcctcctcttccccttcctctttctcctcctctctctctgccccctctattatcaatttacagtataatccagcttttcctaaaaaaaaactagacaaccttcacactacacccttctgtttctaaaagtcttcctctgaatcgaaatcactcttgttcacttgtgtgaggctgggggattcctgaatgaacttgtatccacttgttttgaaaacaacaacaactaaagcaacagaacttcctttaggattcatatagagcattcatatggaattaccgagaactatcttcttttgtccacagccccaaagctggggctcaatcccctgcagtcctggggtctggggtcctcacgcttagcactcaagagaatgggccagagagcttgtaaaaacaactgcacccctggtatttctaactcagtggatcttaggaggcccaagaatcagcatttttttttattttttattatttatttatttatttgagatgccagggctggagtgcagtggcatgatcttggctcactgcaacctccgcctcccaagttcaagcaattctcctgcctcagcctcccgagtagctgggattacaggtgcctgccactacatccagctaattttttgtatttttagtagagacaggatttcaccatgttggccaggctggtctcgaactcctgacctcatgattcgcccatgtcagcctccaaaagtgctgagattacaggcatgagccatcgtgcccgacccaagaatctgcatttctaacgagctcccagaggctgctggtctcagagaccacgctgggaacctcactcattctagcttcttatgcagctctgcaaactatacaccatgggcaaaattcagcctgtacctgtttctgtacaggctactagctaagaatggttttatactcttaaagtgttgttaagaaaaagaaagaaagaaagaaagaaagaaatatgccaaagagactagaggtggcccacgaagactaagacacttcctatctggccgacctcctgtgtagagcaaggaactgtggcttcgcggcagaatttcattatctgccgctgtgcagctgtggctgacagacgctgtcttccacacattctcggaatgatgaagtgggcttgcttggtgacgccttgtgcagggaaatgaaagttgtcttctgaatacacaagacggtcctgtaaatcatgctccctgtggcttaaataacacatcctgttttatctacagcttttttttttttttaaatgacaatctttagagactggcaagaggacagaagatgtataaatgtgaacccaaatccaagaacgcagtgtgttcccttttaacagacacaagagcatctttgaagttccagacgcccggctggggggcgctggggagacggtgcagcaccatttatggtaaaatctgcatcaagccactcttgagtcctggagagtgttggagctgcaagctacagaaaccatttcaacttcattcagtccaatgaatgtttattaaatgctcacccgtattttgccagctcttggggcaaaggaagagaatttcagaaataacccctgctgcccaggagcttccaatagacatgggcagtgggtggatggtgaggcacaagtgcaggaaaaaaaaaagatgaaacacacacaaaatagaagatagagtttcaagtgtactaaatagagccacaagcaatatagtcagagagaggaatgaatggctcataattacataattacacagagctttacagtggagaaaatggtttcccatatattctgtcggcaatgttcacaacactcttatgtgatattattatccagaattaacaaattagaaaaatgagaggcatagcagggaaggagaggagaagggagctgttgcaggaaatagccactgcctgattcttccagggacccctccctcgtcatctcccttctttctctgctttgctatcatgagccctgatccatgcacacagctggatccatgcacatgcattcaatatctccctccctgccttcacccatgcacacagccctgatccatgcacacagctggctccatacacatgcattctgcagctgcctccctgcctgcatccatgcacacagccctgatccacgcacacagctggctccatgcatgtgcattcaatatctccctccctgccttcacccatgcacacagccctgatccatgcacatgcattcaatatttccctccctgccttcatccatgcacacagccctgatccatgcacacagcccagatccatgcacacagctagacccacacacacacattcagtacctccttccctgccttccaggcacagagccctgatccacgcacacagctgttttaggttttttgcagtagtattcagaacagcaaagatatgcaatcaacctaagtgtctgtcagcagaggactggctaatataaagaaagtacagtatagtatatacacaccatggaatattatgcagtcatatcaaagaatgaaatcatgtcttttgcagtgacatggacaaacactgcacgtttccactttttattttattattttactttttattttttgagacggagtctcactctgttgcccaggctggagtgcagtggcacgatcccggcttactgcagtctctacctcccatgttcaagcgattctcctgcctcagcttcccgagtagctgggactacaggcgtgtgccaccatgctgagctaatttttgtatttttagtagagacggggtttcaccatattggtcaggctggtcttgaactcatgacctcaggtgatccacccgcctcagcctcccaaagtgctgggattacaggcatgatccaccatgcccagcctgtttccactttctaaggtccctagagtcatcagattcatcaagacagaaggcagaatggtgttgctaggagctaggaacagcagggaaattggaagttgtattttaatggaaacagagcttcagtttgaaaagcaggccgttctcctaacaaacaactcagatactgaaagtcaaacactgatcctgccatgttctcacttgcaagtgggagttcaccagtgggtctacacagacacagagggtggattgacgatgaggaccctgaaaggtgggaggttggcaggaggtggaggatgaaaaaaatcacctacaggtatagtattcacagctggggtgaggggttcactagaagccgggacttcaccgctgtgcaatgtctccatgcaagaaatccgcacctgtactccttaaatttataataaataagtgaatcaataaatacataagccgggctgggtacggtggctcacacctgtcatcccagcactctgggaggccgaggccggcggatcacaaggtcaagagatcaagaccatcccggccaacatggtgaaaccccacctctattaaaaatataaaaattagctgggtgtggtgagacatgcctataatcccagctactcgggaggctgaggcaggagaatggcttgaacccgggaggcaggtgttgcagtgagccaaaatcatgccactacactccagcctgggcaacagagcatctcaggggaaaaaaaaaaaaaaaagggaacaaaaaaagaaatccgcacctgtactctttaaatttataataaataagcaaatcaataaatacataagccaggacgggtgcggtggctcacacctgtcatcccagcactttgggagaccgaggcgggcggatcacgaggtcaagagatcaagaccatcccggccaacatggtgaaaccccatctctattaaaaatataaaaattagctgggtgtggtgggacatgcctataatcccagctactcgggaggctgaggcaggagaatcgcttgaacctgggacgcaggggttgcagtgagctgagatcgcgccattgtactccagcctgggtgacagggtgagactccgtctcaaagaaaaaaaataaataaataaaataaataaatccgcacctgtactccttaaatttataataaataagtgaatcgataaatacataagccaattggtgagatgacccataaagacaaacaaagctttgtgaggggaaagcaagcgcccaggagaagccctgtcttcggaggttttggcgcaggcctgaatgaagggaaggagagggattggatacctgggggaagggcgtgcgtggaggaggaaacagccagggctgaggcctgcacattgcagggaaagggtgaagtccctggtggctctacctggagcaatttcttcttattttttctttttttgagatggagtttcactcttgtcacccaggctggagtgcagtggcgcgatctcggctcactgcaacctcctgctcccgggttcaagcgattctcctgcctcagcctcccgagtagctgggattacaggcgtccgccaccatgcctggctaatttctgtatttttagtagagacggggtttcaccacgttggccaggctggtctcgaactcctggcctcatgtgatccacccgcctcagcctcccaaagtgctgggatgacaggtgtgagccactgcgcccggccacctggagcattttcagtggagcatgggggactggaagtgaattgtatgagcaattcctgtatggggatttgctgcagcggagactgtagtcagggacagtccccaggggaaatagaaggtccagagagggtggttagatttgtttattaataaaaaaaaaaaaagaaatgggggggctgggtagggtgtctcatgcctgtaatcccagcacttcggcaggccgaggcaggcggctcactcgagactgtgagttcgagatcagcctgagtaacatatcgaaaccccgtctctactgaaaatgtaaaaattagccaggcgtgctgggaggtagctgaggtcccagctacccaggaggatgaggccgaattgcttgaacccaggaggcggaggttgcagtgagccgagatcgcaccactgcactccagcctgggcaacagagagaggttccatcttaaaaaaaataaaaataaaaaaattcccagtacctgcatccttgatttgattaattaacctgtcaccctctcggcacatcaatccaagttccaatcaaccctaagacagactttcattagactgcatggcggatacaaatacatgcttaagacaagcaatgatacgagtggtctacttcatggtgaagtgggcgcagtctacactgcaaatttgttcattttgatggcaggcctgatcacatgatttcaaagtggtcaggacttgctggacatgagccctgaatggtggagctgatacactcagcatttacaatagctttctatttttttttttttttgagatggagtttcgctcttgtcgtccaggctggagtgcagtggcatgatctgggctcaccacaatttccgcccccgggttcaagcgattctcctgcctcagcctcctgagtagctgggattacaggtgactgccaccacgcctggctaatttctgtatttttagtagagactgggtttctccatgttggttaggctggtcttgaactcctaacctcacatgatcctccccctcagcctcccaaagtgttgggattacaggcatgagccaccactcccagccgatagctcttttttgtaacacccattgatcttgagacaactggggtgggaagagaggtaatagccacgttcatttgctccctaggaggggtatacattgtagggggtactgagtttcactgatgaagctgcgaggagcttcctagaggtctgaagagcacacatgccctctgaaatactaagctactctcctacggaggctgagaccatctgcatgtctcagcatgaagaatggcctgatgcatttgtatacaggacaaatcaaacctctcatctttataaatgcacaaatcataatcccaacactttgggaggccacagcaggaggatcgcttggggctaggaactggagacccggctggacaacatagcaagacctcggctctaccaaaaaattttaaaaaattagccaggcatgctggtgcattcgtgtagtcccagctactcgggaggtggaggtggggtgatcgtttcagtccagcaggtcgaggctgctgtgagctgtgattgtaccactgcactccagcctgggtgacagggcgagaccccatctcaaaaacaaaccaatcaacctcctagtttttcttctggtaccgactggtcgcccaggttactggccgtgaatttggaatcgagtccatgtgttctgatgagacagaggatagaggtttcagagtgacatacaaccatgccctcagatgatatgaaacatcacagagatatgtatgtcacacagattctccccagggaccctggacagatcctgcaaggtttttcttctttcttttttttttttttgagacggagtttcactcttttcacccaggctggagtgcaatggcgccatctcggcttactgcaacctccgcctcccaggttcaagcgattcccctgcctcagcctcccgagtagctggaatgacacacacgcgccaccacactcggctaattttttttttttttaatagagatggtgtttcaccatgtttgacagtctggtctcgaactcctgacctcaagtaatccactcaccttggcctcccaaagtgctgggattacaggcatgagacacggcacccagctgatcttccaagtcttaatatacaatgcatgcatgcatgcatgcatacacactagtaaataatacatacacagcaatacagaattatcattacaaagacagcatcaagctactgcagctgtatagccttttctttaaaattcttacattattttaatttcatttccaggctaatgcatattcttctgctctataattttaaagtttccacaatgttgtctcttatataaaggcagtatcactcgagcaatgccccgtggttatttttaatccaaatttgcagatgatgatcaaaggattaaagaatgattcatgtggctaaagttgcagtttgcttgttaaatatttagaaagaaataatgtcaaggccagccatggtggctcatgcctgtcatcccagcactttgggaggcagaggtgggagaatcacttgaggccaggatttcaaggttgcagccagtgattgtgtcataattccagcgcacaagaccaacctgggcgaacagcaagatgccgtttctacaaaaaaaaaaaaaaatgcacagcagccagggtgacagagcaagacctggtctctaaaaaatttaaaagaggccgggcgtggtggctcacgcctgtaatcccaacactttgagaggccgaggcaggtggatcacgaggtcaggagatcaagaccatcctggccaacatggtgaaaccccgtctctactaaaaaaaaataaaaaataaaaaaaaaattagccagacgtggtggcgggcacctgtggtcccatttactcgggaggctgaggcaggagaacggcatgaacctgggaggcggagcttgcagtgagctgagatcgcgccaacgcactccagcctgggcaacagagcaagactcagtctcaaaaaaaataaataaattaaataaaataaaaaaacagcaaatgctctccttggatactgaagtcactctctgagggattcatgggggttttataaggatgaaatgtatcctagtgttggtgtattgctagcgaatacttagtgcttaataaaataactaatattttgaaattcctttgcttgaggaattagagatgtgaagaacaacagatcagaaagcaaactgcaaaataagggatgtacagctgggcgcggtggctcacgcctgtaatcccatcacttaggaaggccgaggtgggcggatcacccgaagtcaggagttcgagaccagcctgggcaacataatgaaaccccgtccctactaaaaacacaacacttagccaggcttgatggcaggtgcctgcagtcccagctactcaggaggctgaggcaggagaatcacttgaacccaggaggcggaggttgcagtgagctgagatcgcgccagtgcactgcagcctggtgacagagcgagactctatctcaaaaaaaaaaagaaaaagaaaaagaaaaaaagaaattcctttgcttgaggaatgagagattcgaagaacaactgataagaaagcaaactgcaaaataagggaagtaattaatcccctcaaaaagtccacattgggggcgggcagctcatatcatgagagactttcagacgaaatcaagagcaatgccaggagtccaacagggagaaaagagaatttgtaaccaagctcattaattccaaagcttgatgaaacagacaattacctaaagggaaaagctgtctaaactgactcagaaagaggtgggaaacttcaacaagcagtagacgcccaaggaattttgaaagctgagttagaatcgctcttccgaaaattcctcaacccatgcggttttgaaggtgaatcgtggcggtgtttcaaaagcagacacttttaaaaatgctaattagacgattctgcaatgtaaagggagaaatagaaaagcttctcaaggttctttctttgttttgtaaacaaattattaaaactttagtatcccgacttgagatagataggaaagaaagtaaatctatagctcccagatacatatcacttcaaaagacctcaaggaggacaggcacggtggctcactactgtatcccagcacttcgggagaccgaggcgggcagattacttgaggtaggtcaggagttcgagaccagcttggccaacatggtgaaaccctgtctttactaaaaatacaaaaactagccgggcatggtggcgcacacctgcaatcccagctactcaggaggctgaggcaggagaatcacttgaacccgggaggcagaggctgcagcgagccgagatcacaccacggcactccagcctggtgatagagctagactccatctcaaacaaacaaacaaaaaaacccaagggaatggctggggcatgaaatcttgcagtgcttaagaagttaatgcatcacgacaacgaagatcattgcagaaatgtgggagctttcagctgctgggtcttaaaaaccaacaccccaaagtacggtgctttgtcctgctgaactgaagaagcctcaagatctctctaacttccccctcctgcttcctctgtgtctcccgatgcacaggatgaagttgttctctgaagtttcctgaagtctggacatgtcaaagaaggaaaaatgaccagtgtccccttccctgagtttctgaacccacatcgcggaggaaagactgatgtctgtcaacagccctgcagagactcctcataaaccactgtctgttctgagggttccacagcctctgtccctgcagagactcgtcataaaccattatctgaggccaggcgcagtggctcacacctatcatcccagcactttgggagcccgaggcgggtggatcacctgaggtccagagttcgtgaccagcctggtcagcgtgatgaaaccccgtctctactaaaaatacaaaattagccaggcgtggtgtcacatgcctgtaatcccagctactcgggaagctgaggcaggagaatcgcttgaacccaggaggcagaggttgcactgggcagaggtcccgccactgcactccactctgggcaacacagaacgaaactccgtctcaaaaaaaacaagcaaacaaacaacaataacaaaaaacattatctgttttcgggccactgtacattgttcaaacccattgacttctctttaaaatcatttactatttggaatcctatattcacccccaattccccactccccttccgctaagaagaagaggacacaagcgtctgtacccctttgtgtaatggggcaattcctctgacattctcctccatggatgagaatacatttgcctgtcatttcctttattcatgtttcaaaaagggcaattgtattttgtgcgttgatttttcagcaaaccttcaaatggcaaagggggatgtttttcccttggcccctaccacagcatccccaaacggtctccagctcctaagaagattcatttatgggcactacctagctacacagcgtcacccaccgagctcgcacacaaccaaggctttggggtgagaatgtacaaatacatcacggaatccaagcccccaacaccgcacacgcagcctggaagtggttgtgtcagagctgtgtgaaccagcgtgactccatcttgaataggggctgggtaacacgaggctgagacctgctgggctgcattcccaggcggttaaggtatgctaagtcgcaggatgagataagaggttgctacaaggtacaggtcataaaaaccttgctgatacaacagcttgcagtaaagaagcgggccaaaacccacaaaaagcaaaatggcgacaagagtgacctccggctgtcgtgacggctacattcccaccagcgccaggacagttacaaatgccacggcaatgtcaggaagttaccctctacggtctaaaaaggggaggcatgaataatccccccctcgtttagcatatcatcaagaaatcaccgtaaaaatggccaaccagcggccgccggggatgctttgtctgcggaggagccattcatttactcctctaccttctcaataacttgcttctctttccaccactgagccgtcctgaattctttcttgcacgagatccaagaaccctcccttggggtctggactggggaccccctttcctgtagcatcttcaggtgcagccgtgaatcagagaagcagaaggggcttaccttgaaaagcaaccagccgagaagcttcttcgccagacgggtggcccagaacacgtgcttgtagacgtccgtgttgaccaccccggggtccaccacgttggcggtcacgtggcttccctcagccgccagcagccgctggaggtggtaggtgaacaggacaagggccagcttgctctgggcgtaggctgcgtggggtgagtagcaggcactgtggggcaagcaggagaaggtgtaagaggctgacggcgttcacgcctaagtgcttcatcccagcagcatctgtacctgcggccacggccacgtctatacgcagccacctcccctagacccatgtgtgatcatgccatctgttggccagttttccaacgcgtgtggatttttctagttcacctttttattataaactcatcccttaattgtattggggtcagatatgttaaattatgttactaattttttatttatttatttatttattttggagacagagtcccccctctgtcgcccaggctggagtgcagtggtgcaatcttggctcactgcaacctccacctgcccggttcaagtgattctcctacctcagcctccccagtagctgggactacaggtgcccgccaccacaccctgctaattttttgtattttcagcaaagatggaagttttaccatgttggccaggctgctctcgaactcctgacctcaaattatccacccgcttcagcctcccaaagtgctgggattacaggcaggagccactatgctccctgttttttttttttttttttttttttttttttttttgagacagattctcactctgtcacccaggctgcagcctcccgggttcaagcgaatctcgtgcctcagcctccagagtagctgggattacaggctcctgtcaccacgcccggctaattttttgtatttttagtgggaacagggtttcaccatgttggccaggctggtcttgaactcctgacctcgggtgatccaccctccttggcctcccaaagtgctgggatgacaggcatgagccaccgcgcctggccacatgtggtcttcttgatgagtctcaaatcataaaagacaaccacacaagcaatttggcaaacttcccaagctatcataaattttcctcacatctactgcaagctctgtagtgtgctaagcacatgttaaactctttgcaccttggttcaagcagtttagagaaatgttttagtatcacaggacatagtgataaaaatcgatccgataaccgcggtaaagtgagtaacgtgcctctctctctctctctggtaacctcaatcaccagaaacacagaaaactggatgtttccagctttgctcctgtaaatatgttctactttttctatgtatgccttagaaacactttttaaagagatgttatttgcggtgttacataacgtcccttgaaggcacacaaccaccatagactccttttagaatttaatgctaggcacagatcattagccttagaattggcctcatagttcttttcaataagacaaggagaagtatttgagcaataatgtttttctttcctctggggctccaaagatgcccagaggcgatcaatttgctacacaattatcgtaacaacatttcaaggtggctgaaggttcatatcgcttgcttcttttatatatatatatatttttaaattttatttttatttatttatttttgagacagagtcttgctctgtcaacccagctggagtacagtggcgtgatctcggctcactgcaagctcctcctctcgggttcaagtcattctcctgcctcagcctcccaagtagctgggactataggcgcctgccacctgcctggctaattttttgtatttttagtagagacgaggtttcaccatgttagctaggatggtctcgatctcctgaccacgtgatctgcccacctcggcctcccaaagtgctgggattacaggcatgagccactgtgcccggcctaattttctgaattaaccacatggtatatgtatcctgatggaagctgtgaacagaaaatatctgggcaccccaaaagcgggaagctcaaaggaaaagtccagctggaacctgctgaaggcaaacctgcctcccactctgttcaaagtcacccctgtgctcactgagatagatgcatatctgatcacctcctttgggaaggctcatcacaaacccaaaagaatgtaaccatctgtgtctcacctacctgtgagctggaagccccctccctgcttccagttgtccctgcttttcaaggactatacttcttatttttttgagacagagttttgctcatattgcccaggctggagtgcagtggcacaatcttggctcactgcaacctctacctcctgggttcaagccattctcctgcctcagcctcccgagtagctgggattaccagcgcccgccaccacgcccggctaattttttgtatttttagtagacatggggtttcaccatgttggccaggctggtctcgaactcctgacctcaggtgatccgcctgcctcggcctcccaaagtgctgggattacaggcgtgagccaccgcacccaccccaacgtagctcttacatatattgattgatgtctcctgtctccctaaaatgtataaaaccaagctatggccagacgcagtggctcatgcctgtaatctcagcactttgggaggccaaggcgggcggatcacaaggtcaggagtttgagaccaggctggccaacatggtgaaaccctgtctctactaaaaaaaaaaattaaaaaattagccaggcatggtggcatgtgcctgtagtcccagctactccggaggctgaggcaggataattgcttgaacctgggaggcaaagggtgcagtgagctgagattgtaccactgcactccagcctgggcaagagagtgagactccatctcaaaaaaaacaaaaaaacaaaaaaacacacaaacaaaaaaaaaacaagctgtgacctgaccacgttgcacacgtcatcaggactttctgaggctatgtcacaggctcacgtccttaaatttggcaaaacaaactctaaattaactgagacctgtctcaaattttcagggttcacaaagccatctcagatatagtttgaatatcagcatgatatttatgctaaaaaactaaagataagatcaaaaagcctaaaagaatgtttaacacattcaaaagatcaaaagaaagacatccgtcatcatatgcgtttcagaaaaagcttctgaaaatccaatgcctcttaccaacaaaagctgttcctaaataagaatacaatattgagggctgggtgcgttggctcatgcctgtaatcccagcgctttgggaggctgaggtgggcagatcaccaggtcatgagtttgagaccatcctggttaacatggtgaaaccccatctctactaaaaatacaaaaaattagctggacgtgctggcgggtgcctgtagacccaactacttgggaggctgaggcaggagaatcacttgaacccgggaggtggaggttgcagtgacacgagatcacgccattgtactccagcctgggcaacagagtgaaagtctgtcaaaaaaagaaagaaagaaagacagaaagagagaaagaaagaaaagaaagaaaagaaagaaagaaaaagaaaagaaaagaaagaaagagaaagaaagaaagaaagaaagaaagaaagaaagaaagaaagaaaaagaaagaaaataaaagaatagaaaattgaaataaatgaagtaaactttgacctaaggatctggagaagaaaaatgaaaatgctttcctaaggaaaacacataaaagaaaaccaaaaagatcaaagcaaatgagaaatacagaaagaaaacagtataaacataaatgataccactggggaacagagactgatgttggtttttgttgttgttgtttgagaaggagtcttgctctgtcacccaggctggagtgcagtggcgccatctcagctcactgcaacctctgcctcctaggttcaagcaattctcctgcctcagcctcctgagtagctgggattacaggcatacaccaccatgcccagataatttttgcatttttagtagagacggggtttcatcaggttagccaggctggtctggaacttctgaccccaagtgatccacccaccttggccttccaaagtgctgggattacaggtgtgagccactgtacatggccctggtattggtttctaaacctcctctccctgttataaaatgtccaatatacactatattttgcagatgaaaagtagaatattacaattacagagcagaccctgaaactataaaaaaaaaattagggctgggtgcagtggctcacacctctaatcccagcactttgggaggccgagatgggcagatcccgaggtcaggagatcgagaccatcctggctaacatggtgaaacctcgtctctactaaaaaaacaaaaaattacccgggcatggtggcgggcgcctgtagtcccagctactcgggaagctgaggcaggagaatggcgtgaacccgggaggcggagcttgcagtgagccgagattgcgccactgcactccagccttggtgatagagtgaaactccgtctcacaaaaaaaaaaaaaaaaaaaaaattagataccctctatattcatgtattcattttttcataaaataaatgaacaaaaccaataatgcatgcctatgctggggctcagagaacagtaacctaaaatgaagacctcagaagcagcatcagaagcaaacctttcttgctgaccttctcctaccctcctgtctctcagacccatttcgccccaagggcaccacggaaactggaatccttcttccccaaggtgggtcccgaaaaccaaagcacctttcccccaaggccagccagaaaccctataaataggactctaagtttccctacaccctgagtatataaaaactcgccataaagaaatttcctatcatcgtgcagtggctcacggctataatcccggcactttgggaggccaaggcaggtggatcacttgagatcaggagttcgagaccagcctgcccaacacagggaaacatcacctctactgaaaatacaaacattaggccgggcacggtggctcacgtctgtaatcccagcactctgggaggccaaggtgggcagaccacaaggtcaggagatcgagactatcttggctaatacggtgaaacccggtctctactaaaaatacaaaaaattaactgggtgtggtggtgggcgcccgtagtcctagctacttgggaggctgaggcaggagaatggtgtgaacccaggaggcggagcttgcagtgagtggagattgcgccactgcattccagcctgggcgacagagcgagactctgtctcaaaaaaaaaaagaaaaaagaaaatacaaacattagccaagtgtggtggcgggcacctgtagtcccagctactcgggaggctgaggcaggaaaattgcttgaacccagaaggtggaggctgcaatgagccaagattgcgccattgcactccagccagggcgacaagagcaagactctgtctcaaaaaaaaaaaaagaaaaagaaaagaaaagaaaaagaaagaaaagaaaaggaaaaggaaattccttgacctgccttgtttgaatgtaggttctacgacccccttcccagagagggtcccaccccacccccagaaggaaggcgcactgctcagaggccaaaaaaatctagacaggcctgtctgtttccccactcagaccgtcagccttagatcacaccctcttcctccaatcctattcctacacggatttcgttcagacgtcgttgaacctaagcataaaaatagacggtttcccctgcatctttgggtcttccctctgaaggctgctgtatgtatccatcgagtaaactttgtatgccttttctcctattcatctgcttttgcaagttgatttttcagcttgcaaaatcagagggaatgaccctccatctgttctcctatcacactgtcatcatttccactgtgaagaacatggggaaaactggccagacaaccaaaggaagggcgtgcacatacatttgcacatcttttgggagagcaacttcacaacatgcaactcaatctttaaaatcataaatctttttttttttttttttttgagacagagtcttgttctgtcgcccaggctagagtacagtggcacaatcctggctcactgcaaccaccccctcctgggttcacaccattctcctgccttaacctcctgagtagctgggactacaggcacctgccaccatgcccggctttttttttttttttgtatttttagtagagacggggtttcaccgtgttagccaggatggtctcgatctcctgacctcgtgatctgcccacctcggcctcccaaagtgctggaatgacagacgtgatgtgagccaccacgctcagccctttttgtgccttttttttttttttttttttttttttttgagacagagtctcgctctgtagcccaggctggagtgcggtggcgcaatctcagctcactgcgacctccacctcccgggttcaagtgattctcctgcctcagcctcccaagtagctgggactacaggcgcctaccatcacgcccagctaatttttgtatttgcagtagagatggggtgtcactgtgttggccaggccagtctcgaactcctgacttcaagtgaaccgcccgccttggcctcccaaagtgctgggattacaagcgtgagccaacgcacctggcctatgaatatcttttagtaacatcactacttgaaattgatcttaaaaaaataaaccttgggccaggcatggtggctcacgtctgtaatcccaggactttgggaggccaaggctggcagatcacgaggtcaggagatcgagaccatcctggctaacacggtgaaaccccgtctctattaaaaatacaaaaagttagccaggagtggtggcgcatgcctgtaatcccagctacttgggtgctgaggcaggagaatcgcttgaacccgggaggtgaagattgcagtgagccgagatcacgccactgcactccagcctgggcaacagagtgagactccatctcaaaaaaaaaaaaaaaaaaaattaagcattgattcaaaaagtcttttctggctgggtgcagtggctcacatctgtaatcccagcagaactttgggaggcagaggtgggcggatcacctgatcctttcaggggtttgaaagggttcttggatctcgtgagaaagaactccgagtgggtccatagagtaaagtgaaagcaagtttattatgaaagtagaagaataaagaatgtgtactccatagatggagcatcccgagagctgctggtggcctatttttatggttatttctctatcatatgctaaacaacgggtggattactcatgagttttctgggacaggggtgaccaattcccggagctgaaggttcatcccccttttagaccatgtcatggcatctgtaaaccgtctcttatcagctaatgcattagaattagcgtatcatgaccagagaggatgaccagaggtcagtcgtcaccatcttggtttcggtgggatttggctggctttaccacaacctggtttatcagcagggcctttgtgacctgtgtcttgtgctgacctcctctgtcatcctgtgacttagaatgcctcatccacctccagagaaggcagcccaagcaggtctcagcctcatgttacgcagcccctattcaagatggcagagttgctctggttctaatgcctctgaaaaatttaggggattgttttctgagccccaacactgtgatcttagcaactgagcaattttcccaccttcatgtaaccaaagacagagtggatcacagagcttggaaagctcgtacccgggaaatcgcagcctgcagctgacatgttctgagatgtgccttgccgttgtgcaaaaggcatgtttgaatgcttgcatgaggacaagtgactcccccattaacacctccaggggctcagttctgcctccagccactgtctcatcacgcagccatgggtagcagaaagccacatgccaaaatctgacatcgggcctgtaaaaaataaaggttcctgttcaaagactttcctccccatctaattaggaataaatagtaacttctctgagaagcaaacttcattcaaagacttgtgctaacattcctaaatatctgctagccgtgataaagaaatcaatgtactttatgctcttagctcccacaatttaacctaagtatcagccctggcatgcttatactggtccaagcaagcattacgtcacagcctgttcctcttctttatctaaaagtgctttttcctttctcagcattccacaagttacttcctccttcctttgttctcctctgcctttgcctcttttaaatagttccaaggtgctggccaatcgggacaaatacagaatgtgaggtcccattccagccctggaaactggacacagcagtagggcggacgcatcaagtgataaatgaccctgtcccctttgttcgctgtactctcctggcaaaactgctggagagtgtaccctttctgcagaaagtaaaaaaaatggccttgctgaggaaattaatgttcaagtgctatttctttatggcactggggaacaagcatttcaaacagacctgaggtttacccgatttctgctggaaaagaaacctcaggtctgctgccttagaaataaataagggcaggacagaaagggtgacaagggggtccttagccatggagactttgcaaaataatgaacaatcaaaacataactttttgggggttggggtggggtaggaggggactggaaaggctgactgcataataaagagattggaagaattggctgggtatggtggcttatgtctgtaatcccagcactttgggaggctgaggtgggtggatcacctgaggccaggagttcgagactagcctggccaacatggtgaaaccccgtctctactaaaaatacaaaaattagcagggcgtggtggcaggtgcctgtaatcccagctactcgggaggctgaggcaggagaatccttgaacccgggaggtagaggttgcagtgagctgataccacgccattgcactccagcctgggtgacaagagcaaaactctgtctcaaaaataaataaataaaaagaaatctaagagactggaagaattaagacagggaaattgagtagttcagagctgaagtcccatctctgatccaagataaactgtaaacctccaattactgtcaagatatctttttaaggcaaacttctccaatctcctcaccccaggggaagagaagagtccaggaaacagatagttactaagtgcagagaggcaaagactggctttcctgctggcatgatcgttttttaaatatcagctacaagcattcggttctgaatctccagcatttgattgatgggtaagaggaatggttacttgaaaaagcagaaaatgcatcatccaaaggcagatttttccagagtaaatggaggggttggttctgtaattatggttttacacagtagcgtggagaagagagaactaagattgtttaaaaatacggtgtgggggcaggcgaaaagccaatacatttctctacaggaggtgaagaaatgaatccaagaggggcacgtagtttcaggagagattccctggggtgggggttagggatgaagaaatatccaccccagaaatgggaaagaatgaaagcaaatacgtaggaggaaatgcccattaaggtctgtaaatgaaaccctaaggactctgacaaaagtcgttggtattaggccgggagtggtggctcgcgcatgtaatctgagcacttaggggacactaaggcaggcaggtcgcttgagcccaggagttcaagaccagactggggagtatagtaagaccttatctctacaaaaaatacaaaaagtacctgggtgtggtaaagcacacctgtagtcccagctaattgtgaggctgaggtgggagcagatcatttgagcctgggaggcgcacatggcagcaagccaagatagcgtcactgcacggcctgggaggcagatatggcagtgagccaagatggcgccactgcacggcctgggaggcggacatggccttgagccaagatggcgccacggcactccagcctaggaggcggacgtggtcgtgagccaagatggcgccacggcactgcagcctgggaggtggacatggccttgagccaagatggcgtggccgcactgcagcctgggaggcggacatggccgtgagccaagatggcgccacggcactccagcctaggaggcggacatggccgtgagccaagatgtcgcggccgcactgcagcctgggaggtggacatggcagtgagccaagatggcgccaccacactccagcctgggaggcggacatggccgtgagccaatcagcaaagatggcgccactgcactccagtctgggtgagacagggagactgccaaaaaacaaaatgaaacaaaaaatcattcaatgagctttcctgttgaataagaaactgaacaaaagccacctgctactaaatctggaccttataaaagggtatttgagttctccattttttgctgattaaagcattactctcttcttgttattaaaaatcgtgaagactgaacatacttttgagtgtttataagaccgggcgcggtggctcacgcctgtaatcccagcactttgggaggccgaggcgggcggatcacgaggtcagaatatcgagaccatcctggctaacagggtgaaaccccgtctctaataaaaatacaaaaaaattagccgggtgtggtggcagacgcctgtagtcccagctactcgggaggttgaggcaggagaatggcgtgaacccggaaggcggagcttgcagtgagctgagatcacaccctgcactccagcctgggcaacaaagcaagactctgtctcaaaaaaaaacaaaaagaaaggagccctttataagttattgtgatggatactgtaggatgtaaacgtgtcatatctcggtctcccaacagccagtctccgtaggcggtgtccttttatatggatcaacaggcagtttttgcattgattatttatccactttgagaggtacttgtgtagaagcaaggacaactgagtttttatgttaacttcctacgaatccgttgcattgcaacgtatttccattgcaggacattgttgcataatcaaattgccaatgcaattagggaaactcaatcgactgctcataacctagttgactggagctatttttccagtgctcattaaacctgatgacaatcactgttttaatgagtaagtatgggtggcattcaatatatttataagtattataacaatccttcatgtctaaattgaattttccctttggcagtacaaacaactccattacattctttctaggatatctacgcttaatattcttgataactatcatctacatttaatattcttgataacgatccgcctaccaggaactcagaaaatactgcgaataaagagaggttttttttgtttgtttgtttttttgaaacagggtctcgctctgttgctagggtggagtgcagtggtgcgatctcggctcactgcaatctccgcctcccggattcaagtgattctcctgtcttagccttccgagtagctgggactacaggtgcccgccaccacactcagctaattttggtatttttagcacagtggggtttcaccacattggccaggatggtcttgatctcctgaccttgtgatccaccccctaggcctcccatagtggtgggattacaggtgtgagccactgtgcctgccccacgcccccccccttttttttctttttttttttttgagagggagtcttgctctgttgcccaggccgggctggagtgcagtgctatgatcttggcttgctgcaacttccacctcccgggttcaagtgattctcctgcctcagcctcctgagtagctgggactacagtcacccgtcaccacacccagctaatttttgtatttttagtagagacgggtttttaccacattggcctggatggtgtcgatctcaaagagaggtctttgactttttccgctaagagaaaacaaccaaaacaacacaggacattgcaggtatcttgtgaattccagctgcatccaaacaccctgatactttcgctcatagacacatagtgagtgtgtcagctgtccgacatatctcagaacacagggggaacatgtgaaaccttgagtgaaatccgaatcgagatgggataccacactcaaaacacgttacacaacttagtctatactggatgatttcacgggatgtgaattcatggttaggaataaaataatgaagaagtcacccaaagttacataagttgagaaactcaaaccaagacagccatgttcacagtgaggcacgcccatgcctataacaactccatgactgagggacgtcagagtgaaataaagaatttcttaaataggtagagaatctatcatggccaggcacggtgggtcacacctgtaatcccagcacattgggaagtcgaagtgggcagatcattcgaggtcaggagttcgagaccagcctgaccaacatggtgaaaacccagctctacaaaaaaaaaacacaaaaattaggtgggcatggtggcggtgcctgtagtcccagctacccgggaggctgagacaggagaatcacttgaacccacgaggcagaggttgtagtgagctgagattgcgccactgcactccagcctcgatgcctgggtgacaaaagcgaaactctgtctcaaataaaataaaataaaacaaaacaaatttaagggtctcacaggaaagaaatcttaaagaatagaaaatgattttggaaggtatgtgtccctcttttttttttttttttctctccaggctggagtgcagtggtgcgatcttggctcattgcaacctccacctccccggttcaagcaattctcctgcctcagcctccccagtagctgggactacagggacatgccaccatgcctggctaattttttatattttagtagagacggggtttcaccatgttggccaggatggtcttgatctcctgaccttgcgatccacccctctcagcctcccaaagtgctgggatgacagacttaagccactgtgcctgcccttttttttctttttttgagagggagtcttgctctggagtgcaagctgggctggagtgcagtagcatgatcttggcccactgcaacctccacctcccgggttcaaacaattctcctgcttcagcctccaaagcagctgagattacaggcacatgccaccatgcctggctaacttttgcatttttagtagagacggggtttccccatgttgaccaggctggtctcgaactcctgacctcaggtgatacgcccgcctcggcctcccaaagtgctttctattgaaatttatttcaccatggggatgattcggtacagccaagttgaggagacatgttctctcatgtgtaaaaactcttggatttttggaatatgttacaacactgtgatttattcctttacaagaacgctaattttccaagccagtaaatcaatcttggcaattaacactaattactggcaatgattatatcaggcaaaagccaagaaccacatctttcatccaaaaaaaaaaagcagtatattttaaattcaagtggttctcatattttagcatgcatcagaattcccccaaagaccttctccttgccaacccctgttctccaaacttcgggtttaggagatctggaggatggtctgagaatgggagcatcttcatttcttttttctttttcttttttaagacagaatcttgctttgcagcccaggctggagtgcagtggtgcgatcttggctcactgcaacctctgcctttcgagtcccagttgaagcaattatcctgcctcagccttccgagtagcagggattacaggtgtgcacccccacgcccagctaatttttgtatttttagtagagatggggtttctccatgttggccaggctggtcttgaactcctgaccttgtgatccacctgcctcggcctcccgaagtgctgggatgacaggcgtgagccaccatgcccggcccactcaccatatatttactgaacttcagtcatatgtgacgcagggatgacacaagaacagaaaaatcagggagatggagacggagctaaccacggaagctgaagttcgtcggccagatggcccaatgcacaataattcggggaacacacatccaggcaactgcacctgactgggaatacctggctgtcctaccaccatctggtcatctaggggctcctacagtaatacagaagacgccggctgaggcgtgttctattctaccaaggggacctgggcgtatctcatggactgaattacgtctccccagattcctatgaagttctaactctgaggaactcagaaagatgaccttatttggagatagggtccttttattttatttattttttgagacagagtttcggtcttgtcaccaaggctggagtgcaatggtgcaatcttggctcactgcaacctccgcctcccgggttcaagcgattctcctgcctcagcctccccagtagctggggttataggcacctgccatggcgcttggctaattttgtattttttaagtagagacggggtttcaccgtgttgtccaggctggtcttgaactcctgacctcaggtgatccacctgcctcagcctcccaaagtgctgggattacaggcatgagccaccatgcccggccggagatggggtctttaaagatgcgattcaggtaaaatgaggtcactagggtaggtactgatccaataggactgaggtccttataagaagaggagatgaggacacagacacacacagagggacaaccaagtgaggacacagggcgatgatgacatctccaagcccaggagagaggcctgaggaggaaccagccctgctcacaccttgatctcagacctccagcctccaggactgtgggagaatcaatgtctgctgttataagctacacagtctatggtattctgtgatagcagcctgagatggagtaaggcattgcataagaagaggagatgaggacacacacacacacaaagggacgaccctgtgaggacacagagagaagatggcgtctacaagtccagcagagaggcctcaggaggaaccagccctgcccatacctggatctcaaacttctagcgtccaggactgtgagagaataatgtctgttgtttataatctacccagtctatggtattctgtgatagcagcctgaaatgggctaagacacctcataagaggaggagatgaggacacagacacacacagagggatgatcctgtgaggacacagggagaagacggtgtctacaacccaaggagagaggcctcaggaggagtcagccacacccacaccttgatctgggacctccagcctccaggactgtgggaggctcaatgtctgctgtttaagccactaggtccgtggtattttattatggcagccccagcaaagcaatgttctctcctttaagagatcactcctaagctatgaacgatgaaaaaggggcctatttggaaagagtcagtgccgtcaacgaagaacagtttccagaaagctcagaggaggcatctgttaacactctctcattatcccctgcagaggaatcatggagaaatgaaacatggctcaggtgaatgcctgtcatcaatattcattttacataatcaaactggtgaagcaaaagaggagaacaggaaaagaaaagcagtgtaagttgaattgtaagtctcgaaaaaatagggggaagtggccgggcgcagtggctcacgcctgtaatcccagcactttgggaggccgaggcgagaggatcacgaggtcaggagatggagatcatcctggccaacatggtgaacccccgtctctactaaaaatataaaaattatctgggcgtgatggcgcatgcctgtaatcccagctactcaggaggctgaggcaggagaatcgcttgaacccaggaggtagaggttgcagtgagccgagatcgcaccactgcattgcagcctgggcgacagagcaagactctgtctcaaaaaaaaaatatatagatagatatatagatatagatatagatatatagatagatatagatatatatagatatagatatatagatagatatagatatatatagatatatatatagatatatagatatatatatagatatagatatatacaataaattaaaataaaaacaatacaatacaaataaataaacaaaaaatgttagagccggctctgagctggctctggctctcaagccctttgactttgaagttccttgatctgctttgcaatctgtattactttcctgggattgtccaaacaaatgagcacagactggatgcttcaaagtcacagaaattcatccagtgaagtgataccttctggagaccagaagtctgaaattcaggagtggacagggtcgtgctctctctggacggtcttctagggcaggaacccttcctgcctttcccagcttctgggggctcggggagtccctgaccccgtggtcagatcactccagtctctgcctccgtctccacgtggacttctcctctgtgtctgtgtctcctcttctgtcttttagaaggataccggtcagtggatttaggacctaccctactccaggatgatctcatctctagatctctaactaattacaccggcaaagttctttattttcaaataaagtctcattctaggttctgggcttcgggatgtggacagatctttctgtgaaccaccattcaatccactacaattgtatccagttccctccagaggctctaggggagggcccttcctgcctctcccagctcctgggggctccgggcatccctgaccctgtggctgcatcactccagtctctgcctccatctccacgtggccttctcctctgtgtctgtgtctcctcttctgtctctttccaagaacacctgtcattccatttagggcccttcttatatgtagagtggggtcggaatagttaatattatgtgttaacctgactggatcatggggcacctagatgtttgattgaatgttactctggggtatctgtgagggtggaggggagggtccttcctgcctctcccagctcctgggggctccaggcatccctgggtgtgtggccgcatcactccagtctccacctccatctccatctccatgtggccttctctgtgtctctctgtctccaaattttctacttcattttttttttttttttgagacagagtttcgctcttgttgcccaggctggagtgcaatggcacgatctcagctcactgcaacctccacctcccaggttcaaggaattctcctgcctcagcctcccgagtacctgggattacagacgcgcagcaccacgcccggctaattttttgtatttttagtagagacagggtttcatcatattggtcaggctggtcttgaactcctgacctcaggtgatctgctcaccttggcctcccaaagtgctgggatgacaggcatgagccagtgtgcccaggtattttctacttcttgtaaggccacccatcatattggatcaagggtctaccctaatcatctcatcttcacttaattccatctgcaaagacctatttctaaattaggtctcaattatacatatttggagttaggatgtggacataactcttcagataagagttaatggtggtcgggtgtggtggctcatgcctgtaatcccagcactttgtgaggtcaaggcaggcagatcacttgaggtcaggagtttgattacagcctggccaacatggtgaagccctgtttctactaaaaatacaaaaattagctgggtgtggtggtgcatgcctgtaatcccagctactcgggaggctgaggtgggagaatcattggaacccgggaggcggaggttgccgtgagccaagatagcaccactgcactccagcctgggcaacagagtgacatttgtctctttcaaaaaataaaataaaataatagttaatggcatataagcaataccgtcaaagcctttctttaatatgtgtttttataggaataaaaactctcttgttaattgcacttggtaatatatgcttcctcagctttcttaggtgataatgaggctcaattcttattaagcgcatgaatctgctctgtagcacctaaagtctctaggaagtagctgtcatttctgttgggtggggttgttctggatgtgatctgcttatcttcattattcaaaacagagatcgtggctgggcacggtggctcatgcctgtaatccacgcactttgggaggccgacatgggaggattacctgaggtcaggagttcgagaccagcctggccaacgtggcaaaatcctgtctctactaaaaatacaaaaatcaactggacgtggtggcgggtgcctgtagtcccagctgcttgggagtcgaggcaagagaattgcttgaacccgggaggcggaggttgcagtgagccgagatcacaccactgcactccagcctgggagacagagtgagactccatctgaaaaaaaaaatgagtaaatacaacagagattgctttgatcaacagtatcaaccccaaagtgagctctcagaataacagacaggcggccctccaccagtgctgtacgaggaaggggtgttcctgtgtgtctttggcgagcggtaatgcctgccaagcagctcacattccccaggttccccaacccatgccttgccttgctcagtgagtcgtgtctgcagcaagtgctgctggctgtgccaagactcctcgttccctcctcccttctcccaggccctctcatacagcaggctccgtgtgtggagccccgagtgggcatcagggaaggctggcccccacacacccagcccagcctcaggcctggagttagggaagccagtcatggcagggctgttcttgccagtgggtccaggcaaacccttcagcatggagcccgaggcaggaggcctacacaatcctgcagtgagccctgagctgagaagaagcctgagaaacacgcatgtcttcctctgggtgctgtcatgcatgggtgtgaaaacaggaaatgccccagccagcatacacacgtcacctgcgcacactggcacgcacatgactcacctgtgcacacgagcactcacgcaccttatctgtgcacactggcacgcacctcacctgtgtacacaggcatgcacatctcatgtgtgcccacgggcacaaagacctcatctgtgcccacaggtacacacaactcacctgtgcatatgggcacgcatgcacctcacctgtgcatactggtacacacctcacctgtgcacattggcacacacatctcagctgtacacacaggcacgcacacatgcccttgcttcctcagggcaccatgaaggagaagcagcccctcccggccacaggccctgctctccctgcattcctctcacccgcccttccctgcacagcccggtgcttcttcagctgcccggagaagatgaagtcctggccagcctcgctccttccctcccacaaccggcagggttcacacttcatgcaggatcccatcgaggccgactccctcatcccacacccttcagagcagagaggctcacagacacaggagctcaattcgacaaaacagatgggccaaggtatcctaggaggcccccacggccctcccttcgttacatcctgcccctcgctgtgcagggaaatgcaaactgttaggagctggcagggcctgtgcccctgggctcaccctcctcgtagtcctgagggtactccagggcctgggggtggggagggcgcccaccctgctgtacattacagaggctggccccaaagtctgatgctggcacagccaagcagccagttctttccgagtgtggcattaacgctttgtgatcttagggctgcagagaaattcaaaggcgagtccgactgtgtgctctgactgtgtctgtctccaaattcctacatggaaatcctcatcccccgtgagatggtgttaggaggtgaggcccttgggaggtgatgaggtcacgatgggggagactcaagtatggaatcagtgcctttataaaggggaccccagagagctcccttgccccttccactgcttgatgacacagtgagaaggtgccatgtgtgaaccaggaagcgggttctcgccagacgctggcacactttgatcttggacttccagcctccagaaccgtgagacataaatgtgtgttatttataagccacccaaactatggaatttttctttcttttttttttttttttttgagacggaattttgctgttgttactccggctggagtgcagtggcgtgatcttggctcaccacaacctccgcctcccgggttcaagcgattctcctgcctcagcctcccgagtagctgggattacaggcgtccaccaccacgcctggctaattttgtatttttaatagagatggggtttcaccatgttggtcaggatggtctcgatctcctgacctcgtgatctacctgcctcagcctcccaaagtgctgggatgacaggcgtgagccaccacacccggactgctggattttttcttatatcagcttaaacaaactaagatgattattcccacagaggaatcgtttttatccttaaggcggggttaggaggaattcacaagagagacctgctgatggacagacagtacattgcgtgtcgacaggagtccacaccaatgccacctgcagatgcagtgcctgacattcccatgggggcacaagagaaggtttaaatagatccgttttccttttctatgtctcacctctgtgtttcttgttccttctaaaaaataaagtaacaataccatcgcacattgctaagttgcccaaggacagcaaatggctggggatgtacatatcccacaacacagcgccaggagcacctgtgcccggcagatgcaggcagcaccatttccagagcacatgtgcccagcagatacaggtagcagtgtgcccagagcaccgctacccagcagaagcagggagcaccgtgcccagagcacctctacccagcagactcagggagcaccgtgcccagagcacctgtgtccagcagactcagggagcactgtgcccagagcacctctacccagcagatgcagggagcaccatgcccagagcacctgtgtccagcagactcagggagcactgtgcccagagcacctgtgctcagcagacgcagagagcaccgtgcccagagcacctgtgtccagcagactcagggagcactgtgcccagagcacctgtgctcagcagacgcagagagcacaatgcccagagcaccagtgcccaccagatgcagggagcactgttcccagaggaccatgcccagcagatgcagggagcatcgtgcccagaacatctgtgcccagcagatccagggagcaccatttccagggcacgtgcgcccagtagacacagagagcagtgtgcccagaacacctgtgcccagcagacacagggagtaccgtgcccagagcacctgtgctcagcagacacagggagcaccgtgcccagagcacaatgctcaggagatgcaaggagcaccgttctcagagcacccatgcccagcagatgcagggagcactatgccgggcaccaatgtgcagcaaatgcgggggcactgtgcccagagcacccatgcccagcagactccagggagcaccgtagccagagcacctgtgcccagcagatgcaggaagcaccagtgctcagcagacgcagggagcactgtccccagagcaccagtgtccagcagacacagggagcactgtccccagagcaccagtatccagcagacgcagggagcactgtccccagagcaccagtgctcagcagacgcagggagcactgtccccagagcaccagtgtccagcagacgcagggagcactgtccccagagcaccagtgctcagcagacgcagggagcactgtccccagagcaccagtgctcagcagacgcagggagcactgtccccagagcaccagtgctcagcagacgcagggagcactgtccccagagcaccagtgctcagcagacgcagggagcactgtccccagagcaccagtgctcagcagacgcagggagcactgtccccagagcaccagtgtacagcagacgcagggagcactgtccccagagcaccagtgtccagcagacgcagggagcactgtccccagagcaccagtgtccagcagaagcagggagcactgtccccagagcaccagtgtccagcagatgcagggagcactgtccccagagcaccagtgctcagcagatgcagggagcactgtccccagagcaccagtgtacagcagacgcagggagcactgtacccagagcaccagtgtacagcagacgcagggagcactgtacccagagcaccagtgctcggcagacgcagggagcactgtccccagagcaccagtgtatagcagatgcagggagcattgtccccagagcaccagtgcttggcagacgcagggagcactgtccccagagcaccggtgtccagcagacgcagggagcactgtcctcagagcaccagtgtacagcagacacagggagcaccgtccccagagcaccaatgctcggcggacacagggagcactgtccccagagcaccagtgctcggcagatgcagggagcactgtccccagagcaccagtgtacagcagatgcagggagcactgttcccagagcaccagtgctcggcagacgcaggaagcactgttcccagagcaccagtgtacagcagacgcagggagcactgtccccagagcaccagtgctcggcagacgcagggagcactgtacccagagcaccagtgtacggcagacacagggagcactgtacccagagcaccagtgtacagcagatgcagggagcactgtccccagagcaccagtgcttggcagacgcagggagcactgtccccagagcaccggtgtccagcagacgcagggagcactgtcctcagagcaccggtgtacagcagacacagggagcaccgtccccagagcaccaatgctcggcagacacagggagcactgtccccagagcaccagtgctcggcagatgcagggagcactgtccccagagcaccagtgtacagcagatgcagggagcactgttcccagagcaccagtgctcggcagacgcaggaagcactgttcccagagcaccagtgctcggcagacgcagggagcactgtccccagagcaccagtgctcggcagatgcagggagcactgtccccagagcaccagtgtccggcagatgcagggagcactgtccccaaagcaccagtgctcggcagacgcagggagcactgttcccagagcaccagcgtccagcagatgcagggagcgccacaccgcacagacagagggagatgaataacctttaacccacctgagatgctgttatgattattcacagggtgcacctacctgctctgaaggtcatccatgttcagctcagcgacgtaatgggtggcagaggagacggtgaccaccctcgcactgtggccaggggacccagactctttcagcgtatccaagagaaggttggtcagcaggaagtgccctaggtagttcaggccgaaatgttcttcgaatccatctctggttttcctctgagggaccatcatcaccccagctggacaaaagagaatatcagaaggagttagactggggaagacagtggagaaatctcacagatggattccccagatgcgcaaatggcccaggacatcggagggtggggtgtagagctggcggccatgtcttcctcctgggcctctgtttcctgctttaggtgtgatggagaagattctagaagatcactgaagtcccttcctgccttctgtctctgcacctctgtgccttgagtttaaaaataataaccacaggccgggcgcggtggctcacgcctgtcatcccagcactttgggaggctgaggcgggtggatcacctgaggtcagaagttcatgcctgtcatcccagcactttgggaggccaaggcgggtggatcatctgaggtcaggacttcaagaccagcctgcccaacatggtgaaacccttgtctctagtaaaaatacaaaaattagccaggtttggtggcagggtcctgtagttccagctactcaggaggctgaggcaggagaattgcttgaacctgggaggcggaggttgcagtgagctgagatcatgccactgcactccagcctggtgacagagcgagactccatctcaaaaaaaaaaaaaaggaaaagaaaaataataaccacaatgataacacagcaacacacacaagagagtgagaatcatccaagtcaccaaacagagtcccctggacaattaattattctgggcggctaggtgtgatggctcatacatgtaatcccagcctttgggtaggtgagtagggcagactgcttgacgtcaggagttcgagaccaggctgtgcaccacagtgaaactccatctttaccaaaaatacaaaaaattagtgggtgtggtggtgcgtgcctgtagtcccagctactcggggaggttgaggcgggaggattgtttgagcccaagaggtggaggttgcagtgagccgagattgtgctactgcaccccagcctgggcaacagagatcctgtctccccccagaattctggacaagtatagctgctatggcaccccctcttcactgagtatcccacaaacaaactgctcagatgtcctttgagaaatgccgacctcagtataaacatggcctgtcctcacccctagaccacagggcagccctgtcggtcatcattctatagacatcatcatcaccgcaggttctgtgcttgacatgttctatctaccagacacagaacagcccacccctgtcaggccaagcccggctgagcgcctgccctgaagtccttgctgtggaggcctgatctcaaaggtgacttgtcctagaaacacgcacgaaccatactgccttgtacttagagcagaccagtttgcttggatattaatgccaatgtagatatgtatttgtatgtacatggataatgtagatgtgtatacataggcatgttatatatgtacctggaattctgtatctatctacacgtaacgcaaatacaggcacgtctattcatatacatatatgcatacgcatttgtaaatgtgtttatatagctatacacttgggtatataactgcatgtatgcataattcaaagatatatgcctatagagatatatgttagcatgtacatatgtgttcacgtctttacatgcagattcattttcaaatgcctataaatttgtgcatattttcttttacatatgtgttgtatgcacatgtgcatgagtttgcatgtgtacacatttattcacatgtatatacatgtccatacacatttacatctttgcatgtgtatctgcatacagtgtatgtatatattatatgtttctatttggaattgtacaatcgcaagtatttgcatgtgttcatacacctacaaacacacagcatttgtcattatttgtacattggaacatctacgtgtattgcacgcatgaatatgcattttgattcatctgtggaatcccatagcttttgcatttgtgcacgtttgcatttgcaaatgcatttgaggtgtatgattaatacacacacacacctatccatttgcatatggacacgtttgtgttcaaagatgtatttcaatatggagctatattgatatttgtagatctatttctgtatttgtatatatatgtgtttgcatctgcatgtgtacatatctttctatgcatatgcatttgtatatgtgtttgtgtgtattttatatggagctatctatacatatatgtaggtctagcatttgtctacatatttgtatatgtatatctgcatgtgtacatattttcctatgcatatgcatttgtatatatgcttgtattagtgtgtatgtattttatatctacacacaaatatatagaggtctagcatttctctgtgtatttgtacatgtatacatgcatctgcaagtgcacacattttttatatgtacatgtatttgtatatgtgcttgtatttgtgtgtattttatatggagatatctacacatatataggcctagcatttctctacttatttgtatatgtatacgtgtatctgtacatgaatacattttcctaggtacatgcatttgtttatgtgcttgtatgtgtgtgtgtattttatatgtatgtatttatttattttttgaggaggagtttcgctcttgtcgtccaggctggagtgcaatgaggcagtctcgcctcactgcaacctccgcctcccaggttcaagcaattttcctgccttagcctcccgagtagctgggattacaggcacccaccaccacacgtggctaaatttttctgtattttcagtagagacggggttttgccatgttggccaggctgctctcaaactcctgacctcaggggatccgcccacctcggcctccctaagtgctgggattacaggcgtgagacactgcacccggccgtgtgtgtattttatatggagatatgtatatatctataggtctagcgtttctgtatgtatttgtgtatgtatatgtacatctgcatagcgtacatctttttctatgcatatgcatttgtacacgtgcttgtgtttgtgtgtatcttatatggagctatctatacatatatgtaggtctagcatttctctatgtgtttgtatatgtagaggtgtatccgtaggtgtatacattttttgaggtacatgcatttgtatatgtgcttgcttctgtgtgtactgtaatatctgtatgttatttgtgcctcggtacatggacccatttccctataaatttttgatgcgtgtgcatttgtgtacctgcctgtgtttgtgtacacagtctttccagttgtactttatgaacactcaaaaccaaagctggctcctcgccggctcagcattcccaaagaaccaagcaggagccacgtggccttatcgacccaactttggaactcctacagagttgtcaccactgccccattctaggaattacgagacagttaatgaggacagccgagattcaagagacggagcagggactccagctcccgaagagacaagtgtgaaaagaatttgcaggcctgttttacagcctctccaacccgcctttcaaaactgtggatgcacaggccgcactggatgccccattgcgcggagggcccacagaagactcagcagtgggtcccgcggctctacacgtccctggccccagtggaggcttgacaattgtgaggtccttgaggaaaaaccaacgtcttattctggctgtagcctccacagtgcggttgtagtgctttgggtacagcaagggggaaataaaaaataaacgtggatggagatctgctgcttttgagacgtgaagccacctggacttcctgggtcgagtggagacccggagaccttttgtctagctaaagaattgtaaaggcaccaatcagcactctaaaatggaccattcagcagtctgtaaaatggaccaatcagtgctctgtaaaatggaccaatcaatgctctataaaatggaccaatcagcactctgtaaaatggaccaatcagcactctgtaaaatggaccaatcagcactctgtaaaatggaccagtcagcaggatgtgggcggggccaaataagggaataaaagctggccacctgagccagcttgtgtccccttccacgttgtggaaactttgttgtttcactcttcaccataaatcttgctgctgctcactctttgggtctacactacctgtatgagctgtaagactcactgccaaggtccgcagcttcactcctgaagtcagcgagtctgcgaacccaccagaaggaaaaaactccaggcacatctgaacatctgaaggaacaaactcgggacgcaccatctttaaaagccctaacactcaccgtgagggtctgcggcttcattcttgaagtcagcgagaccaagaacccacaagaaggaataaattctggacacactctcacagagaatggtggcaggggagaggcaccaccatgccattccaggcctgtggcctgctgaaatcctcagggagaaatgagcagactgttcaggtgcagtccttgcttctcacctgcacacactttccagccagactcagtgcttccccctcctacgtgaatatctagctttcaaaaaaacttccaggatacagagaatttattccctgagcttatgcctgtaaaacatcaggagtataaaccaactgggagggatccaatatcaatcagggtccagtatcaatcagtcacaagacacatgtgtattaaacattcaacactcctacagtcctcaaagcccatctaacaaaacacttctgagaagtatgtcagaattcacctcaggagttatccagaaaaaaagcccggcccggtgggtcatgcctgtaatcctcccagcactttcagagggcgaagcgggcagatcagttcaggtcaggagttcgagaccagcttggccaacatggagaaaccttgtctctactaaaaatacaaaattagccgggcgtggtggtgcatgcctgtaatcccagctactcgggaagctgaggcaggagaatcgcttgaacctgggaggcagaggttgcagtgagccgagatcacaccactgcactccagcctgggcgaaagagtgagacaaaacgaaacaaaaaaacatacctgcacctgtctgtttcttgcagcacaactcacaactgcaaacatacggaatcaacctaagttgatttttgtctcaaaaacaaaaaaaaaccaacaacaaaaaaacaaaaacaccagaataggttgctgtgggtggacgggaagctttgcattttgatgaactataaacatctttttcacgatgccattttcctcatattttatttgatgtgaagaatctggagacacacagctcaatccgtgcctgaagtgtcataaattcccagcttaggagagacgagcttatcatgaacacctggcttatgcatgcatggttttgaaaggcagcttcagggggctctaaagcaggcctgcaaattcttttgacactcgtctccttgggagctagagtctacgccccttcccttgaatctcggccatgctcattaactttctcgttaattcttttgtagaatgccacagtggtgtaaacactgtgtgacttccaaagttgggtcaataaggtcacgtggcccctgcttggttcttgggaatgctgagtctgggaggagccagctttggtttaaaaagactgagcaccttcagcctgacatgctggagaggccccaggtacctgttcttgttggccctcccagctaagcccaggtgacaggctgtaccagcttcttgacaccagagaaagctatcctggacatccaacctggtcaagccttcagataaagtcagccccagctgcagccccacaggagaccccccaggcagaactgcctacattcctgtgccccgaaagaaagtgaattcatacaagctgtatagaaaacagcacggatgttcctctcaaagaactaaaagcagatcatttgttcgatccagcaatcccactcctgggtatctacccaaaggaaaagaagtccttatatcaaaaagacacctgcaggccaggcatggtggctcacgcctgtcatcccagcactttgggagaccaaggcgggcagatcacctgaggtcaggagttcgagagcagcctgggcaacatggagaaaccccagaattgcttgaacccaggaggtggaggttgcagtgagccgagatcgcaccactgcactccagcctgggtgacagagcaagactccatctcaaaaataaataaatcaataaaataaaataatcaaacaaaacaatacaaaacaaaatacctgcacctgtctgtttcttgcagcacaactcacaattgcaaacatacggaatcaacctaagtacccctccgtggagtactggataaagaaaatggaatggaatactactaagccattaaaaagagtggaatcgtgtcattggcagtaacttggatagaactggaggttattattctacgtggagtcactcaagaacagaaaagcaaatacacgttctcacttgtaagtgggcactaagctctgggtatgcttctggcattgaaggggcatacggaatagaggaatacacattagagactgagggtggggctgtgagtgaacctgtcacccaggaaatggccactgtacccaacaggtggtttttcatcccctgcctccctccccctaccttctagcagtcaagagtttctgctcttcccatctttgtgtccatgagtacccgctgtgtaccttccaggtgtaagtcagaacatgcagtatttggttttctgtttctgtgctggttctcttaggataatggcttgcagctctgagcaaattcttggtgacaacagcatcgttggggaaggtatcttttgcaagagcagaggggacagtgcttctgtgcaggcaggtggtgacctgtgctccagatgaatccgagccgtgctagggactcgcctggcggggaagctgcgtgagaattcctgcgccgtggtgaatgcagcagccacgcgcaggggccctggatgctgataattcatcgttagtgagctactgcgagtaattacgtttattcctattttattattattattattactttgaggtaaactcttgctgtgtcacccagactggagtgcagtgttgtgatgtcggctcactgcaacctctgcctcctgggttcaagcgattctcctgcctcagcctcccgagtacatgggattacaggcacctgccccgatggccagctattttttgtatttttagtagagacggggtttcaccatgttggccaggctgctcttgaactcctaatctcaactgatcctcccgccttggcctcccaaagtgctgggactacaggtgtgagccactgcacccagccctactaatattattatttttttggagacagagtctcgctctgtcaaccaagctggagtgcagtgtgtccgtattttattttttatttcattttttttgagatggagtctcactctgttgcccaggctggattgcagtgggttgaactcggctcactgcaacctccgcctcccgggttgaagtgattcttctgcctcagcctcccaagtagctgggattacaggtgtgcaccacaacacccggctaaactttttttttttttttttgtatttttagtagagatggggttttgtcatgttgaccagtctggtctcgaactcctgaccccaagtgatctgcccgcctcagcctcccaaagtgctgggatcccaggtgtgagccaccgcgcccggccacgcacccgtattttaaaccacagtgtcacggagacgtttctaggcagcaaacccacctgaaacgctgatatttacggaacgaaagcctgacatattctgaaggagaaattgttttgttgttgagttctttgccagtggctttaggtattaattttcctcttcctatgtaagcagagcattgaaagaccagattggtgccaggtagagagattggatgggtgcctgagatgcctgttaggaggccattatcatggcctaggaagagatgatggtaccccagaggagggattgacggaagtccgaaatgcagaattgagtactagttagacaatcgacggcaaattcaaatgcctgtaggcttttgtatgtgttttaaattttccataatcatgtttttttcggcatcagtaaaattctatttatttatttttgtcaagttattattttcttttaaatcaaaggaaagtataaaaaaggtgcacagggctgggcacggtgactcacacctgtaatcccagcactctgggaggccgaggcaggcggatgacctgaggtcaggagtttgagaccagcctggccaacttggtgaaaccccgtctctactaaaaatacaaaaaaaaaaaaaaaattagctgagtgtggtggcgggcacctgtaatttcagctgcttgggaggctgaggcaggagaatttctggaactcaggaggcagaggttgcagtgagctgatatcgtgcactgcactccagccccggccgacaacagcgagactatgtttcaaaacaaaaaaaaaaaaggtgcagagatcatgagggaaatctcaatggaatcatccaaagcgagcactctcccctctcaggtaaccgcctcccacatctgcacccctaagcccttttttgatccaaaattaattatcacattcttctaaggtaactacaattccaatttccattaccatagatttaatttgcctgtttttttctgggaggcggagattgcagtgagaagaggttgtgccactgcactccagcctgggcgacagagcaaggctctgtctcaaaaaaggaaataaataaataaaataaaataataatttgcctttttttaaaaattttaatttaattttatttttgagatggagtctcactctgtcgctaggctggagtgcagtggcacaatctcggcccactgcagcctctgcctcccgggttccagaaattctcctgcctcaggctcctgagtagctgggattacaggtgtatgctactatgcccagctaatttctgtatttttagtagagacgggatttcaccgtgttggccaggatggtctcgaactcctgacctcgtgatccatccacgtcggcctcccaaagtgctgggattacaggcgtgggccatcgcgcccggcctgtttcttaaaatttcaataatttttgggaaaccagtggttttgggctacatggatacattcttttgtggtgacttctgagattttgttgcacaagttttaatcatcagcaaatatactgatgtttcattgcgaattttgtaaggaataagaaaaccctgtggccacgtcagtgtatcgggtgccgtccacgttaggagcattcacggaatctgtctcttcgccaattcaaaggtggagaatacacaatagaactatcgttcattgatctgcgaatcgaaaggtggaaaatacagaataaaactatcgtccatcgatctgccaattcaaaggtggaaaataaacagtaaaattatcgtccattgatctgccaattcaaaggtggaaaatacgcaatacaattatcgttcattggtctgtgcacctaatggcattttactggggagtgaacgctcagggtcacaatcacatattgtgcctgaagcagtgaacacaggtgaggtgtatcctgaacgggaggagaagggagagttctccgctctccaagcggagaactccagagaaaggagagtgatggggatgaaagggcaatcagagagagagagaggagagagagagggagggcaaagaaggaagagagaaggagagggaggaaatagggagaaagagagacaaagagagatggagagggaacagggagagagagggagggcaaacgagagggagagagaaggaggggaggaaataggggaaagagagaaagagagatggagagggaacagggagagagagggagggcaaacgagagagggagagagaaggaagaggaggaaatgggggaagagagagaaagagagatggagagggaacagggagagagagggagggcaaacgagagggagagaggaggagagggaggaaatagggggaaagagagaaagagagatggagagggaacagggagagagagggagggcaaacgagagagggagagagaaggaagaggaggaaataggggaaagagagaaagagagatggagagggaacagggagagagagggagggcaaacgagagagggagagagaaggaagaggaggaaatgggggaaagagagaaagagagatggagagggaacagggagagagagggagggcaaacgagagagggagagagaaggaagaggaggaaatgggggaaagaaagagaaagagagatggagagggaacagggagagagagggagggcaaacgagagggagagagaaggaggggaggaaataggggaaagagagagaaagagagatggagagggaacagggagagagagggagggcaaacgagagagggagagagaaggaagaggaggaaatgggggaaagagagagaaagagagatggagagggaacagggagagagagggagggcaaacgagagggagagagaaggaggaggaggaaatgggggaaagagagagaaagagagatggagagggaacagggagagagagggagggcaaacgagagggagagagaaggaggaggaggaaatgggggaaagagagagaaagagagatggagagggaacagggagagagagggagggcaaacgagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacagggagagagagggagggcaaacgagagggagagagaaggaggaggaggaaatgggggaaagagagagaaagagagatggagagggaacggggagagagagggagggcaaacgagagggagagagaaggaagaggaggaaatgggggaaagagagagagagatggagagggaacggggagagagagggagggcaaacgagagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacggggagagagagggagggcaaacgagagggagagagaaggaagaggaggaaatgggggaaagagagagagagatggagagggaacggggagagagagggagggcaaacgagagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacggggagagagagggagggcaaacgagagagggagagagaaggaagaggaggaaatgggggaaagagagagaaagagagatggagagggaacagggagagagagggagggcaaacgagagggagagagaaggaggaggaggaaatgggggaaagagagagaaagagagatggagagggaacagggagagagagggagggcaaacgagagggagagagaaggaggaggaggaaatgggggaaagagagagaaagagagatggagagggaacagggagagagagggagggcaaacgagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacagggagagagagggagggcaaacgagagggagagagaaggaggaggaggaaatgggggaaagagagagaaagagagatggagagggaacagggagagagagggagggcaaacgagagggagagagaaggaggaggaggaaatgggggaaagagagagaaagagagatggagagggaacggggagagagagggagggcaaacgagagggagagagaaggaagaggaggaaatgggggaaagagagagagagatggagagggaacggggagagagagggagggcaaacgagagggagagagaaggaagaggaggaaatgggggaaagagagagagagatggagagggaacggggagagagagggagggcaaacgagagagggagagagaaggaagaggaggaaatgggggaaagagagagaaagagagatggagagggaacagggagagagagggagggcaaacgagagggagagagaaggaagaggaggaaatgggggaaagagagagagagatggagagggaacggggagagagagggagggcaaacgagagggagagagaaggaagaggaggaaatgggggagagagaaagagagatggagagggaacggggagagagagggagggcaaacgagagggagagagaaggaagaggaggaaatgggggaaagagagagagagatggagagggaacggggagagagagggagggcaaacgagagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacggggagagagagggagggcaaacgagagagggagagagaaggaagaggaggaaatgggggaaagagagagaaagagagatggagagggaacagggagagagagggagggcaaacgagagggagagagaaggaggaggaggaaatgggggaaagagagagaaagagagatggagagggaacagggagagagagggagggcaaacgagagggagagagaaggaggaggaggaaatgggggaaagagagagaaagagagatggagagggaacagggagagagagggagggcaaacgagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacagggagagagagggagggcaaacgagagggagagagaaggaggaggaggaaatgggggaaagagagagaaagagagatggagagggaacagggagagagagggagggcaaacgagagggagagagaaggaggaggaggaaatgggggaaagagagagaaagagagatggagagggaacggggagagagagggagggcaaacgagagggagagagaaggaagaggaggaaatgggggaaagagagagagagatggagagggaacggggagagagagggagggcaaacgagagggagagagaaggaagaggaggaaatgggggaaagagagagagagatggagagggaacggggagagagagggagggcaaacgagagagggagagagaaggaagaggaggaaatgggggaaagagagagaaagagagatggagagggaacagggagagagagggagggcaaacgagagggagagagaaggaagaggaggaaatgggggaaagagagagagagatggagagggaacggggagagagagggagggcaaacgagagggagagagaaggaagaggaggaaatgggggaaagagagagagagatggagagggaacggggagagagagggagggcaaacgagagagggagagagaaggaagaggaggaaatgggggaaagagagagaaagagagatggagagggaacagggagagagagggagggcaaacgagagggagagagaaggaagaggaggaaatgggggaaagagagagagagatggagagggaacggggagagagagggagggcaaacgagagggagagagaaggaagaggaggaaatgggggaaagagagagagagatggagagggaacggggagagagagggagggcaaacgagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacggggagagagagggagggcaaacgagagagggagagagaaggaggagagggaggaaataggggaaagagagagaaagagagatggagagggaacggggagagagagggagggcaaacgagagggagagagaaggaagaggaggaaatgggggaaagagagagagagatggagagggaacggggagagagagggagggcaaacgagagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacggggagagagagggagggcaaacgagagggagagagaaggaagaggaggaaatgggggaaagagagagaaagagagatggagagggaacggggagagagagggagggcaaacgagagggagagagaaggaagaggaggaaatgggggaaagagagagagagatggagagggaacagggagagagagggagggcaaacgagaaaggaagagagaaggagagggaggaaataaggggagagacagagaaagagacagagagaaagagagaaagggggagagaaggaaggcaaaggagagaggaggagagatgggggaaggaggaaagagagagaagtgggacacagaggaagacaaaggagatagagagacaaggggagagacaggaagagaaaggagatagggagaagagggagggtgtgcgagagggaaacagaaagggagagagagaagaaagaggggagagagaagaaagaggggagggagagaagaagggaaagggagggagagagggagagagagaatgggagaaaaggagagagagaagaggggagaaagagggagagagggaaggaaggagagagggagggagggagagggagaatgggagagagagaagaggggagaaagcgagggagggagggggagagagagaagaaagagagaagagagaaagagagagagggagagagagggagaaagggagagagagaagggagaaggggagagagagggggagagagggagggaggagggagaagggaggtcgagagcaaaatagtagaagcggggatggggtagactgaggagagagagagacagagagaaaaagcaaaagagaggaaaagtgagacagtgaagaggtggaaagagagaatgacagagagacggggagaaggaggagagagagacagagagttacagaaagagagagagagaggagaaaagcatttgagtaactgaaaaaccactgcttctcaacccacttcctagaatctcgggagggcggtgggaaggatggagccagtccagggaggctatgggacggacgccctgaacatctagccttctctggcagggaacagcctgccgcagagtcacaacagaccacatcccatgctgctgccaacaccaacactaaaagaacatccaaatgcctcctgttcagagaaggcgccatcgggagaggcagaggaaaccactacggaacagaaagctactctatccacaggagagcagctctggaagagaagcaaacagaaggcacgcagaataaatggtctacacctgtgcagactcaaggatccgctgacgaatgcatgcgccgcgatgcaacactttccgtcttcccgggagggagaccagatgactgtggagcccgagtcacatagaaaatgccaggcgcccacaaagacaggagatggctgctcaggtgtccgtccaccaaaaagtgggtcctcagtaaggaccggctccactgcacctcagtcttctgttgatgcagaactgcacacctgggcttccccgaatgaatcttccttaactctcatgggtcttgtaggtgccctgtgcccatttgctcatttgaatgaactcattagaattcattcattcatttgattccattcattcatttgcatcatttgaattcattccttcttttgaattcacttgttcctttgaattcattcattcacttgaatttattcatttaaattcactcatttgaattcattcattcattcctttgaattcgttcattcctttgaattcactcattcctttgaattcactcattcctttgaattcactcattcctttgaattcactcattcctttgaattcactcattcctttgaattcattcattcattcctctgaatttattcattcctttgaattcattcgttcctttgacttcatttgttcattcatttgaattcattccttcatttgaatttattcattcccttgaattcattcagattcactcatttgaattcattcattcattcctttgaattcattcctttgaattcatacattcctttcaattcatttagtcctttgaattcattcgttcctttgaattcatttgttcattcattagaattcattcattccttagaattaattcatttgaattcatttgttcattcctttgaattcatttgcattcattcattcctctgaattcattcattcatttgaattctttcattcattcattcactcatttgaattcattcaagtgaatgaatgaatttgaatgaatgaatgaatgaatgaatgaatgggtgaatgaagaactgtaccaaaaaacagagtctttaggtctctggccagggaagaatcattgttatttttcagggtcaccctgtatcgtggacgtatttctttggtggtaggaaaaataatgcttagtaattcattatctcagaaagaaattcatccattagagttatgggaagatggctgacaaggataaatctataaatcctctgcattattaaaaatctatcaattttcagacatggggatgggaagctagataaatacaattttgaagtgaataaaccataaataccggctctgcaggaggtctattattgatttattcttgtgcttgataaatcatcgcgttgcctctgagcttcccacagcagccagacagaggcagtcaggttctattttcaacccactagcaaatgaaaaagatattctatgtctgaagtatttaatgtttgcaaaaccttgattgctctaagaataaaaaaagaaaagcacgaagtgtagctccttcttgccttggaagtcaccctggctgagctcagctggggctgttttccatgagacttgaggcacgtggttgactagcaggagttttggagggaaggttctggggaaatagtttagggcagcagtctccaacctttttggcaccagggaccacttttgtgaaagacaattttctgaagacagaaggtggaggtggaatgtggggatggttttgggatgattccggggcatgacatttattgtacactttatttgtattattattacattgtactatataatgaaataattctacaagtcgccatcatatagaatcagtgggagccctgagcttgttttcctgtgactagacagtcccatctgggggtgatgggagacagtgacagatcatcaggaattagattccataaggagcacacaacctagatccttcccatgcacagatcatcaggctttagcttttcataaggagtgcacaacctaagtccctcacatgcacagttcacagtagggtttgtgctcctataagaatctaatgctgctgctgatctgacaggaggcagagctcaggcagtcatgtgaacaatggggagtggctgtaaatacagatgaagctttgcttgttcacttgccactcaccttctgctgtgcggccggtgtcctaacaggccatggactggtactatgacctgggggttggacagccctggtttaggggtctgcagaccccctactagcctcttagacactaaaagtaccaccactggagtccttccctgaggctgcctataaatagaaactctatttacataagttgacaccagcaatatcccaaacatacaatccagcaatctcatttgcacacaacgaagaagaattctgatgcacaaaccaacgagaaaaatccttgatttcttctctaagtcaaggtacatctggcccaagcttcagcacaccagctggtgatgaacccattctcagcgttgactgtatagaatccagccttctcatttgcacacaacgaagatgaattctgatgcataaaccaaggcatgcaacaaatgagaaaaatcctttacttcttctctaaatcaacgtacatctggctcaagcctccagcacaagagctggtgatgaatccattctcaacgctgactgtgtagaatccagccttctcatttgcacaccacgaagatgaattctgatgcacaaactaaggcatgcaataaatgagaaaaatactttgcttcttccctaaatccaggtacatcagacccaggcctccagcacacgggcttgtgctgaatccattctcagtgctgactgtatagaatccagcctcgtcatttgcacaccatgaagatgaattctgatgcacaaaccaaggcaaaaaatgctttacttcctctctaaatcaaggttcatctggcccaagcctccagcacacaggctggtgatgaatccattctcagcatagactgtgccatctgggctacttctggcttgaggagcacttatccctgcagctttccatccaccctgggtacctcgggaggcccctttccaagcccatgggcttcacgaagctccatggttctgttgcatttccaagagaaccaagaggatttgtcaacaagagactgcctctctgcatttctgtcttcttgtgaagagtgggcaatgggtattcaacacagcctccaaaagcgaagtctccagctcttttctagaagcttctgtctgtacccacagaggaaaaaaaaaaaaatccagatcctctgcaactgagctcttctcaacagtgaccccagggacaagatgaaccttagtcagccacaaaaacctatagggagtccaggaaagccacagcctgagcaacctcttgaaagatgtagaacaaaaagataaaaggaagaaagtgcaaagtgttatttcaagccatcatcttgtaacaaatggattctcattatcacctcctggaaatggtgttctgagcagcacaggctggggaattccagggaggcgtgtgacttggggtgcaatcttctctgtactttacaagactgtgttgtcacattgcaagaggtgtgttttctaaggcagaacatttcacagaatgattattggtccaatgtttgtttccgttgctaaagtatgatttctatgaggtcaagaatcttgcttattattttatttttcctgcaagcgaagtatgtgaagggcagagtaggtaggtatggcaggttaaataatgcacaactcaagatgtccaggtccacattattcatgtgggagacagaatcatgaccccaaaaatgcccacactgtaatccccatgtgggagacacaataatggccccaaagatgtccacatcctaatcctcaggtggaagacagaataatggccccaaaaatgtccacatcctaatcctcatgtggaagacagaataatgacccaaagatgtccacatcccaatcctcatgtggaagacaaaataatggccctgaagatgtccacatcctaatccccatgtggtagacagaataatggccccaaagatgtccacatcccaatccccatgtggtacacagaataatggccccgaagatgtccatatccgaatccccatgtgggagacagaataatggccccgaagatgtccatatccaaatccccatgtggaagacagaataatggccccaaagatgtccacatcctaatccccatgtggaagccgaacaatggccccaaagatgtccatatgttaattcccatgtggtagatagaataatagccccaaagatgttcacattctaatcctcatgtgggaaacagaataatggccccaaagatgtccacatcctaatcctcatgtggaagactgaataatggctctaaagatgtccacagactaattctcatgtggtcgacacaataatgaccccagagatgcccacaacctattcccaatttggaagagtaataactcaaaagatgaaaaaatgtccatgtcctcatctctggaacacatgaaaatgtgactttcacggcaaaagggcctttgtagatgtgaattagtggaagatcttgagatgaggtgattatctgagatgatcctggtgggccccaaataatcacaatggttcttctacaaggcaggcagaagaacaaaagtaagtgaaggagataaaaaaaaagagaaggcaagatgagagagagaaagagagagaagggaagagagggagagagagagaacaagaaagagagattcaaaggtgtctcattgctggctttgttgttgtttttgttgttttgagatggagttttgctcttgttgcccagactggagtgcagtggtgtgatctcagcttactgcaacctctgcctcccgggttcaagcaattctcctgcctcagcctcccgagtagctgggattacaggcatgcgccaccatgcccagctaattttgtatttttagtagagacagggtttcacaatgttgtccacgttggtctcgaactcctgacctcacgtaatccacctgcctcggcctcccaaagtgctgaggttacaggcgtgagccactatcattgctggctttaaggccgggttggaggccatgggtgaagaaacgctgacagtcttctaaaaactggggaaggaaatactctcctctagaaccagtgtcagccatagactcaggaatttcacactggacttactggcttgaggtgcctctgaggcattgagcgaaggtaaaaggtcttagcatggaagaaaggtctagataagtctaggaagaagtaaacccaatatgtgcatgagattttctacagaagagatagggtacagagacaatccaacaacaagacccttttgattcaaattcaaccctgtcccagtttccagaatatttttgtttgtttctgagagccctgtgtgccttgtttaaaatctgttgagaaaaggaacagaggagaatcctaggaatgcaatagccatttcaaaaggtaaacgtggtggttgagtgatggagtatacgctggttagcctgtgtcaactggtgttagcctgtatccactgtcacagatgtggttcatatacacattgctcagtaaaattctgctccccccagaacacagtaagattctgctggagaaacatatcatatctgacattcctaatttttttttttttttgaaacagtcttgctctgttgctcaggctggagtgcaatggtgtggtctcggctcactgcagcctccacctcccaggttcaagcgattctcctgcctcagcctcctgagtagctgggactacagatgcccgccaccacgcctggctaatatttgtatttttagtagagacagggtttcaccatattggtcaggctggtctggaacccctgacctcaggtgatccactcacctcagcctcccaaagtgttgggattacaggggtgagccaccgcgcccggcctgagattcctaattttttctgcttactggtggatgcaagcccataccaaatggatggaagtagtcgcacaaaagtcctaagaggatggacagttctgttttgtgtgtctctgtgcaagggcaccatgtcatgtatgtatttccatctccaactgctctgtgataaagtgctcccattactaatgagtaagggtgttacacagaacgaggaaatgagacgtcgggtcgtgtaggatctccacagtgcctctaagtggtctccacatttggtgacttataatgctataattctaatcacttctaatactgataggtcttcagcaaaggaagtccacacccagtgctgagacagaagattccaaatggctgctgactgggaaatcatttatgcctgcgtagaaacttcagatcccaccaggatggcaaatctgaaaagtgttattgatctccaaagaagacacacaaagttaaaatcattccggaccttccaacaggagccactagcactgataatacgatgtttcttaccaggctaagtacatggaaatggtgttgtctgtagctatttgagtggcactcacacatcatagctatgtctgcacgtatttttatgcataaatacatatacatcatacatcaaatacatatacaaatacatatgcactcacacatagctatgtctgtacaaatttttatgcataaattggcatcacactctatgtatagttttatatcccatgcttctcctttaaactctagcataataatttccaattaaacaagtgggttgagggggaaccgtgggtatctcatccactttcctatcctccaatcccattaatgttatacaaaaacacgaaacacatcaagacaaaaagaaaaaaaaattagatagaagctaccacatcttggcagctggaaacagacaggtattacaactttagtacaaagaataatgctttctccctccttacagacatgtccatatcctaatctccagaatttatgaaaatggtacgttaggtagcacaaggggttttgcagaattaagaatctttaatggtctaggtgggtaatggagtaattacattgggtaatcacaagatccttttgctgatttttttgtctgcaatctgaagtgtcaataacttgataaatatttcatgtatttgaaaggaatgtgctgtctttatgggctcactgtttgacgtacgtctgttctatccactgtattaatgtcactatttatttcctctctgaatttgcatttggtctccatctgtgaaagtgatgcgttaaattctactagcacacatgtttgttggtgtatttctgagacctttagttctatgtatttacttagtttggagatgtcaataactgtacctcctcagtgtggagggttcaggttaacttttataaaaaataaaatggactgcagcaggggatgagagtaatgggcatcagtgttacgaggagaaacattaagtgttgcaatgatcttaagcgctcagcgtggcccaaagaagggctcaaggtcaacagtaagcgttgcaatgaccttaagcactcagcgaggctcaaagaagggctcaaggtcaagggtagtttgtgttgaagattggcagatgggcagattgaaggtggggaaggggagatattgactccacctatctgggtgagaatgttgaacagggggtaaaatcaagagataaatggtaatgagcttctagtgcccaaataatgactctcaggggaatgtggtgatggttttgtaagataacatttgggaaaacaccaacccttagcatgtgcctcataccctttagtccaagtggacaagtcaacgtgtcaactccatacaacatgttatcgcgtttaccattatttcaaagtaacatgctaacaagaatgatgctcttccaaagctatccgtgaaatgaagcactgactagaaatagcaggtatgttcaataattcccatggatatcctgttttgctgagacacttctcccgcatgaaagctagagttcctgtttgcattcaaattaacccctggcttgctgcaatttcaccaggactcaccattgttgatcaggacatggagaggaatcttcttcatcttgaacttctgcacaaactgccggatggaagtcatggaagccaagtcacagtataaaaattccactggaaaaggacaacaacaaaaaatacctggttatctcccaacctatttcagagattaagaaaatttctaaacaggtcaaactcaatttcatctaggaagtaacactttttttttttctgctctttttgagatggagtctcgctctgttgaccgggctggagtgctgtggcaggatctcagctcactgcagcctctgcttcctgggttccagtgattctcctgcctcagcctcccaggtagctgggattacaggcacatgccaccaggcccagctaatttttgtatttttgtatttttttttttttttttttttttagtagagacaatgtttcaccatgttggccaggctggtctcaaactcttgacctcaggtgatccgcccgcctcagcctcccaaagtgctgggattacaggcgtgagccaccacgcctgtccaggaagtaacactgaattggacatgtcagtagggtacaatgaggagctcatactctagggagatcaatgagtcccatccttgtatagtcccctttccttgagtctgtgtgggacctgtcattctcctcctgaccttgatgtgagctgatgttttgtgagagcgccttggggccagaacctgggcatggcctctctaggagctgacagcagcccctggccaaaagccagcaagatactcagatccccagatctgcagcttccaggaattggattctgcgtataaccatgtgaatttcgaagatcctgagctccagagaggacctcaggccagatgacactttggttatagcccagtgagaccccgaagagagaatgcagttacacctgcccagattcctgacccgcagcagctgtgggatagtaagtatgagcccttccacgctgctgagtctgtgggttattttgttacacagcatatgtaactgatacacaaaatgactcagaagcaaggacttccttcttctgcagtagaggaatatagaatatagaattttatataataatcaaacaggaagcaatttatgcatcccctgctacagatagtaagaagtacgagcccttccacgttgctgaatctgtgttattttgttacagggcatatgtaactaatacacaaaatggctcagaagcaaggacttccttcttccacaggagaatatagaattttatataataataaaaaaggacgccatttatggatcccttgctacagatagtaagtatgagctcttccacgctgctcagtctgttattttgttacacagtatatgtaactaatacacaaaatgactcagaagcaaggacttccttcttctgcagaagaataataaaagaaagcattttattttttattacatttatgtttttggagacagggtctcactatgtccccatggctggtctcgaactcctaagctcaagtgagcctcccacatcagcctcccaaagtgttggattacaggcgtgagcagctgtgtccagccaaagatgacatttttagagagtgaatgactcagggacagctttataacatcacataggtagagaggtagacttatgtctattgtattcagtatatcaacttcactctttctctctaaattcccagtgggtctccatcgctaaaagtgatgtgtttgattgtgttaaagctgttttttttttttttttcccagaaggactgaggttttggagggagaggaactagaaagaaaagcaaattcacaggtatataattctgcctccaggtccatgggttcaaggaggttgggagaacaatgcaacaacctaaagtcagacagaacaaaatgcatgaaaactagctattacttgcagcagagacagcagatctctgagggaagaagcaagttcccttacattgagatgggaaggtaatttctggagagaggtggaaggtattgggggacactgccagtgagttctgaaaggtgaggatggggaatggtgtgaggtggaagagcaaatcacagcatgtgtgcagaggtcagagacaggagtcctcagggagggagcgagcagaggctggttctgggctggccgagaagagaacagccttgatctgcagggctgctggtggtcagtgtcatttacagcctcctcactggggagcctcataggggaaaatcattactgtaaaagaactgttaatatttttatgaaggccacatagctttcagaggataagcagtgtgtgtgtgtggtggggggaggggtctgcctgtgccccccatgtctgcactgatgtgtaaaatgccagcaatcaattttatgacagacacaccttgcttaataagctctatgagccttactctccaaaactattactggaatgctcatcatcattccaaaacgaaatgactctccactcaccatcagagagagagaagagacagagatggagtgtaagaatgagaaagagagagatagaaagatagaagcagagagagagagaaagagagaaagaaagaaaggctaagagagaaagagaaaaaaggagggggaggaaaaggggaagagagaaaaaacacacagagataaagacaaagagacacagtgagagagagaaacagaaagagagagagggacgggagacagtaaaagggacaaagagagaaaggcagacagagagatacaaagaaagaggccgggcacgatggctcatgcctgtaatcccagcactttaggaggcgaaggcaggcagatcacgtgaggtcaggactttgagaccagcttggctaacatgttgaaacctcgtctctactaaaaatacaaaaattagccagctgtggtggtgcacacctgtaatctcagcactttggaaggtgggcagaggtcaggagttcgagaccagcctggccattgtggtcaaactccatctctactaaaaatacaaaaattaggcgactgtggtggtgcacgcctgtaatcccagctacttgggaggctaaggcaggagaatcgcatgaacctgggaggtggaggttgcagtaagccgaggtcgcgccactgcactccagcctgggtgacagagcaagactctgtctcaaaaaaaaaaaaagagacagaaagaggcaaagagagagagcgtgacaaacactgagagacagagagaaatagagaaaagaagacaaagagagagacagagaaagagagagagagagaggaaaaagagagggagagagagagaggaaaaagagagggagagagagagggagaaagacaaagagagcagacagaaaaagaaagagaatgaaatgagagaaagtgtgtgttagtttcatattccttactgtataaggagaagaaaaggaaatggagaggatttggagaaataggaacatttttacaccgttggtaggagtgtaaattagttcaaccattgtggaagacagtgtggcgattcctcaaggatctagaaccagaaataccatttgacccatcaatcccgttactgggtatataccaaaggtttataaatcattctactataaagacacatgcacacatacgtttattgcggaactattaacaatagcaaaaacttgaaaccaacccaaatgcccatcaatgatagactggataaagaaaatgtggcacatagacaccatggaatactatgcagccataaaaaaaggatgagttcatgtcctttgcagggacatggatgaagctggaaaccatcattctcagcaaactatcacaggaacagaaaaccaaacactgcatgttctcactcatcagtggaagttgaacaatgagaacacatggacacagggaggggaacatcacacaccagggcttgctggggggtggagggttagggaagggatagctttaggacaaatacctaatgtagatgacgggtcgatgggtgcagcaaaccaccatggcacgtgtatacctatgtaacaaacttgcacgttctgtacatgtatccagaacttaaagtataataataccaaaaaaacaagaagaaaaggaaatggtatctggattactttgacaggacataactttctaaaacacgtcattctggataaaatattaccaggctgttaggacacgctgctgagtctgtgttattttgttacacggcatgtgtaactaatacacaaaatgactcagaagcaaggacttccttcttctgcagtagaataataaaagagggctagcacttgcttgtattgacggcttgtattttcacgcggttccggcatgtggcaataccgaagcacaaagctggggcgcatacgcacatttattttctcatcgaagaccataaatagttcccttcctcccatacgtagcccattctcttgactttccttttctgggatggactgtggggttctcgccgagagatgcttgtgtgcctcacttggggatcgtaaacgcaaatgtgtcacctccttcaggaagttttcctgaaccccaagccacgccgggcatctctagatctggcttccgcaatcgcaacgacagtacccatcattgcacctcctcacttgcatgaccagtatgtttttaagcatgtctcatatgccttggatgctacgtaactttggaacatacattgaaatgatgcatctttgagtgtccagagctaggctctctgggcacacccagaaaaaagtcagcggaagaggtaaagggaagatgtatgggagcttgggccacgtcctctgctggcgctctgccgcatgccagcttctgccccagagggaggggagggaaggagagggaaaaagagaaaagaagaaaaggggagaaaggtgaagtgaaaaatatcagcatgaagcaaaaatgtgtcctcagacaaaaaggaaatgcatagacccgaggcagacaggaataggacccaggcagataggaataggacccaggcagatagacccaggcagacaggaataggacccaggcagatagaccccaggcagataggaataggacccaggcagataggaataggacccaggcagatagaccccaggcagataggaataggacccaggcagataggaataggacccaggcagatagaccccaggcagataggaataggacccaggcagataggaataggacccaggcagatagaccccaggcagacaggaataggacccaggcagataggaataggacccaggcagatagaccccaggcagataggaataggacccaggcagataggaataggacccaggcagataggaataggacccaggcagatagaccccaggcagacaggaataggacccaggcagataggaataggacccaggcagatagaccccaggcagataggaataggacccaggcagataggaataggacccaggcagatagaccccaggcagacaggaataggacccaggcagataggaataggacccaggcagatagacccaggcagataggaataggacccaggcaggcactgcaagctgtgagcatcatcttgggaatatgcaaatgtttgtgctgaattactttcctttttaaaattatttatgcatttattgagacagggtctcgttctgtcacccaggctggagtgcaaaggtgtgatctgggctcactgcagcctccacctcccgaattcaagcgattctccctccttagcctcctgagtagctgggaccacaggtgcgcagcaccacgcctggctactttttgtagttgttgtagagatcggattttgcaatattgcccaagctggactcgaactcctgggctcaagcgatccgcccgccttggcctctcaaagtgctgggattaccgtcgtgagccaccttgcctggccatcctttcctaaggtagtaagaatgtggtaggctaaatgacggtatcctccactccgtccctaaaaatctcctggtcctaatctctagaacctgtgaaaagattaccttgtatgaaaatagggtgtttagacattaaaggttttcaaatgaggaaattatcctgtattagcctaaatataatgacaaagatttttgttttttgtttgttagcttttatagagacaggggtctctctatgttgccaaggtaggtctcaaactcctggccttgttatcatactgctgcccaaaatgctaggatgacaggagtgcggagttttttttgttttgtctttttgagttttttttttttgacaaagtcttgctctgtcacccaggctggaatacagcggacagatcttggctgactgcaacctccacttcccgagttcaagtgatcctcccttcctcagtctcccaagtagctgggattacaggcacccgccaccacgcccggcttatttttgtatttttagtaaagatggggtttcaccatgttggccgggctggtctcaaactcctgacctcaggtgatctgcccgcctcggcctcccaaagtgctgggatgacaggcatgagctaccacgcctagcctggggtttttataaggaggaggaacaggcatgcttgagacagatgagagaaaatgatgatgtgaagacagaggcagagactggagtgatacagccacaagccgtgggatgcctggagcccccaggagctgggggaggccaaaaggatcctcccctagagcgtctggatggagctcagccctgagacaccttggatttaaagtcttgtcctccagacctgggagaggatatatttctattgtgcaagttccccagttttggtgttttttttttttttgttagttcaatatgattttattcaaaaatgtatacagctgaaggagggatctggtcttttgttaaaaaaaaaaaaaacaattttcacagtatatatttggccattttagctctgtagtgaacaacaccagaaaaggaagtttctgttcaagatcctgactccagcacactcagccaggttgcttggcaagatgacacatttcctggtctgaagcacacagcccatcctctcacctaagtggaacagcagttctcctgcaggcgcgtgtgtacacacacacacacacacacacacacacacacacacgaggtcttattttcactgctctacacagggtcctgagaacccttacttttaaagttgggaaaaacgggccgggcgcggcagctcacgcctgtattcccagcactttgggaggccgaggcgggcggatcacctgaggtcgggagttcaagaccagcctggccaacatggagaaaccccgtctctactaaaaatacaaaattagccgggtgtggtggcacatgcctgtaatcccagctaccagggaggctaaggcaggagaatcacttgaacctgggaggcagaggttgcggtgagccgagctcgtgccattgcactccagcctgggcaacaagagtgaaactctgtctcaaaaaaaaaaaaaaaaaaaaaaaaaaaaatgggaaaaatgtggaaggattccttaactcattgtctgcgacaaatccagctgccttttaactcttagcaactgccagtatcaaatacttgaaagtgacgagatgctccatttaatgcaacaactcaaatgctaagcaattcggtcaagtcacatgcttgaatatttttaaatgtcacttaaaaattatcgagagaagataagatgtgcttttcacagtaaccctaaggaactcacacagaataaaaatcttaaccctaacggagtgtgaatccacagtaacaaatgccttctgtcactgtgattctgacagtgagacagtatcatatgaagacaggagattcacgcacctgctgtgtctgatgcccctctcggcacctagcatggtgaatgatgtccacgcttcccgtagcccacacaccacaccctccaatgcagaaagtgagtctacaattctcactgttgctcttgaggctgccaataactcatccaacttttcttttatttgcaactcagtgacagacagtaaaccctgagactcaagaagataacctcatctggccgggtgtggtggctcatgcctataaccccagcactttgggaggctgagatgggtggatcacctgaggtcaggagttcgagaccagcctggccaacatggtgaaatccggtctctactaaaaatacaaaaattagccaggtgtggtggtgcacgcctgtaatcccagatactcgggaggctgaggcaggacaatcgtttgaacctgggaggtggaggttgcagtaagccgagatcacaccactgcactccagcctgggcgacagagcaagactatgtctcaaaaaaaaaaaaagataacttcatccacagaagaatttctaacatctaaaggggtttcctgagggcaagtcagaaatacagatttctgaaattaatgctgcccaagagatgaagtcaactggaaagacacagaggcatgtgttgataaatagggatcaagaagaaaaaaaaattccttttgtttggagttctggcaaatcgcctggtttggaggaactgaattaccccttcttctttgcgatagagaacatcattatggaatgaactgtacctccctaaaaaatccttttgtctgaggctctggcaaacctcctaatttggaggaattgaatagtgccttcattttttctttgcaatagatataggacatcgttatagactgagccgtgccctccctcactcatcatcagaacccttaaactccaatgtgactttatttgcagacagggcctgtaggagctcaaaagggtgaggccctcgtccagtaggactggtgtccttataatcagagaaacacacaccaggtgtgatggttaatgccgagtgtcaacctgattggattgaaggatgcaaagtattgatcctgggtgtgtctgtgagggtgtggccaaacaagtttaacatttgagttagtggggtgggaaaggcagacccacccttaatcggggtgggcaccatctaatcagctgccagcacagcacattcaaaaagcaggcaaaagaatgtgaaaaggttagactggcctagcctcccatgctacagctttctcccgtgctggatgcttcctgccctcaaaaattggactccaagttcttcagctttagcactcgggctggcttccttgctcctcagctcgcagacagcttattgtaggaccttgtgatcctgtgagttaatactgaataaacccccctttatatatagctatttatcctgttagttatatccctctagagaaccctggccaacacagggtgcatccctcaccccctatatctatcaccctgctgcctgagttgataggaaagcagaaagagcccctttttaatgtttaattttattaagtatgcaatttcccagtgcccaaactcatgttgatttcaaaaactgcccttttaaagcatgtggacagggtaacaattcatagcaggtgacaaaaatgttttataaataatatccacggaaacagaaggtgtcaccgtctgcagaatgcagccaaaatattcagaagatttgtatcactctaagttctcgtgctagtaagaaataaaaaagcaggccgggcgcagtggcttacgcctgtaatcccaggactttgggaggctgaggcgggcgatcacctgagttcaggaattcgagaccagcctggccaacatggcaaaaccctgtctctactaaaaatataaaacttagctgggcatggtggtgcattgcctgtaatcccagctacttgggagactgaggcaggggaatcgcttgaacctgggaggcggaggttgcagtgagccgagaccatgccactgcactccagcctggtgacagtgccagactccatctcaaaaaaaaagctgtgtaaatacatgaatcattagatattagcctttctttgctgagccttgcacatttccacgaggtgtctctggaagcaggttagctttggtcttattgctgcgtggagcagagatgagagggatgggccatgacatgccatcctgcagcattctggtctttgtatgatcacggctggttgcgctgcaggagcacgccaggtcttttcacctagttctttgttgttgttgtttgagatggagtttcaccctgtagctcaggctgaagtgcggtggtgcgatctcggctcactgcaacctccacctcctggattcaaccaattctcctgcctcagcctcctgagtagctgggactacaggcacccgccaccacgcctggctaatttttgtgttttagtagagacagggtttcaccatgttgcccaggctgttcttgaactccggaccttgtgatctgcccgcctcggcctcccaaagtgctgggattacaggtgtgaagcacctcacccggcctcatctagctcttgatgacatactcagaccaacccgtggggtcccgggtccccagaacagaggtggacatggctccgatatcacaagaactggcgcttcctgcagcacacacctgaggttgagacacagtgattaggttttgttttattgtggctgatctaggacactttaaataacacaacatccaagagtcagccaaacgtggcagccaaaagtgctcctgaccttgtgatctgaaatatatactttaaccttctcttggaaggcatgttttaagataatataacagcttcctcatcatggagaatgaagcccatctgtaccaagtcaccaggccatcaaggaaaaggaaataagtactttcaatattttccttagagaaatacagttgggtgggcaggtgcagtggctcacacctgttatcccagcactttgggaggccaaagcgggcggatcgcttgaggtcaggagctcaagaccagcctggccaacacggtgaaactgcatctctactaaaaatacaaaaactagccgggcatggggtcaggcacctgaaatcccagctacttggatggctgaggcaggagaattgcttaaacccgggaggtggaggttgcagtgagctgagatcgcaccactgcactccagcctgggtgacagagccagactgtctcaaaaaataaataaataaataaataaagtaatatattggatggtatgatggtacacacactcctgaatcagacggctgccactctgtgaactgttactgcaagctgtctgtggtgagacatgttcagaaattgaaagtaaatgtttagaaacttaaaaaataatgacagtcatttaagctttgttcaatccaatgacttaaaaaaaacacactgagagcttctagtttccatgtttcttaaatgcattttttttagtaattcatttttattgtatctacggcagttatcaatctgctgcagattaggggagaggcagttttgccatggagagtttaaaagcgctgattctgagcacagtgtcatctggatagaaactcctgaggtactgctgtaattttccacaaaaacacttgtggggatgtaagaaagaggaaaacccatactactgctaataattggaaccagtgatcaaaggatgggtaaaagcacaagctgagcttccaaaaacagcagtgtgaatggattttttttaaaaaaactagaagatgcatttttcttgctccttgagaaaaaaggcttatagccactagcaacatgaacatcagcattctattgagatcactggcttgcgaggtggtgatatagtttagatctgtgtccccacccaaatctcatgttgaattgtaatccgcagtgttggaggagtggcctggggagaggtgatgggatcatggaggtggatttctcacgaatgggttagcgccatccccttggtgatgttcttgtgaccatgaatgagttcccacaagatctggttgtttaaaagtgcacagcacctcccctccactcttgctcctgctctagccattaagacgtgctggcttccacttcaccttccatcatgattgtaagttgcctgaggcctccccagaagcagaagctgctctgcttcctgtacagcttgcagaaccatgagccaattaaacctcttttctttataaatcatccaatctcaggtacttctttatagcaatgcaagaacagactaatacagatggatgcatgcatggacggatggacggatgaattgatggatgggtggaaggatgggtagatggatggataggtggatggatggatggattggatagatggatggataaatggatggatggatggatgggtgggtgggtgggtggatgggtgggtggatgggtgggtggatggatggatggatggatgggtggatgggtggatgggtggatgggtggatggatggatggatggataaatggatggatggatggatggatggatgggtgggtgggtggatcgatggattgatggatggatacatgagaggatgggtgagtggatggatggatgaattgatggatggacggatggatgaactgatggatggatggatggatggatggatggatggatggatgggtggatggatggatgggtgggtgggtggattgatggatggatagatggatggatggataaatggatggatggatgaatggatggatggatggatggatggatgaactgatggatggatggatggatggatggatggataaatggatggatggatggatggatggatggatggatggataaatggatggatggatgggtgggtgggtggatggatgggtgggtgggtgggtggatggatggatggatgaatggatggatggatggatggatgaactgatggatggatggatggatggatagatggatggatgaattgatagatgggtagtgatatggtttggatctgtgtcctcattcaaatctcaagttgaattggaatccccagtgctggaggtggacccttgtagggggagattgggtcacgggggtggatgtctcaggaatagtttagtgccatcccctgggtgctgtgcttgcaatagtgaatgagttctcgtggcatctggttgttgaaaagtgtgtagcatctccccagcccaccccaactgcacctctgtctctccttctcttgctagggccatgtaagacacctgctttccttcactttccactatgattatgcatttcctcatgcctccctagaagcagaagctgctctgcttcccgtacagcctgcagatccatgagccaattaaacttcttttctttataaattacccagtctcagtgtagcaattcctcaaagacctagaaccagaaacaccatttgacccagcaatcccattactaggtatatatccaaataaatagaaatcattctattataaagatacaggcacacatatgttcattgcagcactattcacaatagcaaggatgtggaatcaactcaaatgcccaagaatgatagactggattaaaaaaaatggtacatatacaccgtggaatactatgcagccataaaaaggaacgagatcatgtcctttgcagggacatggatggagctagaagccattattcttggcaaactaatgcaggaacagaaaaccaaacactgtacactctcactcataagtgggtgcttaacaatgagaacacatggatacagggaggggaacaacacacactggggcgtgttgtgggtgggggtcagggagggggagagcatcaggaaaaatagctaatgcctgctcagtagtgaagtacaaatcaaaaccacaatgagataccacctcacatcagttagaagggcgatcattaaaaaatcaggaaacaacagatgctggagaggatgtggagaaacaggaatgcttttacactgttggtgagagtggaagttagttcaaccattgtggaagacactgtggcgattcctcaaggatctagaaccagaaataccatttgacccagcaatcccatgactgggtatatacccaaaggattataaatcatcctactataaagacacatgcacatgtgtgtttactgcagcactgttcacaatattaaagacttggaaccaacgcaaatgcccgtcattgatagactgaataaagaaaatgtggcacatagacaccatggactactatgcagacattaaaaaggatgagttcatgtgctttgcagggacacggatgaatctggaaaccatcattctcagcaaactaacacaagaacagaaaactaaacaccacatgttctcactcttaagtgggagttgagcaatgagaacacagggacacagggaggggaacatcacacactggggcctgttggggggtggggggcaaggggagagatagctttaaaagaaatacctaatgtagataacgagttgatgggtgcagcaaaccaccatggcacgtctatacctatataacaaacctgcatgttctgcacatgtaccccagaacttaaagtacaataataaaaagaatagctaactcatgctgggctttaatacttaagtgatgggttgataggtgcagcaaaccaccacggcacatgtttatctatgtacaatcctgcatatgtacccggaacttaaaatttttaaaaattacccagtctcaggtatttcttcagagcagtgtgagaacggagtaatacaggcaaccaacgggctttgctcattcttgcaatcagcatctttttttttttgcatccattcaggagctacctcgcaccaagagaaacactggtaggaagggtaaggggaacagggtatggctggcatcactaggggaagatgagccgatacatcaagccctgcagcaggggaaggcagaatgctcactgggtgctagaacttgaacttcacccctgacattcagaaaaatctctttggacaaagagcagagcaggaatgaagcccacaattaagattgcgatcaattatcttttttttttttttttgaggcagagtcttgctctgttgcccaggctggagcgcagtggtgcgatcttggctcactgcaacctccacccgccaggttcaagcgattcagcctcccaagtagctgggattacagacgcgcaccaccacgcctggctaatttttgtatttgtagtagagacaaggtttcgatgatcagtcatctttttgacgcactgctggattctgtttgctagtatgtggttgagcatttgtgcgtctatcttcatctgggatattggcctgtagttttctatttttgtcgtgtccttgtcagattttggtatcaagatgatacaggttttgtagaataagttagggaggaatccctccgcctcaattttttagaatcgtttcagtcagattggaaccagctcttctttgtacatctggtcgaattcagctgtgaatttgtctggtcttggggcttttttttttttttttgattgataggtttttgtaaattactgattcaatttcataacttgtcatgaaatgagtctgttctggatctgatttcttcctgattcaatcttgggaggcatgagggaatcagcccaggtgtccatcaattatgtgttggatgaagaaaatgtagttgctgcatatataccgtagaatagtatagagccataaaaaagaatgaaatcatgtttttagcagcaacacagatgcagctggaggccattatcctaagtgaattaacacagaaacggaaaattaaataccacttgttctcaattatacataggagctaaacattgaataatcaggcataaaaatgggaagctggcacacctgcgcattccaagagcaggggagggagaggggtgtaaaggctaaaactctacctatgaggtattttgttcaccgtttgagtgacaggttcaactgaagcgtgaaccgcagcactacacaatgtatcttacaacaaagctgcacgtgtacctcatgaaattttttttaaaagaaaacaaacaaggccggggggtgggtggctcacgcctgtaatcccagcactttgggaggccgaggcgggtggatcacgaggggtcaggagatcgagaccatcctggctaacatggtgaaaccctgtctctactaaaactacaaaaaattagccaggcgtggtggcgggcgcctgtagtcccagctactcaggaggctgaggcaggagaatggcatgaacctgggaggcggagcttgcagtgagccgagattgtgccactgcactccagcctgggcgacagagcaagactccctctcaaaaaaaaaaaaaagtaataaaaataaaaaaaataaaataaaaaacaaggaaaaacaaaagagtatgaggcttcaagcccactggaccaagacaccagggtgatctgcgcataggacacaggaaatcgtacttgctaggagctcagtggctgcgttcacctggaacctaacccatgtaggagctgcgtccctttcccagggcaccatgagagggaccagggaaccgaacacaggaggatctccggaagacttgagataggttttttcattccacctggagtaccttcaacgataccttcattctatttagataatttagagaaatgaaagttagagtgtttgggagtatttaacgcactcctaggagctacaaaatgagtgtctgccacgtagctcatggaataagatggagtataccagttatccatgtggcaagaacagaaaagaagcaggaagtacagcttcagccaacgagggcgctcccagttactggtcatgatataaagccaaaatggtggcctcctacactcagagcctgtgaaaaaggtgatgtctgtatcttgatggtaaagatacagagtattaaaaaggaggaattacaattgttaaaacaactgttcgacaattgttcgacaattgttttaacaattgttcaacaattgttaaaacgttcacatttatcagccaaacaagcaaaaaccaagtagaaatggccctagtcacacaagacagcaatgattgaagtctaaaacgttaatggaacaaggaggatcatcgcctatgaaggcatggtttggatctgtgtaaccaaccttgtaacccaacagggctaacttgaaaatcataaaccaaatgctgaattgagatgaagctataatgtgccattttcacagcattttcttcagaataacacaatatccaagtatatttttcaagaattcctaggtaggcagggagaaatgaacaaaatcaacattgtgggggaaggaggaaaggatgggtggaaagagggaaggggaggggaggggagggaagcaagaatgaatggaaggagggaagaaagaaagggagggagggagaaaggagggaagaaagggaaggaggaaaggatgggtggaaacggggaaggaaggaagaaggagaaacaaggtcccagaaaatactgtcaataatatatttaatgaggcaggaaatgcaaacttacaaataggaaacactgtactgtatgaaaaaagctttaaaatgataggtttctgtttcttagtatcctgataatatgttacatttgtaagtaaaatgtgaaaatctcgaggaaataattttctcagagatactaattatcccaattcaatcaaggaaattaggtctaatcagaccaatagctataagaaaaatagagaagaataatgaaagaatggcatgaagaaagggtagatgagtgcagagggtattttagaaaattcttctagactttcaaagaacagataagtgccctgatactgactggttggacaaaaagagtctgaggtggtttgttttgtgaaatttatgctgttctgatagaaattctgaaaaaagcatagcagaagaaatttgctaggagggcaggaattgcttgatgagtaacatttatatatacagaagaaaaaaatcataaaaatgtaaacttaaagaagtcttccactgagacatacaaaagcaaatgtatttaatactaagaaaaaaatttccagaaatgctgtccattctgaaatattattaaagagctcctagaataaatgtgataagtgtgtccataaccactacctgaaaatcagatcttagtcaaccttgtaacccaactgggctaatttgaaaatcatcatggccaggtgtggtggctcaccctgtcactgtagcattttgagaggccgaggtgggaggattgcttgaggccagttcaagagcagcctgggcaacatagcaagaccctacctctacaaaaggaagtcataaaaaattatctgagtgtggtggtgcatgtctgcaatcccagctacgtgggaggctgaggtggcaggactgcttgagcataggaggttgaggctgcagtgagctatgattatgcctctgcacctctgcactccagcttagaaaacagagcaagaccctgtctcaaaataatataaaataaaaacccatcatttagaccaggaggcagcgcttgtggagaaggcgttcagctcagagcagcaacagctttcaagcatctaccaacagccaacacagcccctgaatccgtctgcacctgccccgtccctacgcatcctaataaattcacgagtgtcttggtaagccagaacctccgggatccaggcagccagaggacagttcttcccgcacttgtgggtagcaacagccgtcctgctacccaaaaagcccagttcttggagccaagagctgatgcgaccacagcctgcaaagtcttgagcagggacgaagctcatgatggcttctggcctctcttcattcaggagggaaggaacccaggtgcccgaactgccggaatttgccaagaaggagggcagattggttgtcaccccctgcgtctctcatttctatatatttatcaatttaaaaataaaggtgaaataccagtatctcttagtcgttatgcaggtatggagcgcctctctggagacctgaaatcctattttctttgtatgaggcagctatccatctgcccctaagacctactgtgaaagacgctgcagcgagattattctgtgtgtgtgtgtatatgtgtgtgtgtgtgtgtgagagagagagagagagggagagagagagaaaataagcaagagagaggaagaaaaaagaacaaaacacagagaaagttatggagaaagagagggtgagaatgggagagaaagagagagacagagggaggaaagagacagagagaaagattgtgacacagaaatagaagcacagaaagagagcttgaaagagacagagagtgtgccagagagacacagagagacagatacaggctcacacctgtaatcccaatagtttgggaggccgaggcgggtggatcgcctgatgtcaggagttcgagaccagcctggccaacatggtgaaaccccgtctctactaaaaatataaaaactagctgagcgtggtggcgggcacctgtaatcccagctactcgggaggctgaggcaggagaatcgcttgaatccgggaggcggaggttgtagtgagccgagatcactccattgcaccccagactgaatgagaagaacaacactctgtgtcaaaaaaaaaaaaaaagagagacagaaggagagagacacagaaactgagagacagagagaataagcgagagacagagagagagaaagaggagagacacagagaaagtgacagagagggacagagaggaatagaatgagagagacagaggttgtgacacagagagggagagaaagagagagagacatacagagagagaaagagagagatggggagagagctgcctggcatggtgggataaataagtgggtgacgcctttgttttcattgtgtttactacgatggccctcctctccctcttgagcacttgagatacatcactacgagagaactcaagttaaaacaatgctcctcggatacacagctgtcctcagaaaccaccttcaggataaactctgtaaatattgttgtcagaatggtaaagtgttcagataattaaagttgtcctctgactcccaggtctagtctagaaaagaagattaaaatgaaagcaccattgacccacccgcgaggcaaagagcagatgccccaaagagcttgtgtaagtaaagaggaaagaaaggctttcgaagacaaggcactacccaagggcgagaagtcaatcttgatgttgccgtggaaacgcggacttgtgaagagctttcaagaacaattctgtctccaaggaggtaaatcgtcctcctgggaatgcgttgaaaccattatccacccacaggactgggctaaaagtaaacttcagggtagcttggatgagcagcataggttgctaatgagcgtcgatttaatggtctgagttgtttatacatcaaaaagaagttaccaagggtctacctgtctgctgtttagatacactggaaaccagttaaaacttaattcctaagaagctgtttcccactgtgttcaaatttaaatgcttcaagagtaatgcttctgggcacaaaatggaaaaagtggggaaaatccaacggcatcaaaatccccacgccaccacccatgctgcaagcactgtaagctgtgatagtatctgtctgctaaaggtgctaaagagaaagcttgaggaactgagacctggcagggacccctcttaggggcaaaccaggaaactctctccacccccgaccaagcatggaaatcaagagaaatcttgagttccttccaggaaggaaactccaggcacttcgctggctgggagaagttaatgagcaacttgatgaagaagaaagtcacagtagcttaaaataacaaccaaggaaattagagtcagggatgttcgcttccctagagcaactaataaagaaaatgtggcacgtagacaccatggaatactatgcagccataaaaaaggatgagttcatgtcctttgcagggacatggatgaagctggaaaccatcattctcaggaaactatcacaggaacagaaaaccaaacactgcatgttttcactcataagggggagttgaacaatgagaacacatggacacagggaggggaacatcacacacaggggtctttcggggactgggggactaggggagggagagcattaggacaaatacctaatgtagatgatggatggcagcaaactaccatggcacgtgtatacctagtaacaaacctgcatattctgcacatgtaccccagaagttaaagtataattaaaaaaaataaaagaaactcacacctctaccctatggaatcctctggcatgaagacctcagacgtgggagagctagggactgaactctgatccctgttccttgttttaaatttcttcctgagggtcctggaggaggtcctgcccatgggccagatccaatgtgcttttactgctgaccgcaagtcttagacaaagctccacttccttaaccaattgcaagtccaaaagtctttgaatccaccttgttcctgtaagcaaccccaccctcgggcccagcttcaagatatatatttttttttttttgagatggagtttcgctcttgttgcccaggctggagtgcagtggcatgatcttggctcgctgcaacctctgcctcccaggttcaagcgattctcttgcctcagcctcccaagtagctggaattacaggcacttgccaccacacctgggtaattttttgtatttttagtcaagacggggtttcaccatgttggccaggctggtcttgaactactagtagacctcaggtgatctgcctgcctcagcctacaaatgtgctgggattacaggcatgagccaccgtacctggcccaagatatccctttttaggccaaaccaacgtatagcttccatgtattgatttatgattttttttttacttattatttttgagatgtagtctcgctctgtcgcccaggctggagtgcagtggtgccatctcggctcactgcaacctccgcctcccaggttcaagcgattctcctgcctcagcctcccaaatagctgggactacaggcaagcgccaccatgcccagctaatttttgtatttttagtagagacagggtttcaccatgttggccaggatggtctcgatctcatgacctcgtgatctgcccacctcggcctcccaaagtgctagaattacaggcatgagccacgacgcccagccgtgatttataattgttgatgaaaagagtcaaactctgtaaaatatttgaagagatttattctgagcgaaatatgagtgaccacggcccgtgacacagccctcaggagatcccgagaacatgtaccccaggtggtcggggtgcagcttgattttatatattttaggaaggcatgagacatcaatcaaatacatttcagaaatacattggtttggttcagaaaggtgggacaactcaacctgggggctgccaggctataggtaagtttaaatattttctggttgacaactggttgagtttatctgaagacctggaatcaacagaaaggaaatgtccaggtggagataaaggattgtgggaaccaagttttattttgcacaggaagctctcagatagcagacttcagagagaacaggttgtaaaatgtttcttatcagacctaaaagggggcctggctctcagttgattatgtcccagatctgggaaggaacaaaggaacaaagggagggacggaaggaaggagggaaggagggaaggaagagagggagggaaggagggaaggaagggagggagggaaggaagggagggaaggagggaatgaaggagggaatgagggagggaaggagggaatgagggagggaaggagggaggcagggagggaaggagggagggagggaaaggagggagggagggaaagaagggagagagggaaaggaatggagggaaggaaggaagggaaagaagggagggaaggaaggaaggggagaagggaggaaggaaggggagaagggaggaaggaaggggagaaggaaggaaggaaggaagggaggtaaaggaggtaagggagggagggaggaaaggctattctctatagaatgtggatttttcccacaagagacttctcagggcaatttcaaggtatggcaaggaaatatattttggggttaaatacattgtttttccttgtctcattatgttatgccagagtcacattggaaagtaagttacgatatatagggttaaataaaacccatctaatgagaactcatggtttgtaaagaatgactccctagaccctttagataggaatttgggcaagataaaaaaatcagaacttcgtcctcatgattttgcctggagcagcttctgtcctgaaatttacccgacttgaaacactatggctcggaagtcattgaaaagattgggtcttaggccaggtgcggtggctcacgcctgcaatctcagcaccttgggatgccaaagcgagggaatcacctgaggtcgggagttaagagaccagcctgaccaacatggagaaatgctgtctctactaaaagtacaaaactagccaggcgtggtggcgcatgcctgtaatcccagccactcagcaggctgaggcaggagaattgcctgaacccgggaggtggaggttgcggtgagctgagatcacgccatagcactccagcctgggcagcaagagtgaaactccgtttcaataaaaaaaaaaaaaacgttaggtcttaagcgtgagctgcctgagtctcctggcttggtgctgtccaaataaacactatcctttctcttgctgcaaagcctcattgtggaggtttgacctaagtgcaccaggcaagtggacaccagtccagtttggcaacaaaacaggcatcagtaacgtggggtacagggtgagaaaggcctacatcagcagctttttatgagatgaaaagatttcctatcaggagaacataaacagacttagactaaggtgttggacttctgttcgtctgaggatcctgtttcttgctgcctggtgagaaggtagtgaggtcatttgggtatacatagcagcattaacagcttgaacctagcgaatatagatgcccatctgtctgcagaagttgcctccctctgccctcaaatgagctgcttaaggagccatccatcttagctagctctgctgcgtaacaaaacgccccaaacgtagtagtttaaaaaacaacacccctttatgatctcacagttctgtaagtcagaagattgggtttagattaacaggatgtctccatttagagtctcacaaggctggaattaaggtgtcagacaaagctgagatgacatctgtagcttaggatgctcttccaggcatgctgaattgggaggcaaaattcagcttcttgtggttgtgagattgagtcacattttctctcttttctttgagacagagtctcactctgttgcctaggctggagtgcagtttcgcgatctcagctcactgcaacctccgcctcccaagatcaagtgattctcttgcctcagcctccccagtagctgggattacaggtgcctgccaccacacccagctaatttttgtctttttagtagagacgggttttctccttgttggaaagagtggtctcaaactcctgatctcaggtgatccaccggccttggcctccaaaagtgctgggataacaggcgtgagccaccgcgcccggccaagtctcattttcattttggctgtcagacaatggtggctctctgcttgctgtgacaccctcagcaacttgtcatatgggagtctgcttcttcaaaaccagcaaaaagggccggctgcggtggctcacgcctgtaattccagcactgtgataggctgaggtggggaagatcacctgagctcaggagttcgagaccagcctggccaaaagggtgaaaccctgtctctacgaaaaatacaaaaattagccaggcatggtagtgggcgcctgtaatcccagctacttgggaggctggggcaggagaatcgcttgaacctgggaggtggaggttgcagtgagccgagattgcaccactgcactccagcctgggtgatagagcaagactctgcctcaaaaacaacaacaataataacaacaaaaaccaggaaaaggatctctgagaccatctcaagtttatttgaagaagaagaattactcattcatctcaccctctttgaggcaggtccagcacagatgatctctcctttgattaaacccacgtatgcctagtgttccattattggaatgctaagcatgtggagttatttatatcctactgctcaaggtcatcgccaagatctgatggcaaaaattcaaaaacttgcaacttcaggcataaatggattaactcaaagttttgaatcaaagaagatgagtgaggcaagcctccattagtttagaggttaattttgccacggttgagaatgtgccccagtccaggaaaaacagacgccagtcaccataggacctgtgctccgtgctttttcttttctttttgagacggagtctccctctgtcgcccaggctggagtgcaatggcgccatctcggctcactgcacccttcgcctcccgggttcaagtgattctcctgcctcagcttcctgagtagctgggattacaagtgcacgtcaccacgcccggctaatttttgtatttttactagagatgggctttcaccacgtttgtcaggctggtctcaaactcctgacctcaggtgatccacccgcctcggcttcccaaagtgctgggattacaggcgtgagccaccgcgcctggctttttttttttttgagacagagtcttgctgtgtggcccaggctagagtgcagtggcgcagtctcagctcactgcagcctccacctcccgggctcagatgattcttctgcctcactgtcccaagtagctgggattacaggcatgcaacgccacgccctgctattttttttatttttcagtacagacggggttttgccatgttggcaggctggtcttgaactcctgacctcaggtgatccacctgcctcggcctcccaaagtgctgggattacaggcgtgagccactgcgtgcggccctgtgctttttccaaggatggttttgagggctttggtatagaaagggaaaaaagcaggcaggagggaaagaggaaagaaaaaaaaaagaaggagagtagataaaagaggcaaatgattacattcttgtgagtctttgattggcactctctgaatacacattttacatggcaaagtgcgggtagaggaacagtcaatcacgcgttcatttcatgcacagtaaatccacttttgcataagacaaagtcaacatacagaagaggaagatgtcaaacatgcatttgtctcagggtgggcggagagatcatttctagtcttatctttgtcccacacttgtgaagacaagttgttaatttacattgtcagggagaaattcaacagaactctgttttaggggaaagattttggagcccacaagaaatttccttatgagcaatttgtgagagcatctccgctggggagggatgtgcagaaatgaagaggctacaacaagtgtctgaagatagtcctgaaggccaggtgcagtggctcatgcctgtaataccagagctttgggaggctgaggcaggaggattgcttgagcctagcagttcgagaccagcctgggcaacatggtgaaacctcgtgtctaccaaaaatacagaaaaaaaaaaaaaaaaaagcagctgggtgtggtgatggtggtgcatgcctgtagtcccagctacttgggaggctgaggtgggaggatcacttgagctgagaaggtcaaggctgtgccactgcactccagcctgggcaacacagtgacaacccaatctcaaaaaaaaaaaaagatacccttccagccagatgaatgcacatgaccactggcatgagaggaggtcggcattaagatacaggtcctaaggaccttgttgataaaacaggttgtggtaaagaagctggccaaaccccatgcaaaccaagatggcgacgagactgacctctggtcttcctcactgttcattatacgctaactctaatgcattcgctgctaaaagacacttccatcagcctcatggcagtttacagatgtcatggcaatgtcaggaagttaccctatagggtctaaaaaggggaggaaccctcagttcccagaaccgcccaccggcttcccagaaaactcacgaataatctttcccttgtttcgcacagaatcaagaaataaccataaaaatcaccaactggcagccctcggtgctgctctgccaatggagtggccactctttattcctttactttcttaatcaacttgctttcactttactctatggactcaccccaaattctttcttgcacaagatccaagaaccctctcttggggtcaggatcaagacccctttccagtaaacaacgcctcatgttttctataataatttcattactttgtgtgcccactgacaatggtaatggtctaacccggggttggtcaactgcagccctctagcaaaatccagccccttgcctatttttgtgcaccttgtaaaccaaaaaactatttccacatcttttaaacagtgggttaaaaaaaatcaaaagaaggataacacagttgactgttggacaacatacatctgaactgagcagattcacccatttggactttcacccgagatgactcctcctccctcttcgtcccccctcctccccccctcccttctcctcctcccctccccctcctctccctactcctgcagagtgcagtgactcacgcctataatcccagcagtttgggaggccgaggcgggtagatcacgaggtcaggagttgaagaccagcctggccaatatggtgaaaccccgtctctactaaaaatacaaaaattagccaggtgtggtggcgtgtgcctgtaatcccagttacttgggaggctgaggcagaagaagtgcttgaacccaggagacggaggttgcagtgagccgagatcgtgccactgcactccagcctcggtgacagagtgagactccatctcaaaaaaaaaaaaaaaaaagagaacgaagacctttatgatgatctacttccatttagtaagtagtaaaatattttctcttctcttccttagcattttttttctagctgactttataatatacataacatacaaactatgtactaatcgactctatgttatgaataaagcttccggtcaagagtacactaccagtatttaacttttgggggagtcagaacctatacatagattttcaactgcatagaggtcagtacccctaacccccgtgttgttcaagggtcagctgtatatacatattttttcgaggtggagtttccctcttgttgcccaggctggagtgcgatggcgtgatctcagctcactgcaatctccacctcccgaattcaagcgattctcctgcctcagcgtcatgagtagctgggattacaggcacgcaccaccattcccagctaattttttgtatttttagtagagacgggtttcaccatgttggtcaggctggtcttgaactcccgacctcaggtgatccacccgcctcggcctcccaaagtgctgggatgacagttgtgagccactgtgcccggccgggtcaactgtattttgtgccacgtgataaatatatacatttacatctcagtgtccctcaagattcttagaacacagaacttgcccattcatttacatattgcgctgttgtggtagcgatcatatgacccaaagagcttcacatatttccctatgtggacttttcttttcttttttttttttttgagatgggatcttgctctgtcacccaggctggactgcagtggggtgatctcagctcactgcaacctccacctcccaggttcaagagattctcctccctaatcctcctgagtagctgggattacagacacgcaccactacacctggctaactttttgtatttttagtggaggcggggtttcgccatgttggccaggttggtctccaactcctgacctcaagtgatctgcccaccttggcttcccaaagtgctgggattgcaggcatgagccaccgtgcctggccctgcaagtctgttttgattggatttgtttgactttaaacccattcggaagagttttcctagaattgctacactcggagacatgaggcaatgcttactctgacttttgacgttttcaagtgtacagttgaaagtcaacaacatgggtgaatgtggcaacccctccttacacaatcagagacagtcactgccaagccgcttcgtggattgtcattagcttccaatgagaaacaggtgcacaatcaaggtctaaagataaagagggttaagtgcaagacagcagccatgacgtgtcggtccacgtacagcctgtctgcctgagggctcagtgatccaaaaagacactgcaggtcagcacttcagagtgttcgcaacatccggggttacttaaccctgtggcttgacaagcagcagagatttgcaaacaatgatagcttctgtgccacttcagccgaacactggctctgaaaacagcctcagtatctgacaagctctcattcctgggcttgtggcgtggctgtccattgagagagcctaagtatatcttcatgccgaggggatgggagcatttatataaataaatgtttgcactgattacagcactgctgccaaagagcttgatgggcgatgatgatccgatttcgccatggcagcttatgtttacagaacccggctccattgcagacaggacatcgaatgtgtaacgcagtatttaaatgtccactgacatttacagctcgtgtcagcccaagagggaagaggcgttggtgtcccagtctgccaaggagggctcctgctatggaatgaatggtgtcaccccgaatctcatgtgtggaaaccctaatgccaaaggggatggtatttggagacggagcctttgggagatgatgatgtttacatcaggtcgtgaaggtgggatccttatgttgggattcgtgcccttgtaagaagagacaccagggcacacatgctccctcgtgctccacccccctctctctctgccctgcgagaccatctgtaaaccaagaagaggaacctctcaagtacccaaccatggtgccacctggatgtaaacatttctgcctccagtactatagagaaataaatttctgttatttatgccaccccatctatggtccagttaacccttaaacaacacaggtttgaattgcacgggtccacttctacgggcattttcttctacctctgccaccccggagccagcaagaccaatccctcctgtccgctctcatcttaggctactcaaggtgaagacgataaggatgaagaccttcatgacgatccactcccacttcagaaatagtaaatatattttctcttctctatgatttttaaaaatttagtttggtgtccttttttgtttttaattatctttccataagtgattggggtactggtggtatttggttacctaagttctttagtggtgatctgtgagattttggtacacccatcacccgaacagtatatactgcaccctatttgtagtgtttatccctcacccccctcccactcttcccccccaagaccccaaattccattttatcattcttatgcctttgtgtcctcatagcttagctcccacgtaacactgagaacatacgatgttggtttttcatccctgagttacttcacttagaataaaagttccttatcaggcgtggtggctcaagcctgtaatctccacactttgggacgccaaggcgggtaggtcacctaaggtcaggagttcaagaccagcctgaccaacgtggtgaaaccctgtctctactaaaaatacaaaaattagctgggcgtggtggcgtgcacctttagtgccagctactcgggaggctgaggcaggagaatcacttgaacgtgggaggcgtaggctgtactgagcagagatcacaccactgaactccagcctgactccagggcaacagagtgaaactccatctcaaaaaaaaaaaaaaaagaatgaaagttccttatgatttttgattctcaaagttccttataaggcgattctcctgcctcagcctcctgagtagctgggattacaggcgtgcgccaccacgcccggctaaaaaaaaacaaacagcattttcttttctctagcatactttaataatacagtatacaatacataaaacatacaaaatatatgttaatcgactttatggtattgataaggcttctgctcaacaataggatattcataagttttgggtgagtcaaaagttatctttggattttcaactgtgccagggacgtgtgtgacgcccctaactcccacattgttcaagggtcaactctagttttttgttgttgttgttgttgtttttgagatggaatcttgctctgtcgcccaggctggagtgcaatggtgtgatcttggctccctgcaatctccgcctcccaggttcaagcgattctcctgcctcagcctcctgagtatctgggattacaggcgccacacccagctaatttttgtatcaaggtcaactgtattttcttgcaacagccagagctgactaagacagtcttgaagctcaaagaggtacaagaacctacccaaagttatccaaccaacaagcacctggaaggcagaataaagactcaggtagccaagcgccatagccacaccatggtagagctattctgccttgtagagatgcattgaatctgtcacagggtgaatacatctccaaatgcatttgaaaactcctacgggatgctacagaaacacgtgagggaagagtgggtgtggacatactctccatctgttacactcagagtactccaactacaggagtgagatgcctcaagacaggccaaggcagaaacaagcatcactatgaaccccagaatagatatgttttttggccagacacggtggtacacgcctgtaatcccagcactttaagaggcccaggtgagaagactgctggaggccaggagtttaagaccagcctgagcaacagaggaagatcccatctctacaaaatatttaaaatatatacatagctgggaatgatgatgcgtacctacagccccagctactttagacactgtggtgggaagatcactcgagcccgggaggctgaagctgtcgtgagccacagtcacaccactgcactccagcctgggtgacagagtgagatccggtctcgaaaaaatcatcattatcgtcacagtaatgagaggaattttaggtgataggtggttactaatttcaaaaataggggcttccggtttctcctctaatgatacaggggttaagaagaaatgacttaagcagatagtaaaaattagctgggtgtggtggtgcacacctgtcatcccagctacttgggaggctgagatgtgaggatcacctgagcctcggaagttgaagttgcagtgagccatgatcacaccactgcactccagcctgggtaacagatggagaccctgtctggaaaaaaaaaaaaaaaaagattttgcacaaagttttacgatgactctgctttgtaattaaaagtaatttctgctttgttggtgatttctcacacatttatctggtagaccagatacctgcatgtgatagggtaagaaggacccatttccctccaaggagaacagcattgcaagggggttgaggacgcatgcatgtggaatccaaacattgaatgcactgagacggcgctgcatgaagcctgtctgtgagtttatgatgaagctgcacagagctccgtaggcggctctcactcctctctctcagcctttggcttcagtttaattgcatacacacccttcagagctgctcggggcccccacttcttcagccttctggcatttttctaagaaacactaaacctctttccaacgttgcccttggattttgtgtgcacgtcttccagcccttgagctgcttgacctgtgcttgcaagggttccataacactggataggacagaagctccgcccagccccaggtgaaagctctgtgctcttcagggaccatgtcctattcacactgtctccctcacatctaatacagtcatgatactcggcaatatagtactccacccaacaggcaactcagagtctgccagtgatacaggagttaagaagaaatcacttaggcagacagtaagggtatgggagtcctcggcaaggcttttttcttttctttttttttttttttttgagatggagtcccgctctgtcgcccaggctggagtgtagtggcgtgatgttcgctcattgcaacctccgcctcccgggttcaagcaattcgcctgcctcagcctcctaagtagctggcattataggtacgcaccaccaagcccggctaatttttgttttgttttttttttttttagtagagacgcggtttcactggtcaggctcgtctcgaacccctgacctaatgatccacccgcctcagcctccaaaagtgctgggatgacaggtgtgagccactgcgcccggcagcttttctctttaacgaaaagcagccccaagtcattttctaacaatgaacagcctgtcaagtcgagctgcagacatacacaagccagctgggagcttgtacgggtgaatgtcgggaggacctagggactagacacgttcaagatggcggctccatcttcccgggaggaactaacgactagacacgttcaagatggcggctccatcttccgggcaggaactagggactagacacgttcaagatggcggctccatcttcccggcaggaactagggactagacacgttcaagatggcggttccatcttcccggcaggaactagggactagacacattcaaaacggcggctccatcttcccagcaggaactagagactagacacgttcaagacagtggctccatcttccctcctctttgtcagccacatgtaaagtaagaaaaacaggaccgagagccccgaccaactacaaagcccatttgcataaccgattagggtgggcaaccagcctttcctgtgggctatgtaaatgtcatgcttgatggaaccaatctctcggagagccccgaccaactacaaagcccatttgcataaacgattagggtgggcaaccagcctttcctgtgggctatgtaaatgccatgcttgatggaaccaatctctgagctctatgtaaatgagacaccgcctcctcaaactggactataaaatccatcacatttggtgccagctggtcctttccgctcggagacccctttctctatagagaaaaccatttctctttctcttctcctgattaaacttccactcctaaactcctcgtgtgtgtctttgtcctaaattttcctgatgcccaatgacgaaccccagggtatataccccagacaacgtagccacttcactaacatgtagagagcttgcgcattttaattcctatcctcacaataggcaaagagcagaacatactgaaaatcagcaactctgcgatccatcagaaaatagagatcacaagacgaaatgctgcctgaagactggacagacaggtggcaagtggaattgtgcttgtctaggagttcctgctggagccagcacctgatggacacatttgcagggtaattattaaacagctgcaggctgacagtggacaagcctaagtaagttaaaaactcctggccaggcatggtggctcgcacctgtaatcccagcactttgggaggccaaggcgggcagatcacctgaggtcaggagttcgagaccagcctggccaacatagtgaaaccccgtctctactaaaaatacaaaaattagccgggcgtggtggcaggcacctgtaatcccagctactcgggaggctgaggcaggagaattgcttgaccctgggaggtggaggttgtagtgagcccagatcgcaccactgcactccagcctgagtgacagagcgagactctgtctcaaaaaacaacaacaacagaaaaacttctgggggcccatcttagaggggaccttgtactttcacaaattttacctccgggagctccaccaggttcccagggtgaagatcaaagaaatatccagttgtgtgttattgggggaaagtaaccactttgcaatattcctagggagacagtagcattttgaagtatgcccaaagcaatccgtgtcctctctgccctcaaaggaaattactttagcgcagtcaaagtgaactgggggaagggaaatcttctatttcagtttttcttttttttttttttctttccaggcagattttcactcttgttgcccaagctggagtataatggcgcaatctcggctcactgaaacctccacctccagggttcaagcgattctcctgcctcagcctcctgagtagctgggatgacaggtgcctgccaccatgcccggctaatttttcgtatttttagtagagatggggtttcgccatgttggccaggctggtctcgcactcctgacctcaggtgatccacccgcctcagcctcccaaggtgctgggattacaggcgtgagccaccgtgcccgaccagatttcagtttctattagctttcaacaacacttttcgtgcatgagtgacgctggcggccatgtactcagccattccatcaaggttccaagcagcaaagctgcaaaatggatctgactccttcagtgaagaagagtctccctgaatgcattggaaacactcatgagatgctactgaagcaagtaagggaagcctgactgtggacatgctctctgtctcttaggctcacagtactccaaccacagaaacgagatgcctcaagggaggcagaggcagaaagaagccatcactataaacccaagaataaagccagcagagctacagtgatggcctgtgtgctgcaggtgagcatcaccttgttgtaaggccacaggctttcctggccaccctgctcagttggcctcgtggtgggagtcactagactcaagatagacccagccagaccatctggttagagctacccaaggaaaagccattgtcagcacaaagtcactggagtcttagaatgcacagctgtgatgggctgattccttctcccaaatccctatgttaaagccctaacgcccaggacctcagaatgtcaccatatttggagatagtctttaaagaggtgattaaggtaaaacaaagtcaccagggaggcccctaatccgagaagactgggatgcttataagaagaggagatgaggccgggtgtggtggctcacgcctgtaatcccagtactttgggaggctgaggtgggtggatcacgaggtcaggtgatcgagaccatcctggctaacacggtgaaactccatctctactaaaaatagaaaaaattagctaggcatggtggcacgcacctgtagttccagctacttgggaggctgaggcaggaaaatcgcttgaacctgggaggtggagcttgcagtgagccgagatcccgccactgcactccagcctgggcgacagagcgagactccgtctcaaaaaaaaaaagaggaggagatgaggacacagacacacagagtgacgaccctgcgaggacacagtgagaagatggcatctacaagcctacaagagaggcctcaggaggaaccagccctgcctacaccttgatcttggacttacagcctccaggattgtgggagaataaacgtctgttgtttacaagccacccagtctatggtattctgtgatagcagcctgaaatggactaagacacctcataagaaaaggagatgaggacacagacacacacattgggacaaccctgtgaggacacagggagaagatggcgtctccaagcccaggagagaggcctcaggaggaaccagccctgcccatacctggatctcagacttccagcctccaggactgtgagagaatcaatgtctgttgtttataagtcacccagtctatggtattctgtgatagcagcctgagatggactaagacacctcataagaggagatgaggacacagacacacacagaggggcgaccctatgaggacacagggagaagacggtgtctacaagcccagcagagaggcctcaggaagaaccagccctgcccacactttgatctcacagacttccagccttcagaactgtgggaaaataaaagtctgctgtttaagcggcccagcctgtagtattttgtcatggcagccctaggtgactaatacaacaggtgtttcatcctgttcctttcctcaggtggtgttgcagagtaccccagcatctttaggtggtggtagaagagactccagcatctgccataacccccggaagagtgttctgtatgttacactgtggggaggttttcctcaaagcattagagtgatctgaacaatgggaatctttgcacagaggaggatgagttctactcggggatggtacctactaagagagacatgttgtcttctcttcaattgccctttaatgaagaaataaaaattatttaattattcggtgaagaaataaaaagagtattgcattctttcaacagagattctgcacttgtactcccaggtatttatgaaacctcatgttgatgcctggtgcataggccaggcagtggggctctacctaagtaatgcctggtggttggccatgggtagctggagcaccaatagcatactctaatagtccatgacatcggtctactcaagggccatggctcaaatagaaggctttgtttggaggaattcaaaagaggttctactgagaaggaacctatgaatcagtgctgctacaatacttttggattgtgcggttcaaacgccatattggttttcttccagctctccagctccagcagcactgaggcagatctgagtttctcgaagctgggcccatcaccaacaagacagtgatggtgaaagcaatgatagaagaggtcgaatttagagtaaggatcaggatggacaggtgggtacatctatgcaaccctaacctttctgaaactactaggcatagatattttcctgaagactagtctcagcctgcatggatggtccctcatggctactgtctcatttgaaaagtgaacctatgaaaagaggaaaacactatgacatccaccactgtttggtcacaccaattcttgacattaactctctcgaaggacattagtatgaccttcaaatcctagcccgcaggaaagcttcactttagttgtttgtttcctgggtgtcccttcctacaacccacgaagcaaatgccacacaccctccttacatgcataaaacagtgctgataatggatgaaacacacaagtatcagctcatgcctgcactttcagagaaaacactcttgcttagaccatgggtatgtcaagctgccaaggatacaaaaggtaaaacaatccaagggcaacagatggttcatgacaaagaactaagagggcagcactgcgattccaaaaatttggatatggacgtcaatgagagtgaatgagagagaagcagagagacggcgggggggggggggggggggggagggagggagagagagagagagagagagacagagagaaaggaaggaggaggaggagaaaggaaggaggaggaggtgaaagaggaggaggagaagcaggaggagggggaagaggaggtgaaggagaagggaaaaaaaaagtagaaggggccaggtgcggtgtctcatgcctgtaatcctagcactttgggaggctgaggcaggtggatcacgaggtcaggagactgagatcatcctggccaacatggtgaaaccccatctctactaaaaatacaaaaattagctgggcagggtggtgcatgcctgtaatcccagctactcaggaggctgaggcagaagaatcgcttgaaccggggaggcagaggttgcagtgagctgagatcgcgccacggcactccagcctggcaacagagtgagactccgtgaaagaaaaaaaaaaagaaaagaaaagggaagggaagggaggggaggggagggaaggggaggggaagagaggggaagggaaggaaagggagaaggagaaggaggaggagagaaagggaaggagaagaaacgaaagaagatgaaggagaagaaggagaaggaggaggagaagtaggaggagatgaggggcaggagaaggaggggaaggaagaagtaggaggggaagaggagggaagagaagaggaaagaagacagggagagagaataagagaatgagaaagagagaatgaaggagagaataaatgaaagaagagagagatgagaaaacctacttgtgaaagaggcctcagtagaagaaaagagaatgagcaaagagcctggtccaggccactctaaatgtctctcaaatgttaaagactgatgaaggaggagcaggaagacttatcacacgtccaaggagacaatgttgagcgacccgcaaacttagcagaagggagaacaggctctggagatgtccagtaatggggtagagcccagactcccacacttggtagttgtacccttcaacctggagaggcctcagttttctcatcagtgaaatgggcccaagaatagtatctatctcaagaaaccattttctctgctccttcatgagaagaaactcctcttccattccagttttatcatgagattacaggagttcagccccatcttcaacctgcacctttacttctgctattttcaccatagcagaagtgacttcctccactgaagtcttgaaccccctcaatgtcattcatgaatattggaattcactttttcccgatttctgttaatgtggatatcttaacttcctgccatgaatcaccaaggttctaaatggcattcagaatgaggaatcctttcaggaaggttttttggttttttttttttttttttttttttttttgagacggagttttgctcttgttgcccaggctggagtgccatagcgcgatcttggctcactgcaacctccacctcccaggttcaagcgattctcctgcctcagcctgccgagtagctgggattacaggtgcccgccaccatgcccagctaatttttttgtagttttagtagagatggggtttcaccatgttggtcagactggtctcaaactcctgacctcaggtgatccacctgccttggcctctcaaagtgctgggattacaggcgtgagccaccacgcccggccctgactcgaattttgaaaaaagttctactctgggtaaaaccctatcaaacagcatcgcttgatacagaaaaatctttcatgacagaaagggtcaactgatgtgacaaacatcactgttgtctattttaagaaattgccaaagcaccctctaccctcagcaaccaccaccctgatcagtccacagccagcaacattgaggcaagactctccaccagcaataaggttttgactcgcgaaatgttcagataattgttagtattgtttaccaataaagtatgcttaaattaaaaaatatatatcgttggaatggtgtatggatacaccacaaaacagtcttagcataatgctcaccattcactaagtgctcaataacgacattattaactttgccaattcctctgtttattgctcagaaggatgatgcatttgtcaggagaagcaaagaaaaagattcttgaaaagatcatggtgacattgctgaaaggtcggggagaaaacacaaacagactgaatgggtcctgtgaagctcaagggtgtgggtagctcgtaagaaaggctatgagcagagattacgctggagaaatatgccaggaagggaagggaagggatggtcagaagctagttagtgtgtgcagtgatattttcacaatgcttttgaaatcagcgtgttaattggctaaatgagccactggctggatgacagtatgtgagcattagctgctctatgtcagctgggattctaggaaaacagattgtgccaaacatttggatatccagaggaggcacaacaactgtgcattagaaataggacttatgtttcccacccaactacctctctctggggcctgacctgccgtctaaaaacagtccaccccaatgcagcctccagtcactctgccaggtattgacccagagtcttgattctatgcaacaaataagatctttgcattttaacccattgagttttagtaagaatcttcgacaagaagatttcttccagagaaccaaagcaggagttgcaagattgcaaagggcacactgaggtcttaaatatccatctgatttggccaggaatgtgatcgatcaaaaactcaggaattttcctggtcatcgttgtctaacgtgtattcagaatgtactctgcggtgagtaccattttacgaaaagactcactggccaagactatgggcgtgaggtaactaacaatcagggggcttggtttcattttgttgaaaaaaagttcaacaaagacatccacaaagaaataggtgatgggcctttgcctactcatttctttgctcgttttgctatttacccattcccctgttttcttgccctgtaaaatggacacaatactcaagcttcccattggtgtcaatgtttacattcacgatgggtaaaaaaaggtatttcatgatttgaaaagtgtgatgcattttattcttttttataactttaacaccttttaattttttgaacgtttttgagtcatcataacacatagcttaaaacacatacacacgtggtgcagctgtacaaacatgtatttttttaaacttgtatgttagattcgggaggagtccatgtgcaggtttgttgcacaggcaaattacgtgacatgggagtttggtgtacagattattttgtcacccacataatcagcacaatatctgatatgcagtagagacagagtgccactctgccgcccaggcttgagtgcaatggtgcgatcccggctcactgcaacctccgcctcatgggttcaagtgattcttgtgcctcagcctcccgagtagctgggattacagatgcctgctactctgcctggctaatttttgtatttttagtagagacagggtttcaccatcttggccaggctggtctcgaactcctgacctcgtgatctgcccacctcggcctcccaaagtgctgggattacaggtgtgagccactgcgcccggccaataggcagctttttaatcctccctctcctcccacccttcaccctcaagcagaccccaatgtctgttgttcctttctttgaggccacctttactcaatgttgaacttccaattataagtgagaacatgcgatatttgcttttatgttcttgtattagtttgctaaggacaatgatctccagctccatccatgttcctgcaaaaaataataagatcttgttcttttttacagctgcacagtattccacgacgtacatgtaccacattttctttacccagtctaccactgatgggtatctagcttaattcccatgtctttgctattgcaaataatgctgcaatgaacattcatgtgcaaaagtgtctttacggtagaataattggtatttctttaggtatgtacccaggaatggttgctgggttgaatggtaattctgttgttttaactcaaaagtatgctttttttttttgagacacagtcttactctgtcacccaggctggagtgcaatggcatgatcttggctcactgcaacctccacctcctaggttcaagtgattctccctgccttagcctcccaagtagctggaattctaggcacctgccaccatgcctggctaatattggtatttttagtagagacggagtttcaccatgttcgctagactggtctcgaactcctgacctcaggtgattcgcgtgccctggctgggattacaggcgtgagtcaccggacccagccgcctattttctttctttaagagataaggtcttggtctctcagccaggctggagtgcagtgatttgagcacatctcactgcagcctcaaactcctgggctcaagtgatcctcccgcctcaacctccccagtagctgggaccacatgtacacaccaccatgcccagctatttttgaaaaatttttgtagaaatggcatcttgctgtgttgcccaagctgctctcaaagtcctgagctcaaaataatcctccatcttctgaaagcattgcgattatgggtgtgaagtttctttgactttaatattttaacttaatttataacagtatttttgaataagggactctatccatcactatttaattctataattgtatatatttgcaggcccctccaagcctttgtgaaccctgaatatctgagatggtgtcagttaatttagaaagttaagtccgggcgtggtggctcacgcctgtaatcccagcactttgggaggtcgaggcgggcggattgtctgaggtcaggagctcaagacaagtctggccaacatggtgaaactccgtctctactaaaaatgcaaaaaaaactttagctggacatggtggcgggcacctgtaatcccagctattgaggaggctgaggcaggggaatcgctggaaccagggaggtggaggttgcagtgagccgagatcgtaccactgcactccagcctggacaacagagtaggactccatctcaaaaaaaaaaaaaaagaaaaatttattttgccacagttgaggacgcacccatgacacagcctcaggtggtcctgacgacatgttcccaaggtggtcagggcacacgctggttttatacattttaggcagacatgagacatcaatcaatatatgttgagaggtacactggttccatccagaaacacggggacgactcgaagtggggagggggcttccaggtcataggtggataagagacaaatggttgcattcattatttttttggggtgtgtgtgtgtgtgtgtttagacagagtattgctctggcaccaggctggagtgcagtggcgcgacctcggctcactgcaacctcagcctcccaggttcaagccattctcctgcctcagcctcccgagtagccgggactacaggtgcccgccaccatgcccagctagtttttaaaatatttttagtagagatggggcttcatcatataggccaggatggtcttgatctctttacctcgtgttctgcctgccctggcctcccaaagtgctgggattacaggcgtgagccaccgcacctggccaggagtaactttgaataaaacgggaggcaagtttgctctgagaagttcccagcttgacttttcccttgagcttagtgatttggggaccccaagattttcctttcaaaccttcttaaattattgttactgtcactatgcttccatctttcatgaacttaggcgacatccatggaggtatcatttgcagattcaaagtagctctttcaacttctgagtcatggagcacagtgtctttaatatcatgcttttgtttttgtttttgtttttttgttgtcgttgagacagagtcttgctctggtaccagggagtgcagtggcgtgatctcggctcactgcaacctccgcctctcaatttcaagccattctcctgcctcagcctcccaagtagctgggactacaggcgcccgccaccatgcccagctagtttttttgtacttttagtagagacggggtttcaccctgttgcccaggatggtctcgatctactgacctcatgatccgcctgcctcaccctcccagaatgctgggattacaggcgtgagccaccacgccagactgcagtagtgagtcttagtcactcactgtgaagttccctgcagtttctttttcaaaagcattttgctgtggataacgcattctcattacgtcagacatctgcagtaacatttatctagcaacaaggttaactgccttcacatcaacaaaaacaggttgtgttgccagcaaagaagaatgccagttctcttttccatcccataatacttgtcatcagtactggggtatcctgttcaccttctcccatgctgtgagattaatttagagaacatattcacggtattttgttttttgttttgttttttttttttgagacggagttttgctgttgttgcccaggctggagtgcaaaggcatgatcttggctcactgcaacctctgcctcccaggttcaagtgagcctccagaggaagcacagtactgcccacatcgttatttcagacttctggtctccaggactggaaaagaataaacttgttgtggctttaagacttccaagtgtgtggtcgtttattacagcagccctaagatagatagatagatatagatagatagatttattttactttaagttgcaagatacatatgcagaacatgcaggtttgttacataggtatacatgtgccatgctggtttcctgcacccatcaacccgtcatctaggttttaagccctgcttgcattagaaatggggtttcgccatgttggccaggctggtcttgaactcctgacatcatgatccacccacctcggcctcccaaagtgctgggattacaggcgtgagccaccgcggctgacctttattgctctttctatgtaaaaccagaaaagccaacaaagctatttcccgtaatgacatgcccaagtcctaacccccaaacaccgtgaatgtgaactgatttgcgaatagggtcttggtagatgcattctcgttaaggatatcaggacaggatcatcccaggttcaggactgatggacacttcaaactttcattctatattctttcacacgagtagtgttgtttggctctgagaagcactttcatttttatttccaggcaatttcatatcgttctcttcaattcagtgagtgcaaaagaagcaagacagggagtgatataaaattactgctaatagaaaattcacttttaatcttgcttaaaacaagtttttttgttttttgtttttttgtaaaatgaaggagagagctgaacttcaaggatgcgaatttatttccacacaggggagaaacactgattggagaaaatttacagttgctgtttagacacttgagcctcaggatcgagaaaaggtgcacctcttagatgggccttaaattggagatgatgatatctaaccacctggagacgggaaagtaggtgtcactcaatgctgaacggtgctactcatctgtgagattgtataatgaagttttggagactgagcctgtaccttcatctgttctttaaccaatgcacacttaacaagcacgtcatgtttagctgctcagcagagcttccttcttcagaaacagagacggggtgcggaggcattttacaacccagggggctccagcttcatagactgtcttgtgaggatctatgctgttactctgaggatcagcgttggttttccaagtccttcatgaacataacaagtcaatgataagacgacaagttccaccgctgtgcctcagctgagacaaaaaaaaaaaaaaagctggaatcatttagaaataacaatcccaggccaggcatggtggctcatgcctgtaatcccaacattttgggaggccgaggccagcagatcacccgaggtcaggagttcaagaccagcctggtcaacatggtgaaaccccgtctctactaaaaatgcaaaaattagccaggcatggtggtgcgcgcctgtaatcccagctacttgggaggctgaggcaggagaatcgcttgaacctgggagatgaaggttgcggcgagccgagacagtgccattgcactccagcctgtgcaacagagcgagactctgtttcaaaaaaataaaataaaaatagaaaaaggaagtcacactcacaaccattctacaagcaggagacccagaatattttgctttagaatctacaggctctgctttaaaattcctcctctcccaaactcaggttaaaatgtaagcctcagtgctggatgggaggtcgaatgggaggggtttgagcaacggacgatggattcttcctgaagagatcaatgtcctttcttgaagcatgagtgagtttttactctatgagttctccacaggctggttgttaaatagagcctggcgtctcccgtctgtcttccctcctgtctcttcgtgtggtctctgtacacataccagctccccttcccgttccaccatgagtggaagcctcctgaggtcctcagcagagacagatgctggccctgtgcttcttgtacagcctgcagaatcataacccaaataaacctctttcctctataaattatccagcctccagtgttcctttctagtgacacaaaaccgacgaagacaccccagctctctctaccatggggtatttatgtcactagtgatgaccgtcctgacaaggggccagccctgcagttcccacgagaccacctacttcccactccccatatgagctcagaaacttccggaagctggtacactcatggaatgataatccatataatttccgcaacgagatgtgatgtagtatcatgcttacttaagtgatcctgaatatactctttttgtgtgtttttctttaattttccataacttattgggttacaggcagtatctggttatataagtaagttctttttatttttttctgagacagagtctcgctctgtcagccaggctggagcgcagtggcatgatctcggctcactgcaacctccacctcccacgctcaagcaattctcctacctcagcctcccaagcagctgggattacaggtgtgtgccaccaggcctggctaattccttttgtatttttagtatagacagggtttcaccatgttggccaggctggtcttgaactcctgacttaaggtaatccgctcgcctcagcctcccaaactgttgggattacaggtgtgagccaccacatccgatcacgagtaagttctttagtggtgatttgtgagattttggtgcacccattacccaagcagtacacattccacactatttgtagtcttttatccctcgctgccccctcccaagctctccccaagtccccaaagtccattgtatcattctcatgcctttgtgtcctcatagcttagcttccacgtatcagtgacaacagacgatgtttggttttccattcctgagttacttcacttagagtaatagtctccaaaggacatgaacttgtccttttttatggctgcatagtattccatggtgtctatgtgccacattttctttatacattctatcattgatgggcatttgggttggttccaagtctttgctatgtgaatagtgccacaataaacatacgtgtgcatgtgtctttatagtagaatgatttataatcctttgggtatatactcagtcatgtgattactgggtcaaatggtatttctggttctagatccttgaggaatccccacactgtcttccacaatggttgaactaatttacactcccaccaacagtgtaaaaccattcctatttctccacatcctctctagcatctgttgtttcctgacttttaataaagctggaaaccattcttctcagcaaactaacacaagaacagaaaaccaaacaccacatgttctcactcataagtgggagctgaacaataagaacacatggacacggggaggggaacatcacacactggggcctgtcgaggggtggggggctaggggagtgatagtattaggacaagtatctaatgtagatgacgggttgaggggtgcagcaaaccaccatggcacatgtatacctatgtaacaaaaactgcacgtcctgcacatgtaccccagaacttaaagtataataataaaaaaagtaatagtctccagtctcatccaggtcactgcaaatgctgttaattcattcttttttgtggctgtgtagtattccatggtgtgtgtgtgcgtctgtctgtgtgtgtgtgtgtatatatatatatgatgtccatcaatatatacaatgtccaatgttctggagtccacagtcagtaatgtccatcaaggtacatacacacgttcacggacattattgcctgtggacatcagaatcttgacccacacctaggaaatgactgcattcaacgtcaggcgactggactccccgccagacacccgccattgagaacaaataataaaagccacagtcttcaccttgcaaattgatatttggacttttgtcattcaaggatgctttcaatggttcgtgtctactaggcttgggagaaagataggctcgtgagaggagacatcagacaactggcaaatcagaggtagatgaagcaacaaaaggaaggaaaaagagtgtggaaataccagccaacgagctggtgttcccaatgggacctatgaaaagatgttttgcaggtggagagaagaaagaggagacgcaagcatttgagctgagcaacgaatattgcctgcattgcggaggaccaagaatggacaatatcaccaggttagcctcctgggaaatgctgcacgggtggcaggttcagcaaatcaaggcagggggagaaaatggctgccgctctctctccagtttgcgatcctgggaagttagggtgcacgggtttactgggctttgatttcctcagaggactggttttacttacacacagcaggaagccataatacaaggggctcttttcccaccacaggcatcaagctgaatcaccgcacacgcttgcattccagactcatgttctccagagcttacaggttgggatgggaccactgtaacccatgaccccaaactagggagcttacaaaagcagccatttaacctctcccagtcctggagactacatctgtgaaatcgaggtgcctacagggacatgctccctgctctagggaagaattcttcctgcctctcccagctcctgggggctccaggcatccctgggcttatggccgcatcactccagtctctgcctccgtctccacgtggccttctcctctgtgtctgtgtctcctcttccgtctcttacaaggacacctgtcattagatttaggatccactgcaatccaggatgatctcatctccagatccttttttacatctgcaaagaccttatttccaaataaaaaatcacatgtacagattcaaggtgaacttgtcttttttttttttttggtgggggtgggggtaaaatagaggcaccattcaatccactacaggggttgagaagaaataaaatattacaaaatgctccctgataagaaataaaatattacaaaatgcttcctgaatgtgatttagaagtttttttgtttgttttgttttgtttttaaatggagtttcactcttactgcccaggctggagcgcaatggcgtgatgtcagctcaccgcaacctctacctcctgggttcaagtaactctcctgccttagcctcccaagtatctgggactacagatgcccgctaccactcccggctaattttttgtatttttagtagacatggggtttcaccatgttggccaggctggtttcaaacccctgacctcaggtgatctgtccgcctcggcctcccaatgtgctgggattacaggcgtgagccacctcgcccggccgatttagaagcttttgtttgtgggcgtgaaggttcagtaagagcttcctctagtccttgtcaagatcaaaattaaaggcattataaacagagatgcctatctgtcggccacatatccagaaaataaatgctgagatgagaattctggtttctgaataggagtctgatatctgcatttggtgttgccaaagcaagccctgacttctctcttctctcattgagacagagcacacaccctcactccttgtgtctctgagtcacatgtatcgggccatactcacctgatacctcacggattgtcccggggctagttctatttctagctcctgggcaggacggtgaccatgagttcgacggtgcccagcaagcccatctggccagcacttatctgcctttgggtacagcctgccctttctcccaagtgtctgagcataaaaatagcccaccatgtcaaccccgcagatgacaagcatgtgagtggctagtttctgcctgagaactctcccgaggtctccctgaacactcacggatgcctgggctggcccaagatgcagcagtaggtcactgacagactctcttccatttattcacagtttccatgattcccacgctcatagcatcgacataacaaaagcaaagttaagctacagactctgctcccgccccaacctctctaatagctgctaacagagccaatggattgtttttttcaacttgcaacttaaacacaactttgccttctccctgagtcttttaattcaaacattcagtcattctccatcaggtacgcacaggagatacaaaatcaatatgataacggtcttcaggttgtgggtgacagagcgggagcatggccatcttgaacaaacaccaccattctaggctccccttgattaaaaaccgcctaaatccagcccgaaaacatcagcctcatgactcatgtcagcataaccagaaacattccaaccctaagataaacccgtctccgaccaaaaacataccaaccctgagacagcctcccctctgaccagagatattcaaccctgcaataaactctccctcacatacaaacattctgaacctatgataagcacccccttccaaaacccttaaatgtgcttagtctataagagagaagagctctgacctaactcagccagaagcccctctcaggtttctctaaaataaacctgtgtttaactgtcaagtgacatttcatgcttctttcctctttaattcttacagtgagtgtgtagagcacgcttgacataagtgactccaccttagaaaaagattccatgttacatttcattcaaaaggcatcatgcctacaggagccagatgttcacctgatcaataaagaccacatccaaacagttaaggacacaaccaaacaccctcttccattgtcaatcctcaccagaggactctgtggtcatgaaagaacagggcttcagcagctccaaatggctaccttaacagatgccatcttgctgtcacttgtaatcattacgcagcatccaccgcaaaaggctctgccccactgatatcaaaggctcttccttgcaagatggcgaccactgatggccctccagggccaggccaggagacttttttttgtccacatcaatatccctgtgctcctttgttaagctttttcctaccccttttctcttgatgataaatgttacgttgtttgatgtagaatgtttaatctataacatgcatatattggtgaagtgtattagtatgtataggttgcaatactgactgacttgggtcacagcaggagcctgtgcgcctgtagctctgactaaatgctgccggcacacaggctccagtactccaagggctcaagccatttcagtactaaatgggaagtcctaaggagaattgcctccttgaaaactccgtgcatcttggggcttctgtaaactgaaatagcatcaataaaaggctgaacttgtgaaaagacacaaccatacatgggcctggttttctatctctgaccttgcaccactcatgagagcgggctccagcaagccagccagcaggaaagacagaaaaggtgaaaactgattcaacaaaggaaggatacttgagctagattaaacattttattacattttctctgaatttttagcccatcatcacgggtcattagagaaatgcaaatcaaaaccacaatgaaataccaacttatgccagttagaatggcgatcactaaaaaagtcaggaaacgagagatgctggagaggatgtggagaaataggaacgcttttacactgttattgagagtgtaaattagttcaaccattgtggaagacagtgtggcgattcctcaagaatccagaaccagaaatactatacgaccacagactggataaagaaaatgtggtacacagacacaccatggaatactatgcagccataaaaaggatgggttcatgtcctttgcagggacatggatgaagctggaaaccatcattctcagcaaactaacacaagaacagaaaagcaaacaccacatgttctcactcataagtgagagttgaacaatgagaacacatggacacagggtggggaacatcacacaccagggtctgtcagggggtcaggggctagtggaggtatagcattaggagaaatacctaatgtagatgatgggttgatgggtgcagcaacccaccatggcacatgtatacctatgtaacaaacctgcacgttctgcacatgtaccccagaacttaaagtatataaaaagaagcatatatatatatatatatatatatatatatatatatatatatactgtatttatttaataaaatttcaaattaatgatgtaaaaattttgaattttataaatttgaatatgacttggcctgtgacagagacagaggccacaagacccctgcagtctaccctataccctgctgccacagtgacctccctaacatacacacctgatcacaagtcccctcagagcagcttccatggcttcccctgcctcttgaaatactgcccaacttgtgttctgtctgggtactcttgttctgaggcacccttgatccttgattttataagtccacttggctgagccatggtgcccacatatgtgattaaatgttcttctgggtgtttctttgaggttgctttaaatgagataaatatcgaaatcaggagactttgagtaaaggaattggtgggtaggcctggtctaatcagttgaaggtcataatagaacaaaagactgggctgggtgcagtggctcacacctataatcccagcactttgggcagctgaggcaggtggatcatctgaggtcaggagtttgagatcagcctggccaacatggtgaaaccttgtctctaccaaaaaaataaaaataaattagctgggcgtggtggtgtgtgcctataatcacaactactcgggaggatgaggcagaagaattgctcaaacctgggagatagaagttgcattgagccaagatcgcaccgagatcgcatcgtaccccagcctgggcaacaagagtgaaactctgtctcaaaaaaaaaaaaaaaaaaatctaaatcagtacactttgagtaaagcaatttgtccttcctatggtgggtgggcctggtccaatcagttgaaggtctgactagaacagaagactaatgttacctgagccagaagggattctgccaacagatggactttggactccaactacatcatcagctcctccctgggtctccagctggctggtctaccccatacatcttgagacttgccagcctccatcaccatatgagcaaaattccttaaaataaatgtgctttctatcagtacacacatcatattggttctatttctctgcagtatcttgactcagacacacagttccctggttctgcggcacccacctcccgtggtatccttgttctgtaagaaattagtaagttttaggtgaacgccaaggaggaatttcatccaggaaagctctttgcctccttgtagacccgatgaatttctactcactctctaaaatttaactcaaatacatgtattttctgataatgtttctaactctatgagcaaaaccaggcatctcactccatggcatctggacacgcagctacagaggtgcatctgacatgcccgagttgttatgtaccatcttcccctgactgtgaatctcttaggaatgacatccataaaaatgcaatgtgccatccaggatttaatacgtgctcaaatattgccgagtgtggtttttctcgtctctgttttcacagtccaggctggcaccatttctctgcaaatcagtgtatttttcacccacctgattttcctgcccccagcctcccctcccacaaggcgccttgaagctgctgtcaagctcaatctcctgaagatagcccaaatccttcccgcagcctttggaaagcctcccatagcttcttctcacagcaaatctaagtaaactacaaggtgactcccatgttcccctccccatttttcctgtttgtagggatgttgtatgagtctggttttttttttgttgttgttgtttaatactttaagtcctggggtacatgtgcagaacatgcaggttacataggtatccatgtgccatggtggtttgctgcacctatcaacccgtcatctacattaggtatttctcctaatgctatccctcccccagtcccctactccccgacaggccccagtgtgtgatgttcccctccctgtgtccatgtgttctcattgttcaactcccacttatgagtgagaacatgaggtgtttggttttctgtccttgtgatagtttgctgagaatgatggtttccagcttcatccatgtccctgcaaaggacatgaactcattcttttttatggctgcatagtattccatggtgtctctgtgccatattgtctttacacaatctatggtcaaatagtatttgatatagataaggatggataaataaagtataagtatgttttcatgctgtagataaagacatatctgagaatgggcaatttagaaaagaaaggtttaactggacttacagttccacgtggctggggaagcctcacaatcatggtggaaagcaaaaggtgaaaggcacgtctcacattgtgacagacaagagaagagagcatgtgcaggaaactcccctttataataaccatcagatctcataaaacttactcactatcatgagaacagcagggcaaagacctgcccccatgattcggttacctcccactgggtccctcccacaacaggtgggaatacaagatgagatttggggccgggcgcggtggctcacgcctgtaatcccagcactttgggaggccaacacaggtggatcacctgagctcaggagttcaagaccagcttggccaatttggcaaaagcccgtctctagtaaaaacacaaaaattagccgtgcatggtggcgggcacctgtaatcccagctaattaaaaggctgaggcaggagaatcgctggaacccaggaggtggaggctgtagtgagccgagatcatgccacggcactccagcctgagtgagcgagactctgtctctaaataaataaataagatttgagtggggacagagccaaaccatatgagatgtaatgagctgtacattttcccaggcatttaatgcctttttgtttttcagttgccataatgcggtgtccagcaacatacggtacatggatgtcatacatgggacatgtaaaatggtagcatccatctgcagttagactgtaggctccctgttggaaccaccctgctcgtggacaatcactgctgtcttggtaatgaacaccccctacatatctgcttcactatagagctgctgcctccagaaaccccatacacccatgcgttctggcagtgccaacggctggaaattgctgcccactcctcagccaaacccacagtcaggcagggaacccaagccaggccaattgggtccctgccttgggatagtccaacgtaacataagaaaaagacagtgtgttagtattataggcaaagcaaggcaaaagagaatagagaagcagctcgggtaagagactaaagcttctctgcaggaagaggagaccccagagataggaagctggcatcctggaaaggttggactctgtgttctggcctctgagaagaaagtgatcactaagcttggtgcagattaaacatagaagcaaaggctcttctggcttaagtggatcaagctggggtcagtcgcttgcagccagggttttgatgcatttgttcgttctctctggatggggtcagtccctcgcagccagaattctgaggcgtgcgctcctattgtctggatgtgtggggttttatttactttctttcaaaagaaaagtagatagaaaggctcaaaaggatgggggcaggggaaagacctcccagcaataagaaagaggtccaggcagcaaccatacaggaagaagcaaaaatgaaactggaaagtcagaatgaaaaactgcccaatgtctgctatattattttcttgttttgcaaagaaaggaggtccaaagcccttgtgggtctcttatttttattttttttttttttattttgttttgttgagagagcctgttgcccaggctggagtgcagtggcacgatctcggctcacggcaacctccgcctcccaggttcaaggtattctccctcctcagcctcccacgtaactgggatttcaggcacccacgaccacactcagctaatttttgtatttttagtagagacgacatttcaccacgttggccaagctggtctcaaactcctgacctcaggtgctccgcttgcctcagcctcccaaagtgctgggattacaagcatgagccaccgcgcccggctgtgggtctctttttgcacagctgggacagggaagaagaaaacttgtgttcctctgccactgtttcctgcagaaatgggtgaatacagtaaatggtacggacgttcctcaaaaaaattaaaaatagaactactcgatgatccagcaagcatgcttctaggtatttatccaaaagataaatcggtctatgagagacatttgcacccccatgtttatggcagcagtattcacaatcaccaagatatggaatgaacccaagcgttcaatagatgaatggatgaagaaaatgcggtacagctgggtgcggtggctcaggcctggcgacagactgacactccgtctcaaacaaaaaaaaaagaaaatgcggtacacgcacacaatgggatactatgcagccttcaaaagaaggtagttgggccaggcgcggtgcctggaatcccagcaccttgggagactgaggcgggtggatcacttgcagttagttaggagtttgagaccagcccagccaacatggtgaaaccccgtgtccactaagaagtacaaaaattagccgggcatggtggcaggcacctgtaatctcagctacttgggaggctgaggcaagagaatcacttgaacttgggaggcggaggttgcagtgagctgagatcacgccactgcactccagactgggcgacagagtgacactcagtctcaaagaaagaaataaagaaaatgctgtaaatacacacaatgggatactttacagccttaaacggaaggtaattgggctgagcaaggtggctcacgcctgtaattccagcactttgggaggccgaggcgggcggatcacgaggtcagatcgagaccatcctggctaacagggtgaaaccccgtttccactaaaaatacaaaaaaattagccaggcgtggtggcaggcgcctgcagtcccagctactcaggaggctgaagcaggagaatggcgtgaacctgggaggtggagcttgcagtaagccgagatcgcgccactgcactccagcctgggcgacagagactctgtctcaagaaaaaaaataaaaaaagaacgtaattggccaggtgcagtggcccacgcctggtatcccagcactttgggaggctgaggcaggcagatcacttgcagttagttaggagtttgagaccagcctggccaacatggggaaacaccgtctctactaagaagtacaaaaattagccgggcatggtggcgggtgcctgtagtctcagctactccagaggctgaggcaggagaatcatttgaacttgggaggcggaggttgcagtgagccgagatcacgccactgcactgcagcctgggtgacagagcaagactccatctcaaaaaaagaaagaaaatgcagtacatacagacaatggaataccacgcagccttaaaaagaagggaattctgtcatttgccacaacatggatgaacctgggggatgttaacgtgaaatacaccagacacagagagacaaataccgcatgatgtcactgacatgtagaatctaaaatagtcaaattcacagaagcagacagtagaatgatggttttcagaagatgaggagagagggacgtagggagatgctgttccacaagtataaggttttggtatataacatgaatcagttctgcagtctgggtacaactgtgcacaccacagcagttgtgcctagagttaacaagaccgtattatacatgtaacactttgtcaagagggtggctctcatggtaagcgtttgaccgtgataaaataaaaatttcaacacgtatgtttattgcaatactatttataacagcaaagacttggaaccaacccaaatgtccatcaatgataagactggataaagaaaatgtggtatgtagacactatggaatactatgcagccataaaaaaggatgagttcatctcctctgcagggacatggatgaagctggaaactgttattctcagcaaactaacagaggaacagaaaaccaaacactgcctgttttcactcataagtgggagttgaacaatgagaacacatggacacagggaagggaacatcacacaccggggcctgtcagggagctgggggcaaggggagggagggcatcagggcaaatacttaatgcatgcagggcttaaaacgtagaagattggttgataggcgcagcaaaccaccatggcacacgcacacctatgtaacgaacctgcacgttctgcacatgtatcccagaacttagagtaaaattaaaaagaaagaaagtcaaagacagttttgtaaatgttcggctacatcgtaacattcaaaatgagactggccaactttccctatctgctttgatgagtccatcagaatacttgtaatatgtggactaagtctttaaataaaaacacctgcttataaatatgcctgaataacatgagctctggcacttgtcagcctcagacaggtcatgactcagtaaaggatggaacacttccttgctgacacagacttggagattgagaaagcaacacaggccacccaatgggagaaagaggacatggtacagtgaaaggccagtgtgctggacatggggagggccatgctatgcactctggtgtctggattaaccactgggaccagccctgacttcctgcatggctgaagaggaggctgatgatgcattgggagttggcatcctggctctcagtgctggaaccctggaccacctgggtgagactaccagactgagagccctccctgcccttactctgtcgcccaggctggagtgcagtggcgcaatcccaactcactgcaacctccacctcctcgattcaagcgattctccagcctcagcctcctgagtagctggaattacagatgcccaacactacacccggctaatttttgtatttttagtagagacagggttccaccataacagccaggctggtctcaaactcctgacctcaggtgatccacccgcctcggcctcccaaagtgctggggttacaggcgtgagtcaccgtgcccagcctggaacatttgttgtttcaataaacagctgtgcatttttgccccctaaaagcaccattggacaaccacaatcccaggcctgatgctggcagtcataggggatcagatgtcctcccgtattctctatccacaaaacaggaagcttagctgatgactcctggaggcacactcaaccctaaactatgatataatcctgcaggaaaataaatggtatcccaagatgttcagtatgaaaatgcatgtggctttgtgggtattttgcaaagaagcgaatgggatagtatctgttttcttcactacaatctcagggaatgactcatggaaacatcagtgatccgcaagcagattatggttaaactaaaactcctacgaggctgtctccaaaaacttgagctatctgaggtgcttcatcaacagaggtgtgaaaataccgtcctacttgccgggctgagggcctgggagcttacgggtgactcagctttgcttagtatcactgctcaccatgcgacaattctgtgaagttcttcagacatgcaggatcaacgcacagtgttacagatcatctgacacttcttcctaccaacaagtgtctgcaggcgtagctgctgggctgccttgctggaacttatcagggtggaaactctttggggtgagaataccacgtttcggcgtcttcaggggatacagcagaggtgtgttgaatgctacggtgatagctacaagcacaggcaaaggctcctacagcaaataaaacagacctacaagaccagccacagtagatgaagggctatagggaccagcatgggcattcggaccagcacgggcattgagaacagcagttcagcttaagccacaaaacttcaattctccttaaaatctacaagagtccatctgaaccaccaaagttttggccaaacccaagaccaagagtccaaaaccaggctggacgcagtggctcctgcctgtagtcccagaactttgggaagccatggcaggcaagatggcttgagctcgggagtttgagaccagcctgggacaaatggcaaaacctcatctttacaaaaaaaaatacaaatattagcagggcatggtagcacgtgcctacagtcgtagctactcgagagactgaggtgggaagattgcttgagcccggaggcagaaattgcagtgagccaagactgcactattacacttcagcctgggcgacagagccagaccctgtctcaaaaaaagaaaaagcgtccaacaccatcttcctgaagccatgtgtatgtcagtagaagaaaccttcaaccccctagagaatccaaaggggagtggggaactcaggtgctgtcctcatttaccccgaaatgaagttgtgcaggaaaaaaagaaaaaagcgtccaggaattcagaacatgcttattatcctagtgagacccaaggttccatttgctacagaagcctatgaaataattcctaggacaaagggtcactaagaagtcattcatcttttgggtaatagttgaaggagtcagaagacagtcacaccagtagtttagggaaggattatagctgattgcattttttttttttttttgagatggagtttcactcttgttgcccaggctggagtgcaatggcgcgatctcggctcacctcaatctccgcctcccgggttcaagcgattctcctgcctcagccccctgagtaggtgggactacaggcatgcaccaccacacccagctaattttgtttttttttagtagagatggggtctctccacgttggtcaggctggtctcgaactcctgacctcaggtgatcctcctgccttggcctcccaaattgctgggattacaggagccaggcctacacgtggtttttaagggccagcaaattatatgtatgcacacacctcagtttggaaggagaatgactgagtaccagtgggataccaggagagcccaggaagaaggcagcgtatcccttcacaagcccctttccatgacttttctacatgactccagcaagactatgctggggaggaggaggagacacagggcctcgcctgagtatgggtgctgacttggtgcaagaagagaagggtaggcatcgtctcctggtggccattcccaccctggaatggctccaacccaatggagcggagctctagtggttccagccactggaaacaccagacgtagcacaacaataatgaactgttgttggacggccatctactccagatgtcccatcactgggcagctgtccactggggccaagtcatcactggatggccgtccacttcggctgcaccatgttcctggcctacagcagcatggaacacgccactgctgggatgacaccagggattccctcagcttagagagcaggtgctcacagacaggggtcatggacagcaatcactacccacagcctccactccctgcccatccatcttttttgtttttgtttttgagatggaatctcgctctgtcagccaggctggagtgcagtggcgcaatctcggctcactggaacctctgtctcccgggttcacaccattctcctgcctcagcctcccgaatagctgggaccacaggcacccaccaccacgcctggctaacttttgtatttttagtagagatggggtttccccatattggccaggctggtctcgaactcctgaccttgtggtctgcccgcctcagcctcccaaagtgctgggactacaggtgtaagccactgcgctcggcctctgtccgtccatcttaagcagctgaagaactgaacggataaaacaaagccctcaaaaccacagacacgtgtgtccatgtctgaggtccacggggcaaggaggaaaaaagaaccaactcacgcatcctccaggggtgaagactgggcattaaaataaatgcccgtatggagggaaaatatccatcttgggactcatgggaaaaacaggcaaacacaaaaaacaggaaagtaatattccataaaaaagaaatgaagagcatcagttgaaatgaagatttatgtggggcgaggcagaaggacctgagaccactaatccttcactatctcaattatagcaagaaataggttggaaggaaaacacaaatatacagcctataaaagatacccacagaggagtaattcaggtggaacataaaagagatttaaaggtaaatagaaacgaaaagaaagtcagagtcaaaatattatcaggccgggcacaatggctcgcacctggaatccctgcattttgcgaagccgaggacgacggattgcttgagctcaggagtttgagactagcctgagcaacatagtgagagcctgtttctacaaaaaatacaaaaattagctatgcgttgtggcgcatgcctgtagtcccagctactcgggaggctgaggtgggacgatgtcttcagcctgggacgcaaaggttgcagtgaaccaagatggtgccactgcactcctgcctgggtgacaagagcgagaccccatctaaaaaaaaaaaaaaaaaaaaaaaaaaaaaaaaaagactatcattacttttaatggcaaaaacagcaattacttttgcaccaacctaatatattcatatcagataaaaaataataaattcagagcacaaaaatattaaacgtttaacaaaagggttaatgcggtaacataataagaagggtgccggaaacgagtaggagatataacatcacatcctagagaagcccggacaatagtagacagagggaagatcaaaatcaagaatgaggagactcagctgggtatggtggctcaccctgtaatcccagtactttgggaggttgaggtgggcagatcatctaaagtcgggagtttgagaccacccaggccaacatggtaaaaccccatctctactaaaaatacaaaatgtagccaggtgtggtggcaggtatatgtagttccagctactcgggaggctaaggcaggagaatcacttgaacccaggaggtggagtttgcagtgagccgagattgcgccattgcactccaccctgggcaacaagtgcgagactccgtctcaaaaaaaaaaaaaaaaatacaataattagccgggtctggtggtgtgcacctgtaatcccagcactttgggaggccgaggcaggcagatcaactgaagtcgggagttcgagaccaggcaggccaacatggtgaaacactgtcatactaaaaatacaaaatacagctgggtgtggtggtgggcacctgtaatcccagctactcacgaggctgaggcaggagaattgcttcaacccaggaggcagaggttgcagtgagccgtgatcgtgccactgcactccagcctgggtgacaaagcaagactctgtctcaaaaaaagaaaaaaaatgaatgtggagaatcatgtcaggggtgcagagggcaggcttgtggaagcgtgtagaatgtagaagaaaaagatgatgacatgaagtgattggagaaaagaacatgaaagagaaggaaaccagttgagaggcaacatccaatgttggtatctctgaagacaagaactgggagaaagagacacagaaacatagttgatccttcacaggtttggactgtacaggtcagttatatgtggattttcttctgcctctgccacccctgagaaagccagaccaacctccctcttcctccttctcctcctcagcctcctccatgtgaagatgatgaggatgaagacctcggggatgatccctttccatttgatgaatagtaaatgtagtttctctttctcatgattctcttggtaacgttttcttttctctagcttactttagtctaagcataaagtatgcaatacatagaacatagaaaatatgaatgagtgaatcacctgtttatgttattggcaagggttcctgtaaacagtaggctattaataattaagtttttggagaatcaaaaggtgcacatgggccaggcgtaggggctcacatctgtaatcccagcactttgggaggccaaagtgggtggatcacctgaggtcacaagttcaagaccagcctgaccaagatggtaaaaccccgtctctactgaaaatacaaaaattagccaggcatggtggcgtgcgcctgtaatgccagctactcaggaggctgaggcaggagaatcgcttgaacccaggaggcggagattgcagtgagctaagatcacaccattgcactctggcctgggcagtaacagtgaaactctgtctcgaaaaagaaaaaaaaagttacacatggatttttgactgtgtgaggggttggtgtccctaacccccatgtttttcaagggtcaattgtaaatggaaaggtttcgtgcaaagaaaaaaaaaatccctgagataaaaacccagatctgccattataagatgtatagtaagccatacgatttatttttaaatgcccatatgtccatcaacctcatcctgatgaaaccgtggagctttaaagatcaagagaaaatcctaaaagcatcaagggaggaacaaaaaggacatctgccaatggaaaagcaaatcaggtggaaagagctcttcgtcaatgtgagatttcagtaaggaataaagaaagagctacagagtcctgaatgacaaaggatctgaacaaataaccctagacccgatatgggaaaacgagatttgtctcaaacactttgggactcaggaaattaaaaaaaaaaaaaaaaaaaagaatcattgcttgtttctctaaaactgtgcccagacacacacacacactacagcaagctaagatttccaggcaaatcactaagccattcatagggaaagacaggcactgtgtgtcagatcaaggattcacctacataacggtggttatgaaatggaaaatagagaaacacatgtacatcactggggtgtggctaccatagtcaaaacagggtaactcttgagaaaaacatcctctctacaaaacgcttattttaaaaaactaattagagattgggacaaaaagaatcctcaaaacagcaatcagaatcaagtgatagcatgtggtggatggctagggttatgctactttgtcttcaaaaggcagaacctgttgttctaatttaatttctgaagttactcagttgagaaacggagttagctaacacttggtttaaagttacgaaagtttcaaagagcttctgcacagcccaggaaactatcaacagcgtgaacagacaacctacagaatgagagaaagtatctgccaactatgcatctgataaaggtttaatatccagaatttataaggaacttaaacaaatttacaaaacaaaacaaaaataaaaacaaaaaaaatcccattgaaagcacaccctttgccacgtcaggcaaaggacatgaacagacacttttcaaaagaagatacacatgcagctggccgggcgcggtggctcacacctgtcatcccagcactttgggaggccgaggcgggtggatcacaaggtcaggagatcaagaccatcctggctaacacggtgaaaccctgcctctactaagaatacaaaaaaaattagccaggcatggtggcggggttgagggcttgatatgtgggaggcatattactaaacaatttgattaccttgtttaacctttacaacattcttttgaggtagatcttactattcttcccatttcatagacgaggaaaatgaggcttagagaagttaactaaattgcacaatattccttagttagtaaatggcgaatttaaatccagtttggaaagacagatgtgctttgcttatgcataccttgatttctgaaaaagtgcatgtaactaaagtcaaaaaccaaagctacttgcgaggctgaggcaggagaatggcgtgaacccggggagcagaggttgcagtgagccgagatcgcgccaccgcactccagcctgggcgacagagtgagactctgtctcggaaaaaaaaaaaaaaaagacatacatccagccgacaagcctatgcaaaaacattcaacatcactgctcattagagacacgcaaatcaaaaccagaatgagataccatctcacaccagtcataaaggctattactaaaacatcaaaaaacaacagatgctggcaaggtggcagacaaaaaggaacacctaaacactgttggcgggagtgtaaattagttccaacattgtgtaagacagtgtggccattcctcaaagacctaaaaacagaaatatcattccactcagcaatcccatgcctgggtatatacccaaaggaacatcaatcattctgtcataaagacacatgcacgtgtatgttcgtggcagcacctttcacaatagcaaagacatgggatcaatctgaatgcccatcagtggtagacagaataaagaaaatatggtacataggccaggtgcggtggctcacgcctgtaattccagcactttgggaggccaaggcgggtggatcgcgaggtcaggagttcgagaccagtctggccaacacatggtgaaaccccgtctctactaaaaatacaaaaaaattagctgggcgtgggggcgtgcacctgtaatcccagctacttgggaggctgaggcagaggaattttcaagggtgcagtgagctgaggcagaggaattttcaagggtactgcactccagcagcctgggtgacacagcgagactccatatcaaaaaaaaagaaagaaagaaaaagaaaatatggtacatagacaccatggaatactatgcagccataaataagaacaagatcatgtcctttgcagaaacatggatggagctggaggcgattatcctcagcaaactatgtaggaacagcaaaaccaaattactacatgttctcacttataagtgagagctaaatgatgagaacatatggacacagagaggggaatagcattcattgaggcctatcagaaggtgggaggagggacaggatcaggaaaataactaatgggtactgggcttaatacctgggtgatgaaataatcatacaacaaacccccatgacacgagtttacctatgtaacaaacctgcacctgtatccctgaacttaaaaatggtttttaaaaattatggaagtttgaactataagaatcaaaatttccagaaggttggggtgatgaggcatgaagcttccctgagtgcaaaagaactcaccattgccacccacggcaaaaagaaaagtgacatagaagcaaaaaaaaagatacaaagcatagtaacatttattcaacatctcattaaacatttcgcaagagtgaaggatagactatgcaagagggttataatggggccaggcgtggtggctcacgcctgtaatcccagcactttgggaggccaaggtgggcggatcacgagggcaggagttcaagaccagcctgaccaacatggtgaaaccctgtctctactaaaaatacaaaaatgagccaggtgtggtggtgcgtgcctgtaatcccagctacttgggaggctgaggcaggagaatcgcttgaacccgggaggcggagattgcagtgagccaagatcgcgccactgcactccagcctgggcaacagagtgagactctgtttcaacaacaacaacaaaaaaatacacatcacccaccatttcttgggtatcaacatccacctctggaatgactgaagggttattaatctaggatggtaatggagccaggttatcgccaagtttggtaagaacatccttgcctttgtcactcactgctctcttggtggagttggtaccgagacacggcccgatgtgggcagatgcttagacagggaacatggcttcctcttcctggaatggcaagaacttcgaattctgccccctctctgccaacgttagatatgtcacggttgaatgactaaacaccaaatacatatccggagcgagaaatggcatgatgctttcagaggaaggatggagctggaatttggggaatgaggaaatggcttttccctctttgtgtgtttagtgatgataagagcaatcagttctgacagctcctactggctgctacctactggctggctggagcgttggctttggttagagaaaatggaacatttcaagaggagacactttccatacacattatcataaaagtttgtttgtgagatggagttttcactctgtcgccaggctggagtgcagtggtgcgatctcggctcactgcaacctccacctcccgggttcaagcgattctcctgcctcagcctcctgagtagctgggactacaggcgcccaccaccacacccaatttttgtatttttagtagagatgggatttcaccatgttggtcaggctagtctcaaactcctgacttcgtgatacacctgcctcagcctcccaaagtgccaggattacaggtgtgagctaccgcacccagctcaataaaagtttttaaaatgttatcagtaatgctataatgatcatcataacttatggtaggtacaaactatagaatccacaactgcttaccaaggtcttataaagacctaaatctgtggtttattgaggttctttgaaacccctcaattttcttcttggtattaatgattgaatttttaatggtggggcagaatctgcccaagtattagagggacaaagaaggatacagagagctggagttccatcagttcagcctggttaatgtgtcgtttctgagcacacagcaagccctaccctgtttatgtggtaaggtctcactcctatacagaacatggcatgattcaaattctaaaaagaagatgtctggataagcacttttgattgactgtctgattagaggtacttttaatggaataggcagaaaatgcaaatatctaatgaacatgctggagaggttcaccatcggcaagcatttcattttcttttcttcaaaaattaattacagagtgtggctgcgtttctgtggattcagtgtttctaattctttcttcaattagtcctttaattttcttcccaaggagacacatggatatacaacacgtaacacagtgacattttcttgtcactgaaagaaatttcaaagttcattttcaaattcaaagaaaaggaaggctggagtggattggaaaagaggctacaggctaagaacttttaagagccctagagagagtggggtgctggtgtcactgttatttcattgattttccttgtccacagccattttcaagactcatatttcagggccttagatggtttgtctcatatcactgctgtctgtagcaacaaccactctgtagaaggctcccagggaaagacccataaggtctaccttgtttttgtttgtttgtttttgaaacacagagtctcactctgttgaccaggttggaatgcagtggtgtgatcttggctcactgcaacctccgcctcccgggttcaagcaattcttctgcctcagcctcccaagtagctgggattacaggcgcccaccaccatatgccactaatttttgtatttttagtagagatggggtttcaccatgttggccagactggcctcgaaatcctgacctcgtgatccgcccaccacagcctcccaaagtgctaggattgccggcataagccaccatgcctggccaggtctgccttataagtgatatgagcataggtggaggagttgaacactggagaaggatggatcaataactccacccaaccacaggtgctcccatttctgggtgtctaatcccaacccttgagatcatgccgccattttatcaccgttctatggtatcatgccgccattttatcaccgttctatggtatcatgccgccattttatcaccgttctatggtatcatgcctccattttatcaccgttctatggtatcatgccgccattttatcaccgttctatgatatcatgccgccattttatcaccgttctatggtatcatgccaccattttatcaccgttctatggtatcatgccattttatcaccgttctatggtatcatgccgccattttatcaccgttctatgatatcatgccgccattttatcaccgttctatggtatcatgccgccattttatcaccgttctatggtatcatgccattttatcaccgttctatggtatcatgccgccattttatcaccgttctatggtatcatgccgccattttatcaccgttctatggtatcatgccgccattttatcaccgttctatggtatcatgccgccattttatcaccgttctatggtatcatgccattttatcacctttctatggtatcatgctgccattttatcaccgttctatggtatcatgccattttatcaccgttctatggtatcatgcctccattttatcactgttctatatcatgcctccattttatcactgttctatggtgtcatgccgccattttatcactgttctatggtatcatgccgccattttatcactgttctatggtaacatgcctccattttatcactgttctatggtatcatgccgccattttatcaccgttctatggtatcatgcctccattttatcaccgttctatgatatcatgccgccattttatcactgttctatggtatcatgctgccatttcatcactgttctatggtatcatgcctccattttatcactgttctatggtatcatgccgccattttatcaccgttctatggtatcatgctgccattttatcaccgttctatggtatcatgcctccattttatcaccgttctatggtatcatgcttccattttatcaccgttctatgatatcatgctgccattttatcaccgttctatggtatcatgctgccatttcatcactgttctacgaataataacacatcagcatcgaaggagatgagggaacatgcatgatggagctgtgggagaagaatccccgccacaaaaccggcccaggatcctgggcacagagatatttccacactcaacacacagggactgaggtgaaaggagacggctgggtgggatggaggagataagggaggagacccctgatccacacagcacagccatgtttggaggggaatcataatgctacgtaggatgtctaagctctcctcaagatgcgaggctgggagtccctttccagagcctcagagagcatactggtcttaggtccaggttactgccattgaatggtagtaggcacatccccacagaactgggctggcatctgtagggatctacatcagtggttttccattggaggcctttttgtttccccctcccccaggaacatatagaaatgtctggaggtatttttggttgttataactgcggtggggggtatagtgggtacatccatgtcaagtgggtggagcccagggatcctgctcaacacgctacagtccacagcatggcctcaccacagagaatcatccagctccagatggacatactgccaaggttgacaaagcctgccttagcatgacagattgtatgcatatgtgatccatttgtctgtgtgcctatcatccaactcacttcctatcatctatcacctaccatttatctatcaactatttatagaatatctatcgacctatttaccacctatcacctacttatctaccgtctatcatttatctatttaccatttacaatcaagcatctacttatctatctaccatcatttatctatttaccatttatcatctatcatctacttatctaccatcatttatctatttaccatttattatctatcaagtacatatttatctatcatttatctatctttgatcattatatagcatctgtttactctctatctactgtctatcatctacctatcatctattgaccatcgatcatttatctacctgtcatctattacctatcattgatcacaatctatcattgaccattactatctatctagctattatctatctagctattttctgtctaactaatatctatctatgtatccatcatctatctatatcacagtggttttcaactgagcaaaatttcgcctcctcagggacaactggcatatctatctatctatctatctgtctgtcatttcctcatttatgaaattggggtaataacaatgcctgcctcaaaaattgacaaatgagatctcattaaactaaagagcttctgcacagcaaaagaaactatcatcagagcaaacaggtaacctacagaatgggagaaaatttttgcaatctattcatctgacaaaggtctaatgtccagaatctacaaggaacttaaataaattctcctgcctcagcctccctggtagctgtgactacaggcagccaccaccacgcctggctgatttttgtatttttagtagaggcagggtttcaccatgttggccaggctggtctcgaactcctgaccacaaatgatccacccatctcggcctcccaaagtgctgggattacaggtgtgagccaccgtgcctggccaggttttggcctttttgatgccactttgctttgacctttacttctttctcctgtatgcctagagagttcatcctaagagcttgtcctcatatcacctcccagaatatgcaaacttacaatctctttacttcttaaaattttaccttggggctaccaagctctgaagatggaagtgagatttcctcaaaatacacagaaatgggtaaatcctcacatgctttcacaggtatgcagtctttaacctgaggtagctcagggatacctatggctcccaggatactccaccatagcaaagggtgactgcctttggtgagccttgggtggatactagagctctgtgaacaccggggcctgtcgggaggtggggggcaaggggagggagagcattaggacaaatacctaatgcatgctgggcttaaaacctagatgacgggttgataggtgtagcaaaccaccatggcacatgtatacatatgaactagttctaggaacagttcactgaacactagcgttctatgaaccccctctccctgcctgaaatgaatgctgtcttcacatgacatcctaccctctgcccaatgtctttcccgaatgggaatctcttcaccacacggccaatttatcacaaacccttctctaaacccttacaataggcaggaaactgctcatacccctacgacggctgatggcagaggataaaatattaattctaagaaaataggccgggtgtggtggcacacacctttaatcccagcactttgggaggccgaggcaggtggatcatctgaggtcaggaatttgagaccagcctggccaacctagtaaaaccccatctctactaaaaatacaaaactagccaggagtggttgggcatggctgtaatcccagctactcgggaggctgacacagaagaattacttgaacccagaggtggaggctacggtgagccgagaccacgccactgcactccagcctgggcaacaagagcgaaactcagtctcaaaaaaaaaaagaaaagaaaagaaaaagaaaatagttcaggtaattcttggaaattgtatttttataccctctaatatttaaatgaccatcaatatacaaccagggtagggggttaataaataaaggatagcattctttgctgcatcctgggcttatttttctcattctttttctgtgacactgtctcattccatcagccaggctgaagagcagtggagcagtcacagctcactgcagcctccacctcctgggctcaagcaatcctcctgcctcagcatcttgagagggagaccagaagcatatgccatcatacccggataattttttttttttttcctgtagagacgagatcttgctatgttgcccaggctagtctcaaattcctgggctcaagtgatgctcccgccttggcctcccaaaagtgctgggattacaggcaggagccaccatggatcattcgtgtgtacaatattctcactcctttgcaccggaataaaacccagccccctggaaagctgactctgagactttgtgaggatgtgtatgtgcggtttctcatctgaatgcagccatttcacgaacaccagccattccccaggcttcagttaagccattccccatcaggaagatatagggccccctttcaagaggaaccacaatggctaaaactacaatcttcacagcacacatggcttcagcaaatacagagagatgctagccgggcgcagtggctcacacctataatcccagcactttgggaggctgaggtgggcggatcacaaagtcaggagttcaagaccagcctgaccaacatggtgaaatcccgtctctactaaaaatacaaaaattagccacgcgtggtggtaggtgcctgtaatcccagcaactcaggaggctgaggcaagagaatcgcttgaacctgggaggcagaggatgcagtgagccaagcttgtgccactgcactccagcctgggagatagagcaagactgtctcaaaaaaaaaaagaaaaaagaaaaaaaaaaaagaacgatgctacattctcagaaaattagttttacattgaagcttcatttgggaattgaaaataagaacagggaaatacatttttcttttctagagaaaataaacaaggacaaagatgcatggaaaataatattttaaatgtctcctattgacctaagttataaagtcattttttatgtaataacaaaataattggagaggcgtacccaagagcacaatagtctctgaaatgtcttatttcatgtacactcaggcacacaaagacacatacataatttataactaatttagcaaaacattatgatttgatacaactggatggtgggtacacaaatgctgttcaaattattctctgcgtctttcaaatgtgtgaaatgttttataatgaaacatttttagaaggcacattgaagttcaaacaactgctaaacaatgaaaaagataaatggttgtattcaaatgcttacgggtatttactcattaagaatattttgaggccaggcacggaggctcacacctgtaatcccagcactttgggaggccgaggagggtggatcacttgaggtcaggagttcaagaccagcctggccaacatgtcaaaaccccatctctactaaaaatacaaaaattagccgggcgtggtgccgtgtgcctgtaatcccagctactcaggaggctgaggcaggagaatcacttgaacctgggaggcagaggttgcagtgagccaagattgtggcactgaactccagcctgggcaacagaataagactctgtctcaaaaaaaaaaaaaagaaaaaaggtctcctattgacccatgttataaagtcattttttatgtaataacaaaataattggagaggggtacccaagtcacatacgtaatttataactaatttggcaaaacattacgatttgatacaactggatggtgggtacacaaatgctgttcaaattattctctgcgtctttcaaatgtgtgaaatgttttataatgaaacatttttatgaggcacattgaagttcaaacaattgctaaacaacaaaaaacataaatggttgtattcaaatgcttacgggtatttactcattaagaatattttgaggccaggcgcggaagctcacgcctgtaatcccagcagtttgggaggccaaggagggcggatcacttgaggtcaggagttcaagaccagcctggccaacatgtcaaaaccccgtctctactaaaaatacaaaaattagccaggcatggtgacaggtgcctgtaatcccagctactcaggaggctgaggcaggagaatcacttgaacctgggaggcggaggttgcagtgagccaagattgtgccactgaactccagcctgggcaacagaacaagactctgtctcaaaaaaataaataacccgggaggtggagcttgcagtgagccgagatcgcaccactgcactccagcctgggcgaaagagcaagactccatctcaaataaataaataaaagtaaataagtaaataaaaaagaatattttgaaactacacattgccttctgtgtaaattaaaagccaatgaaagcctcctgattttcagggtgtctcatttctaccctatagaagcaaacctaccacacccttcactgaggagccttcgtgaccctaccaagggggaaagagcttgtcttttcaatgagtttaagagctttgcttctgcggttgaaacttccccccagccagcatttcatgttgagagacagtggctaagctgatgtggaaataacacaagaaatcttgtctgaagatgggtgataccaacatcagaactggagacagcaggtactgtgattcaggcgaaactctcaccactaattggtggagagaagaaaagaaaatgagcaaatgaactctgattttgaagaacttcattgaatcaggcttatcttgatgtcttgtgagtcaacaagatgcagctggactagatgtgtgtgtggagtattcgtgaggggctaagggactctcctatgtgtttagtttttgtttttttttgtttgtttttctttttggagacagagtctcgccctgtcacccaggctggagtgcagtggcacgatctcagctcactgcaacctccatctcccaggttcaaacgattcccctgcctcagcctcctaagtagctgggactacaggctcacaccaccaaaattagccggggctaattttttctatttttagtagagacggggtttcaccatgttggccaggctggtctcgaacacctgacctcaagtaatccacccacttcggcctccccaagtgctgggattacaggcctaagccacagcacccagccccagctattttttgtattttagtagagacgggtttcaccatgttggtcaggctggtctcaaactcctgacatcaagtgatctgcccgccttagccttccaaagtgctgggattacaggcatgagcccctgtgcccggcccggactcccctactgaaatgtgcatgacagagaccccaaggctgtcttttccagcaggagctccgggttcatgactgaggatagatgcttcccaacctgctcctcactctccaaagagcttgcaagtgggcacagatgaaccaagctcaccttcctgacaatgacacctgcagatggcacaccatgagttttgtctacaaatgcaccattcccccagtttgaggagtcccagttcgtctttttttttgaaacagagtctcactctgtctcccaggctggagtgcagtggcgcaatctcggctcactgcaacctccgcctcctgggttcaagcgattctcctgcctcagcctccccagtagctgggattacaggcacccgccaccatgcccggctaatttttgtagttttagtagagatggggtttcaccatgttggtcaggctggtctcaaagtcctgacctcaggtgatccacccgcctcggcatcccaaagtgctgggatgacagtctgagccaccgcgcccagctgagggctttgtattttacggagacacaatcagtccatcattccacacaactgtgctgttgggaatctgtgaaggttaagaattccccactgcctttgtcttccagaaaatggttttactgaaaaaaaaaaaaaaaaaattcccttcctcattactcacagatgcttccaagtcagcctaggacaaggctggccacatcctccaaattcacattctttatttgccccttcagggatggactgaattcctcgtcttccttgacctgaacaaaattcccatctaacgtgatcacattttggttgggtttctctcctcctatcaggccccgggatgttgggccagcctcacctggagcaaacgtcagaggatcaagcaacgcttccttaggacctgctcaaaattagctatgcagccacagggtttggcagcttttatccatgactgaaccccacatcgaacgaccccaatcacggttgttccgagcatcacgtgcctgtccctagaaaagaaaatggtatgctgcctgcgctccaagaggctcccagatgtcactgctcgggtgtgcttcatggtgctataggcagcgtccaccagtggttgcattagtccctcctcctcttgttacaatagttcctcccctattaccataatccctccccgccattaccatagtcccccctcctccattaccgtagtccctccttccgttaccatagaccctcctccgttaccacagtcccttctcccgttaccgtagtccctccccattaccatagtccctcctccattaccatagacccttctacttctgttaccatagtccctcctccattaccatagaccctcctcccgttactatagtccctccttccgttaccatagtccctcctcccattactatagaccctccgttaccacagtccccccttctcacattaccatagtccctccttctgttaccacagaccctcctttcgttactatagtccctcctcgttaccatagaccctcctcctcccgttaccgtagaccctccccgttaccacagcccctcctccgttaccatagtccgtccttctgttaccatagtccctccttccattaccatagtacctcctcccattagcagagtccctccttctgttaccagtccttcctcctcccgttaccatagtccacactcctccccttaccatagtccctcctcctcccattatcaccgcccctcctcctcccattatcacagcccctcctcctcccattatcacagcccctcctcctcccattacagtagtccctcctcctcttattgcaaaagctcccatctgtgggaatgatcttttcaaatgaaactgttgctacctgtgtatctggtgtctctgtcaccatcatgggacatccctgaaaggtgtacctcactgctgcagagtagcactctctgcaggaaagtccatatcttccctgccccagacaactgtgctgtccacagctggacactgggcgcttgccagacagttagtgcaatgaggcactgagtttttcttttcccttaattatcacttatttaattttcgcgcatcacacgtgacccctgacccctgttctgggcaccatcgtcggagaaattttcttgaggctcgggtttcttctttctttgctacaaactcccagggctacttactaaggtgaagaaaacacactgttatgtaatccattatacagtcaacgtatccttaccagaaccagaaaaattcacaattttaatggtgaatcgggttgggaaatccatgcttctagttttgaggcgaaatacatgactgataaaacccttttgtattatacaagggaaccggagtggatggagttttgctatagatctcccagacgcgccccacagctccatgattgacagcgtgagtgtgtctatcacacgaaccgctgggggaaggcaggcagttgtgtcaaattggaaccgaatcacaaatgaaacataaattccaggatcccgttgagtataaaaacccaggacccaacaagggcaaacgtaagcagcgaagccccagagaccccctagagcatccagcatgttggggttttaggtttgaaagggagaggttggtatttcttttcttttccttctttgtttttttttttttgagacggagttttcctcttgttgcccaggctggagtgcaatggcgcaacctcggctcactgcaacctccgcctcccgggttcaagcgatgctcctgcctcagcctcccgagtagctgggattacaggcacccgccaccctgcccggctaattttttgtatttttagtagagagacggggtttcatcatgttggcgaggctggtctcgaacccctaacctcaggtgatccgccggtctcggcctcccaaagtgctgggattacaggcgtcagccaccgcgcctggctgggggttggtatttcttgtggctcataaaccgcggctctactttgcatctgtattagttcattctcacgctgctgatagacatacccgagacggggtaatttataaagaaaaagagctttaatggactcacagttccacggggttggggaggcctcacaatcacgacggaagacgaaaaccatatcttccacggcggcaggcaaaatggctcctgtaggggaacttccatttataaaacatcagatctcgtgagaacacactcactaccacgagaacagtatgcgggtcaccgcgcccatgattcaatttcctccacctggccccacccttcacaggtgggaatcattacaattccaggtgccatgtgggtggggacacagccatcccatcgttacagagattgttgcaagtttgccagaatcctcacactcttttcagaggagacctttcaaaagaaacatcatctagggaagctatgctgtgttctgaggcgaggctggaatttcaaaaccagcttttccactaaaacacctgctccatttcctctggggcctccattctccccacgccagaattagggggtctctagtcccccagctctaatgctttccaagcaggataaccctctacatcccatggaaaccacggctgctgcaaggaagagctgagggactgcagtgccgctgaaccgagtcaccctggagttataaattatcaggttggagaaaaggggaaggggttgttgtatctggagctgaagttttcagggctgagctgccaacgtgtgatacttcaagggcccctgcgtacctgacgcggtgtggacagttcgcacccacatagagtttgcaagccaacaggaaacctaggcaggcttcctggaggaggcatcatccggccaggaaatagaggtgagatgttgacagcaggagatggtgagaaaggaacccaggaggagggttatccaaaatagggcacacaggtgagagagtgggggaagaggaagccacaggaaggaagaaaaaaggtcaatgatattgtgacgtaaagtaagttcctgtagcatcttagcatagcaagtttgagaaacagtcgtgcatggaatgaggacaaaaaaagacctctgcacctgcacacctgccctctactcacctgtccagcccaggcaatggcctaccaccctcatgtgattagtattgttctaaagaaatggagtctcactatgttgcccagtctgatctcaaactcctgggctcatatgatccttctgtctcagcctctggaattgctgggactacacaggcatgccaccgtgcctggctgatttggattcttgacagaagagttggctctgaaataccaacatgtggttctgtttaaaaacaaaggcttctcaaaacagaccacagtgaggccaggctcagggctgtaatcccagcactttgggaggccgtggtgggaagattccttgagctcaggagttcaagaccacccagggcaacatagtgagaccccatccaaaaaataaaaatagctgggtgagcagccgggcacagtgactcacgcctgtaatcccagcactttgggaggccgaggcaggcaaatcacctgaggtcgggagttcgaggccagcctgaccaacatggagaaaccccatctctactaaaaatacaaaaattagccaggcatagtggtacatgcctgtaatcccagctacttgggaggctaaggcaggagaattgctggaacccgggaggcggaggttgcagtgagccgagatcacgccattgcactctagcccgggtgacaacagcgagactccatctcaaaaaaaccaaaaaacaaaaaacgaaaaacaaagtcttctcgaaacagaccacagcaaggccaggttcagtcctgtaatcccagcactttgggaggccgtggtggaaggatcccttgagccctggagttcaagaccacccagggcaagatagtgagaccctgtctctataaaaaataaaaatagctgggtgttggtggcatgtatgtgtagtctcagctacataggaggctgaggtgggaggatcgcttgagtccaagaggtagaggctgcagtgagccagatagcaccactacactccagcctgggcaacagagcaagaacctgcctctaaaacagaaacataaataaacaaaaatgaaaataaactatcctgcattcttcagacaacactgtgactacaggacaagcggtcacgctgtcatggaaggatggagcccatctcaaagggaatttctggagtgcagaaagcaaccacatcaggtgggaatacgccctcccagtcagcaggtgcgttctcaaatctccagcgggtaattagtgcacatcacacaatgaatgagcttccgataagtgaaagtatggtatgcacaccgcggctgtgaaatgcggttcgttcttggatatcatgggcagcattgaaaacttaaacctttttcttcttgtggaaaaggctggggcttgtcatcactgtctcctcccttcccctcgcagtttatatttagctgggcacacgccgtgtggatgcccgttttcttcctcctaggggagaatcctcagctacagggttgttttggtttccttgtgtgtttgtttcttgatttattctctcttgagtcagcaagagaacggctcgatgggatggttggttggttggtcggttggttggttggttggctggttggttggtttttgagacagagtctcactctgtcgccaagctggagggcagtagtgcgatctcggctcactgcaacgtccgcctcctaggttcaagtgattctcctgcctcagcctcctcagtagctacgactacaggcgtgcacccccacgcctggctaatttttgtatttttagtagagacggggtttcaccatgttggccaagctggtctcgatctcctgacctcgtgatccacctgcctcggcctcccaaagtgctgggatgacaggctggagccactgcacccggccggctcagtgggttttaggagcatcccagcattccccggacacaaaatgtgcctctctgtgatttttactaactcgcctggagtcaccaatgttgttgccatattttgaccaaaacagtaataaaaggggcaattttcctaggggctcttgttctggtagaagaacaacttcccgctgcctgcattgcaggtgcctctgactcaggaggaaacgcagaatttggcgaacacgtgaagtcttttttcgctaaatctaaattctacagggtggctggggccaattgcagtacggatctgaggcattgtagatggcaagagtgcatgtgtgcgtgtgtgtatgtgtctgagtgtgcatgtatgtctacacttgccataaacgaaagcacaaaagggaaatgtcagaaagaaaccagcaaaggaagccagcatcattcacaatgctggtgtctgttacccacagaggatgacatcgtcattcaggtggccatgaagaaaggctttgaatgacactcccagaacaagagcctggagatctaacatccactctgattctgcccctagccttgggtgacgtgggtttaactgtgacctcaccaagatgtgtccacccagaacctaggaatgaaagctcacttggatatcagatctttgcatacaattaggttgcactagagtagtgtcattgcatacaactaggttgtcattgcatacaattaggttgcattagagtagtgtacgctgttaactgaataactggtgtccttataagaaaaggaacattggaggccgggtatagtggctcacgcctgtcatcccagcactttgggaggctgaggcaggcagatcttgaggtcaggagactgagaccatcctgcccaacatggtgaaaccctgtctctactaaaaatacaaaaattagccgggcacggtggtgcacacctgtagtcccagctactcaggaggctaaggcaggagaatcacttgaacccgggaggcagaagttgcagtgagccgagatcacaccactgcactccagcctgggtgacaagagcaaaaactctatctcaaaaaaaaaaaaggagaagaggaacactgtggcatagagacacagagatggccacgacaaaggcagatactgtattgatgcttctacaccagccgtccccagcctttctggcacagagactagtttcatggaacacaatttttccacacacacacaaaaactgtcttcatagaaagacagtcactgtgagtgcagggggaaggatctggggatgatttgagcgtatgacatttattgtgcactttatttctatgatgatacgttaaatgaagtaattctacaatacaactcattgccatgtagactcagtgggagccccaaacttgttttcctgcaactagatggtcccatccggggggtgatgggagacagtggcagatcatcaggcattagattctcataagaagcatgcaacccagatccctggtctgcccacttcccaatagggttctcaatcttctgataatctaatgccactgctgatctgacaggaggtgacctcaggcggtaatgcgtgcagtgggaagtggctgtgaacacacatgaagctttgctcagtaccagtccacagccagggggttggagtcctctgttctacaggacaagaaacaaccaggattgctagctagcgaaggaagccagaagagatagcggaggatcctcctccagagcctccgcaaggggcacagccctgccttaatactccagaatgaaatgcatttcataattgcagtgtgcacacaatactttttttttttttttgagacagagtcttgctctgtcgccaggctggagtgcagtggcatgatctcagctcactgcaacctccgcctcccgggttcaagtgattctcctgcctcagcctcctgagtagctgggactacaggtgcgtgccaccacacccggctaattttttgtatgtttagtagagatggagtttcaccatgttggccaggatggcctcgatctcttgacctcgtgatccgcctgcctcggcctcccaaagtgctgggataacaggcatgagccactgcgcccggccgtgtgcacacaatacttcaacttactgaacgcttattctttgtgtctggtgcaatagtgacctgctggagatttgcaaatatacttagtgactggaaggttgtatttccacccggatgtgttggctttctgctccaggaatgtcctttgacacgggctctgcccttggatgaccaggtggtcagcctgccttggctgtggacttctggtgttcagagctgtcagagatttgacttctgtggctttcagccagctggtttgtagaattgtgtcgcagcagctccaggaaactaaaatattgagcctcccctatgacagtggacccttgaacaccacgggcttgaattgaatgggtgtccccttatatgtggattttcttctgcctctgccacccgagacacccccttctcttcctcctcctcctcaacgtcaagatgacgaggatgaagacatttatcatgagccacttccacctgataaacagtaaagatattttctcatccttacgattttcttaaggaaaatcacagcttactttattgtaagaatataatatagaatatttactatatttttctctaggttacttcattgtaagaatatagtatataatacatactatatttttttctcttgattaattttttttttgagacagagttgtgctcttgtcacccaggctggagtgcagtggtgcgatctcggctcactgcaacctccacctcccaggttcaagtgattctcctacctcagccccccgagtagctgggattgcaggtgcgcaccaccacgcctggctacttttttgtatttttagtacagacggggtagccccatgatggtcaggctggtcacgaactcccaacctcaggtgattcgcctgcctcaacctcccaaagtgttaggattacaggcgtgagccaccgcgcccggcctttggcttactttattgtaagaatattactatattatttgtgtctggtgcaataatgacctgcctcatgatctgtcactgtctcccattacccctagatgggaccgtctagttgcaggaaaggcttccagccaacagcaagctattagttaagttttgggggagtgaagagttacacaaggtcttcacgtgcccctaaccctcacgtggcttcagagtcccctgtaaatgaatgtgtggcaagcaaagaaagaagaacatgaagaaaagagggagaggaataccctaccactacacaagaccatatatcaccaacaccattaattcttccttctacatgataagccggcaaagtccctgtccttgataactgtgccaatgacgtctgattcccagtagatggatgatgactaattagtcctacatggcaaacaaacgaagggttaattaatctgagcctgcctgagttatctgtgaatgaggatagcccagtcacttgacaatcattttaaacaggtcaacggatgatcaatcacgactgaaattcccccgtaaaagacgtgtccactcaactggaatttatttctaggaagaaaatgagcgacctgtgggctggcagtggaggttttttttttttttttttttttttaatgatgctgctgtttcttaaaatgggctttgagttttttgtgttattctatccaggagagctcatgaaggaccctgtcagtgtggggggcatccaaaacacattaaggccagattcctagagaaagctgttttgccgaaacaaaaatgatgtctggtggcatcacaggctttctttaatccacttgggctcagtcgtaatggcaaagctaatgaacacagagggatatttgcaggataaaagcaattagaacaattatgagggtaattaactggcccaacacactcgtcaacacatctagcaggaccgccagaatctgagactccaaaacccaaggtttttcttttctgttgattccaaaatcctggatggatttcctgctaaaagattgcattggccgggcccattcgctcacacctgtaatcccagcacttcgggaggccgaggcgggcaaaccatgaggtcaggagtccaagaccagcctggccaacatggtgaaaccctgtctctactaaaaatacagagcttagctgtgcatggtggcacgtccccataatcccagctactcgggaggctgaggcaggagaattgcttgaaccgggacccaggaggcggaggttgcagtgagctgagatcatgccactgcactccagcctgggctacagagcaagactccgtctcaaaaaaaaaaaaaaaaaaaaaaaaaagactgcattgcaggatgagatgtcttaaaaaaaaaaaagtagctgtaatctctcatggaactatacaaccttagaaacatatgataaggaagcaggatgttgaaggaatacagggaaagatggtctctacaggtcctactgagtctagcagggatggttcaggagagatgtatagatatgatgtatgagtttactattgctgctgttatggtttggctctgtgtccccatccaaatctcacgttgaattgtaattcccagcgttgagggagggacctggtgggaggtgattggatcatggtggcggatttcccccttgctgttctcatgatagtgagtgagttctcacgaggtctgacagtttagaagtgtgtggcattccccccttgctctctcttcatccatcaccaccgagcattcatgctgcacacgtaaactcaaagactcaaggtcgccatgtgctatggtttcaatgtctgtgtcctctcgaaatccccattttttggttattgttttgttttgtttttgcttttgcttttttgttttgttttgttttttgagacggagtctcacacagtcgccaggctggagtgcagtggtgtgatctcggctcactgcaacctccgcctccgaggttcaagcgattctcctgcctcagcttcctgagtagcttgggattacaggtgtgcaccaccacacccggctaatttttgtatttttagtagagacagggtttcaccatgttggccaggctggcctcgaactcctgacctcaggtgatccgcctgcctcagcctcctaaagtgctgggattacaggcgtgagccaccacacccggccccagatccctgtcttgagacataacctacaaggtgatagtgttaagaggtggagccctttaagacgtgatgaggtcatgagggtggggcctcaggaatgagatgagtgtccttctaaaagggaccccagagagctccctcgacccttctgccacgtgatgacaagagtgagaaggcaccgtctgtgaaccaggaagcaggtcctcaccagacactgaacgtggcatgctttgatcttggacttctagcctccagaagtgtgagcctgaccaacagggagaaaccccgtctatactaaaaatacaaaattagctgggcatggtggcgcatgcctgtaatcccagctactcaggaggctgaggcaggagaatcgcttgaacccagagggcagaggttgtggtgagccgagatcacaccattgcactccagcctgggcaacaagagggaaactctgcctcaaaaaaataaaaatgaaaaaaataaagaggcaaaagagccagaagcaaaatgtgcatccgcctatttcccctgagggcacgtacgttccctaagagcgacaggtagagtgactaaaagcacctttgttccaacagtggcaggctgtagcatccccgttctcaggaagccacaaccaaaaaaaaaaaaaaaaaaaaaaagccagcaacacacatgaggtgagaaggattttcctgaaaacttccagcctgacaggtgcatgattattttaaaagcagagcctagatgtgcaaatctgcaggaggggtaacatgaaactaaaacatggcattgtttgcaagctacatggcttcgtaggagagtctgctgtatggggggccatggcttgcatggctgacagcatcacttctcctgcatagtgcaaaacatggacaagaagatgcctgaagaggtcctgtgggcctgcctagactcatctggcttaattacaatattcagaaatgcaacacctactctctggagaagtattccattccctctttctgggctcccacaagcacagtctttgcttggctgagccaagggagctgacagcagaatccctgagtcttcggatattagggctgttgttagctatggaaggagggcagagttgagggtgtcagacttggccaacctacccaccagaaggaggacatgcaagccacagagacttgggaggaaggacacagaacagtccacagatagtcaagtagagcaagattgtttcaggaaaaggggttggttctttcacagaatccatgaacagcaatcattaccattttcataatcatcactatcaccaccatcaccaacatcatagccaccaccatcatcattaccatcatcaccatcaccaccatcatcactaccatcatcaccatcatcatcatcaccatcaccatcatcatcatcaccatcaccatcatcatcaccatcatcaccatcaccatcatcaccaccatcatcaccatcatcaccatcaccatcatcaccaccatcatcaccatcatcatcaccatcaccatcatcaccatcatcaccatcaccatcatcaccaccatcatcaccatcatcatcgccatcatcatcactatcatcatcatcatcatcaccatcaccatcatcaccatcatcatcaccatcaccgtcatcaccaccatcatcaccatcatcatcgccatcatcattatcaccatcatcatcactatcatcatcatcatcaccaccatcaccatcatcaccatcattagcagcagcagcagcatgaccatcatcaccatcattatcatttctatcatcaccatcaccatcatcaccatcatcagcagcatcatcaccatcaccaacatcattatcatttctattaccaccactatcaccatcatcatcatcaccaccatcaccatcatcagcagcagcagcatcaccaccatcaccatcatcattatttctatcaccaccaccattgtcatcaccatcatgaccatcatcatcactgaccatcatcatcatcacatgaccatgaccatcactatcaccatcctcatcaccatcatcattatcatttctatcaccccatcatcatcaccatcagcatcagcatcatcaacaccaatattttcatcatcactatcatcaccatcataaacaccatcatcaccatcaccatcatcattatcacatcagcagcagcagcataatcattatcatcaccatcatcaccatcgtcatgatcatcaccatcatcatcatcatcaccatcatcacagtcattactatatcaccatcaccataattatcaccatcatcaccattaccactgtcatcatcattgccatcatcactaccaccatcatcacaaccatcatcaccatcagaatcaccattatcatcaacatcatcattgtggcagctgtcattcatgagatcccacaatgcacaaaatattttcctgtattttattcctttggccagtactttttatatcccagtgatgttccatggaccatcatggggctggggaaatcagtgacacaattaaacaaccaacgatacaatgtgtgaggttggcgatagaagggattaagtgtcccaagggagcagggagttgtaaggcacctggcttcaggacaactgctttacagcatgctataaaagctgagaagactagcatgaaagggacttggatggtcaggaggcagaggaggggaagaattctcaagaaccaggaaccacatgtgcacagctacagcaaacaggtggaggcatgaagggcattctgcccatatgggtttaagcaggttaagacaacagtgtgactcagcaggatctctctgactgcagtgtagacagttcagggagggaaacctggaagccgagagactagccaggaagcagagttatgaagcaggtaagggataggtgtgacctgctgtagggagtgataccgaaaatgacggagtgtttttgataagcatgtaggtggtctacagagctctcagttgccaccagggagaggaatgccaaggtggagaaaagcatctcagacactctaggatcgactgtaggcagctgagaggatggtagtccactgacttacacagagagaaggaaaatgtcaaatacattcctgcacttgctgtggaagcagggaggtgtaggaggcaggagtttggaaacaaatatattggtgagaactagcagagcagagttttggagaacacggacgtggttgcaagacctaaggaaaggtgtgtagtgtgagatgctacgaggaaacgctgaggaaaggcagcataaaagaaacagtcaagaaagaagccacacaggagggtaggtcttggagaaagcaaacccagagggtggaacctcatgagaggatggaattgaatctttcaagacagctgttaaaggacactttttaagagtgtttatcataattttgctcactcagataagtggatgattatttaattcctcactccagctggactataaattccacacaggcaagaagcaagcttatttggttgtatttaaaattgaacaatgggatcacgtggacacaggaaggggaacatcacactctgcggactgttgtggggtggggggaggggggggatggcattgggagatatacctaatgctggatgaccagttggtgggtgcagcacaccggcatggcacatgtatacgtatgtaactaacctgcacaatgtgcacatgtaccctaaaacttaaagtataataataaaaaataaataaatttaaaaaaaaaaagaaaaaaaaatatatatatatacatttgctgcgcacctgtagtcccagctgctcgggaggctgaggcaggagaatcgcttgagcctggaaggcggaggttgtagtgagccaagattgtgccactgcactccagcctggcgacagagtgagactccatctcaaatatatatgtgtgtgtgtgtgtgtgtgtgtgtgtatgtgtatatatatgtgtgtgtgtgtatacatacatacacacatccaacaagtaccatcattaccatcaccatcatcaccatcatcatcatttagggaaaggaacacaaatgtgacactggaaattcacatttgaatttggaaattcatccatgaatcagccagagggctatggtggtggctagtgatggtcatggttgctttaaaagatgcatgctttattgtggtttatgagagaaccaccaagaatggaaagaatgtagcacacagaccgtaattctcattccatagccacagcaggcatcactaattgatgactattccttgctgcaggatcattcttatctcagggtgctggcagccagaaccaatcaatcagccttaggagggaaaatccacttgccatccattcaatttgtgattcgggtgtagagcatctcctgcattccggctgctgttatgagattaattccttcagaggtttactaattaatggatgttgaattatcccaaatgcttccctgttacctaatgagaagcatcctttggtctacaggtggatgagttgcaactaagtcaggagtaattttttttttaacctggaagtctattcagtggataagattaaactagattttctttatttaggttggtaagtagaaccagccgatgatgcttctttgaaaagtgttcatttgggagtaaaacggtttactcagacacaggttggtggctctggtcactttgaagagtacagccagtagatttttggataaatggccaaatactacacaccttaggatttgtgggccataaggtctctgttgcaactcttcaaacctgtgtacctaaggcaaaaacagtcacaggcaataagtaaatgaatgtatatggctgtgtttcaagaaaactttaatgagaaaaacaagttaagggtcagatatgttccagggtcaacagtttccagattcttgatctagattgtccttgatggtttggaaaaagtatatagataatcaattatttatttatttatttatttatttatttatttatttattttgtgtgtgagagagagagagaaagaaagagagagacagagagacggagtcttgctctgtcaccaggctagagtgcagtggcatgatttcagctcactacaacctccacctcccaggttcaagcaattctcctgcctcagcctcccaagtagctgggattacaggcctgtgccaccacacccagctaatttttgtatttttagtagagacagggttttaccatgttggccaggctggtctcgaactctggacctcaggtgacccgcccaactcagcctcccaaagtgctgggattacaggcgtgagccactgcacccaaccagatattcaagaattcattaggaacacttggtggaaagttctgacggttgaaatttcagcatgttgttttatctgtgatctgtaattccatttgcatgaatttagcaaaattctaattttttgcaataagacagcctttcatcctttgcccaggaggaggtaatcaaatatgttagttgagttaagaataaattactttttttgcataagtttaaatcatatttttattacatgttatttcctctttcttgttccaattcatgctaatctgtccttgcttcttttgtgtgtggaatgaaggatgaataaatggtgggatattattctttcatttttcttaaggaaactactattgatggttttgtttttttttttttttgcttctctgctactttccttttgtatttatttctgcacaatgtcattattttcatactcctgcttcctaattttactttatttcttagaggcccagtcatcatttgcttttttatttcttactagcacgagaacttagagtgatacaaatcttctgaatattttggctgcattctgcagacagtgacagcttccatttccatggatattatttataaaacatttttgtcacctgctatgaattgtcaccctgcccacatgctttaaaaggacagtttttgaaatcaacatgagtttgggcactgggaaactgcaaacttaataaaattaaacattaaaaaagcggctctttctgcttccctatcaactgaggcagcagggttatagatgtagggggtaaggaacggaccctgtattggtcagggttctctagagggacagaactaacaggatagatatatagaaaggggcatttattcggtattaactcacacgatcacaaggtcccacaatagactgtctgcaggctgaggggcaaggaagccagcccaagtcccaaagctgaagaacttggagtccagttttccagggcaggaagtatccagcacagagaaagatgcaggctgggaggctagaccagtctagtcttttcatgtttttctgcctgcttatagtctagcctcgctggcctgctgatgacatggtggccacccagatgattaagggtgggtctgcctttcccagcccacggactcaaatgttaatgtcctttggcaacaccctcacagacacacccaggatcaatactttgcatccttcaatccaatcaagtttactctaagtattaatcatcgcagaacccattccaagggcagaagtttacagaggaaatagttaggacctcagccagctccagagtgtgcatggatcagataacaggggtgaatttcctcacagcaggcggaaaaaaaaaaaaattccctactctgagcctccaccctcccctgcaaaaaaaaaaaaaaaaaaaacgggattccctcaggtacccccagaacctaaatcttgttctgtgccagggaggcatggggtacaggagcctggctcactcctgaggaagccactgctcatagctacagggtagctgtggtcctgtggggactgatcagcctcagggcttgaggggacaatgagggcagagaaaacaggagaagggagtggtatgggtttgtccttggtcttactcaaaggagccattgggaggcatggagggaaccccatggcaagatgctgagacgatgccagcttgctgggggttgcagaaacgttttcaggtagccccttggaaagaaacactggttgtcatgggctgaattttgtccccctcaaattcatacattgagatcctcacccctaggacttcagaatgtgatcatatttggatatggggtctttaaagaggcaattaaggtaaaatgaggtttcagggggttggggggaggctgatccaatgggactggctccttataagaagaggagatgaggacacagacacacacagagggacaaccctgtgaggacacagggagaagacggtgactccaagtccagcagagagacctcaggaggaaccagccctgcccataccctgatctcagatgtccagcctccagtactgtgggagaatcaatgtctattgtttctaagccacccagcctatggtattctgtgatagcagcctgaaatggactaagatatctcataagaagaggagatgaggacacagacacagacagaggaaggactctgtgaggacacagggagaagacagcatctccaagtccaggagagagacctcaggaggaatcagccttgcccataccctgatctcagacatccagcctccaggactgtgggagaataaatgtcttgtttgtaagtcatccagcctatggtattctgtgacagcagcctgaaatagactaagacatttcataagaagagatgaggacacagacacacacagaggaaggactctgtgaggacacagggagaagacggcgtctacaagccagagagaaagcaagcctaccgacacggtgacctcagacatgtagcctctacagctgtgagagaataagtatcttttgtttaaaccacctggtctgtggatctctgtaacactcggcaacgctacaagacgaatacacggaccagagcattagaagcgccgcaggtggtctctggcagtcacgcttctgccatgagaatcagctctaaccgtctgttaccgggacatagggtaaccagccaggaaggggtcacctggtctccttcctcctctctctcacctgcacccaggtgggtgctccaatggcagctcatggggggaaagagagggaaaggctgggccagaggcagcagaaatctcccttctgaaagaggaagatgacctgagctcctgccctgggctgaatccctgaatccagactctgttttgtgatgaaagtgatggcggtaacctgggagggggtgggtaggtaggtttcgtgtccacctctgtttccatgcaggagcttgggagagggagacagggagggcacagcacatggatgacaccccacgggctgtgtgcttggcgtgctggacacgtgtgtcacagtctttcttgacctaaaacatgggtacttttatccactcatgagtgtatgatcaattgacacacacgagtcactcaccaacagctgcacaaggatgctccagagataaatcttctcttgccttgtgttttatttattcttctctgtatctccctgatctggccttttcagattcagaatcacgtgggttgttgagcatttccaatttaagggcaattacttattttattttttttttattgttttagatggattcttgccgtgtcacccaggctggagtgcagtggcatgagctcggctcactgcgacctccgcctccggggatcaagtgattctgctgcctcagcctcccgaggagctgggattacaggcttgagccaccatgccaggctagtttttgtatttttagtagagaaggggtttcgccatgtcggccacggtggtctcgaactcccgacctcaagtgatccacccgcctcagcctcccaaattgctgggattacaggcatgaaccaccgtgcccggcctcatttttaaaataatttttaattgtggaaaaatacacataacataaagtttagcattttaaccttttttttttttttttttaatggagctttgctcttgttgcccatcctggagtgtaatagcgcgatctcagctcaccacaacctctgcctcccggattcaagcgattctcctgctcagcctcccaaatagctgggattataggcgcccaccaccacactcggctaattttgtatttttagtaggaggtttctccatgttggtcaggctcgtctcaaactcctgacctcaggtgatccacccgcctcggcctcccaaagtgctgggattacgggcatgagtcaccatgcccagctgcattttttttttttataattttgaattgtggaaaaatacacatcacataaagtttagcattttaaccatttttacgtacacagtaaagtggtattaaatacattcatattgttatgtagccatcactgccatgcatctccaaaatattttcatcttgccaaatggaaactctgttcccattaaacattaagtccccaccttttcctcgcccaacccctataactaccccattctactttctgtctctaaaaatttaaaggtactctgtgtacctcataggagtggaatcctacagtatttgtcctttggggattggtttatttcacttagcattaatgtcctcaaggttagcccacattgcagcatgcatctgaatatccttccttttttatggctgtgtaatattccatcatttggatacaccacattttgcttatccatctgcctgtggagggacacagtttctctccaccttttaggattggattatttcacttagcattaatgtcctcaaggttagcccacatcgcagcatgcatctgaatacccttccttttttatggctgcgtaatattccaccgtttggatataccacattctgcttatccatttgcttctggaaggacacagtttctctccaccttcgggttattgtaagtaatactgctgctgcaaacgtggtttgtgcaaatatctgttggagaccctgtttccaattctttgaggtatatacccagcagtggaattcctggtgccatctgttcttactttttatttcatggaatgctgttttattggggacccaagaatttggcaggatcagtctatcctcagggagtcagtgaagttcaataataaagaaactctccaggtcgtccctccttaaaagtcaggttccttcaagacagaatacaagtgacctgccctcaggcaaaagggatgccggcaacgttgcaccactggtgcaacaccagtatgcaccaaggcataacccaagatttaagacgcagccaagagccctttcccaggaggagccataggtaggaattctcaggcaggcaggggactgggggaaaaaataaacccacctaggggtggaatcctgccaagtaagagaggaatatagaaggcagcagacacaggggtcacacccagaaatgcaaaggctgatgtgaaaagcctgccacgaagcacccagcccatcttaagtgaaattcaagaggactcctgtaatcccagcactttgggaggccgaggtgggcagatcacctgaggtcaggagttcgagaccagcctgaccaacatggtgaaattcccatctctactaaaaatacaaaaattagctgggtgtggtgggacacacctgtaatcccagctactggggagactgaggcaggagaattgcttgaatccaggaggtgaaggttgcagtgggccaagattgcaccactgcactccagcctgggtgacagagcgaaattccgactaaaagaaaaaaaaaggaaagaaattcaagagggactgtgaaaagagcagtgattgctacacagtccaaggcgatccatggggatgagtcagcaattatgcatccaacgaagtgaggtttgcaaggtgaggaaggaggagggaaaacgctgtcgttcaccatccctcgccacagggaggccacaggcaatgccagcaattcaaacgtgctgcttaaacaaagcatcctggtccttcctggggaaatggaaatgggtatgacggtcagggagggtgacgctaccctcaagcccagcccttcacttcaatgggatttaaatgccatgcatgttacagttcagttttatgaaacctctgcttttatctaaagcatatataatttcataaagtatatgtaaagcatttatcattttatatatgcagcacatacaattttaggaggaaatgatggtgcacgcctgtagtcccagctcctcgagaggctgaggtgggaggatcgcttgagttccagaggcaaagccagcccgggcaacacagcaagactcacgtctcttaaaaaataaaataaaataagtaggtatataattttatgtatatattaattttatattttgtatactgatatatatgtattatatattatatgttacaatgtttatttatattatatattatgatatatgcttattatatattatatttattatatattatgtgttacatagtatgatatatataaaataatatatacataaaattaaacatccaataactatagtttatacttatatattataaattcgtgtttattataaagtatgatataaaaatatatactaaatatatatactatttatagaatagcataaatatttaatataaattatttataatgacacaaatataatttatagttatcattatatatttatgtaatatatattttatatatacacaaaatgtattgtgcatattatattatgttttatatataaatatataaataaaatatatcaaagtatatcttgtatataattttatattacaaatatatgttacaaaatatatatacattacaaaatgtaacatacatatgaatgtgaattcatatgtatatacattataatataaattcatattatgtcattatgtatttaatatatacattgaacataatacatcatatataataatacattataatttaatgtatatgctttataataataaatatatagtaagtatataaacctaaaatattaatatagatcaaatatataaatgtgtatacaataaatatatgaacctaaaatatgaatatatataaagtagatgaatataacacataaacaaactataaatgtctagacattgaccatgtacaagtgtgcagtgtggacagtgaatggaaatgtgagcatgaaatgtgtgttgacgcctcccatctcctgtgcacacacaagacacagcgacctccccatctcctgcgcacacatgacacacagggacctccccatctcctgtgcacacacatgacacacagggacctccccatctcctgcacacacatgacacacagggacctccccgtctcctccgcacacacgacacacagggacctccctgtctccggcgcacacaggacacccagggacctccccatctcctctgcacacacgacacacagggacctccccgtctcctgcacacacgacacacagggacctccccgtctcctccgcacacacgacacacagggacctccctgtctcctgcgcacacacgacacacagggacctccccgtctcctgcacacacgacacacagggacctccccatctcctgggcacacaacacccagggacctccctgtctcctgcacacacgacacacagggacctccccgtctcctgcacacacgacacacagggacctccccatctcctgggcacacaacacccagggacctccctgtctcctgcacacacgacacacagtgacctgcccgtctcctgcgcacacacaacacacagggaccattcggggttcagggacgcgtgtccatggtaggatccctggcaatttttctgatttgcccgagcactcatgagtttcatgactgctatgatttttcacagaagcttggctgtgggcaagatgggttggcagatgcagggggaaccggatggaaggctgcttgtgtccgggctcactgtcctggcggctgcaggtgcctaggccatgaggacatctgagcagacagggcgccggaggagagggcaggacaagaatgggagtgcagacagcaggctccctgtgaaggccagtgggcccagctgagacccagggaggggtatacctgccccacaggagagacctggacttggcagcagcagggagctggggcaggagggaaatcggccccacccacatgctgcaagcacgtcagccaggtcagagttccaggtgaggacgaggttacagctacaggtgatatgatgtcagagctatcggtgaggatagccggttagagctacaggtgagggtaagaggtcagaatgccaggtgaagatgagattacagctacaggtgaggatgacatcacatttacacgtgaggataacaggttagagctacagatgaggataagagttggagttggggccgggcacagtggctcacgcctgtaatcccagcactttgggaggctgaggcgggcagatcacaaggtcaagagatcgagaccgtcctggccaacatggtgaaaccccatctctactaaaaatacataaattagatgggcgtggtggcacgtgcctgtagtcccagctactcagtaggctgaggcgggagaatggcgtgaacctgggaggcggaagttgccgtgagccgagattgtgccactgcactccagcctgggcaacacagtgagactccgtctcatgaaaaaaaaaaaaaagagttggagttggagttccaggtagtgatgagaggttggacttccaggtgacaatgagtggtcagcattacaggtgatggagggaggttggagtcctaggtgaggacaagtggtccgagttacaggtgatggggagaggttcgagtcccaggtgaggatcagtggtcagcgttataggtgatgataagaggttgaagttccaggtaaagataagccatcactggggccaaggacagcccgaggtcacagggctggctcaaccctgattcctccaagacctgtgttctttcctgcacctgtttccttggaacgagtctgttcaggactcacactcacctgctgcagggagctcagctctccagcccacctgcactctctccagaacccctccctgcccgtgtgaagcaggagggtgtcacagatcagcacccaacacacctcggccactggggccagccagggggtggaggggccgagctacgtaagtccctgcgcgcaccacaaagggggcttgtactgtgtctagaaacctttcatttctgttttgagtttactttctcactggggttccactcctggcagacctccctttttcccatagagaggccgcacgcagaatttccaagcatctggaaccccggctgcttggaaacatgtagcgcctcctgtcatgccccatcggtgaccagagaggactgagtaagggatgttcccgtgactgcaaggaaggcatggatgggggcgtgtccacctccagcggaacccccaggggacttggaatttggaggcagagtctgaggccaacacttcagagtgacacacgcatgttcagggtcaccttaccggaagccatgcatttccctgatgagccaggggggtgactatgtctccccaagttcttgtcccatgacctggggtcaggacacagtgtgctgatgtcacaccatgtcacacagctgtagtatgcctctatcagcaatgcaactagatattctattcctgcccgatctatgtctctactcgtctcccgaggctgctgtgacaaatgaccacacctggggaacttaattcaacaggaattcatcctctactggctctggagaccaaaagtctgagatcaggtgtctcaggaccatgctccctccgggggctctcaggaaggggcctccctgcctctcctagttcctgggggctccaggagtccctgggtttgtggccgcatcgctccagtctctgcctctgtctccacaaggccttctcctctgtgtctgtgtctcctctcctgtctcctacaaggacagctatcattggatttaagactcaccctaatccagaatgatctcatcttgagatccttaactaattacatctgcaaagaccctatttccaaataagttcctgttcacaggttctggggattaggacatggacatatcttttggagatcagcattcaaccccttgcaattgtgtttgatgctttctttctttttcttttttttttttttttttttgagacagaatcatgctctgtctcccaggctggagtgcattggcaatatctcagctcactgcaacctcagcctcccgggttcaagccattctccagcctcagcctcccgaggagctgggatgacaggctcccgccaccacgcctggctaatttttgtatttttagtagagatgaggtttcaccatgttggccaggctggtctcgaactcctggcctcaagcaatccacccgccttggcctcccaaaggtgtctgatactttctgaagactctagggggcatccttcctgcctcttccagctcctggtatccctaagttgatggccgcatcactccagtctctgtctccacatggccttatctgtgtctcccttttttttttttttttgagatggagtttcactcttgttgcccaggccggagcgcaataccacgatctcggctcaccacaacctccgcctcctgggttcaagcgattctcctgtctcagcctcctgattagctaaaattgctcttaatattttaaaggatactgcagaatacagaggcatttgaaggaataaagagaatggctgaaaacagctgaaattcagcttctttttactattattccatttttatttagagaaaagggtcttgctctgtcgcccaagctaaagtacagggtcgcgatcatggctcaccacagccttgacctccaggctcaaacgatcctcctgcctcagcctcctgagtagctgagactccaggcacgcacaccacgcctgactaatttttttatttagttgtagagacaaggtcttgccatgttgcccaggctggtcttgaagtcctgggctcaagcgatcctcctgcctctgcctcccgagtagctgggaccacagtgcaccccaccaagccagactgatttgttaatattttgtagagacggagtctctctacgccaccctgactgctgtcgaactcctggcctcaagcaatcttcttgcctcagcctcccaaagtgctggaattccaagcgtgagccaccgggcccgaccctggcattcacccctcttgagacacggtgggaaagaaactgtgaatagttattttcacacgtgccgcctgtgctctggtgggagaagagcaatgagaacactcgccttgtttctctacctcggttctcattcacagacaaaaaaaaaaacaacagtaacacagccaggcagggtagagataactccctccactgacagagacattttttttttcccattttaacaacactcattaattcttatctgttaaatagcgcgtagaatttgtgcctctaaacccactcgataatcttttgggtaattaacttgtaaaacaaccccagtcctcgttacgggcgggatggaaaaatgtgaagtagcgcatttgcaaagcagaccatacacaattacttattaaacatgccccaggtgtgccggcaagtcggcggcaagtggaagccctcagccttgtcgtctaatggaagaagattaaaaagtgccaatatcctcagagcgcgcacacacacacacacacacacacatagatacatatgccaacaggctgatctcacacacatagatacatatgccaacaggctgatctcacacacatagatacatatgccaacaggctgatatattcagggtctggagaaggattacacaaagagatgagttgcggaagggggctcgcttgcagacccttgtaggtgaacaggggcagggattaaggagctcatggtgctgcagaagtatctctgaatggatcagggcaaccgtgcattcaatagcaaaatatgtcagtatgactcatctcagaaacagccttgcttccaactgcaggcggtgatttggccagaggtgggctccaagacttgggaaacactcgtcagagcacctctaacctctacctaactctagccctaaccctaaatattagggaaatatgagactatgagttttcaaaaaatagctgggtatggtggctcactgtgcctgtcatcccagcactttgggaggctcaggtaggaggatcgcctgaggctgggagttggagaccaaaacccaaagaggctgtgaaccacaacacaccgtcatttctggaaacgcaccgactatctgggaggcccatgtgtggatgtgcttattcttaagtatttaaaggcccatggaaaggcgcttttgctctttagtgaaaatatatactgggctctatcgagccacgaaaagacgcaaagaaacgttaaatgcatattcctttttttttttttttttgagatggactctcgctgtgtcacctaggctgaagtgcagtggtgcgatctcggctcactgaaaactccgcctcccaggttcaagcaattctcctgcatcagcctcctgagtagctgggattacaggcatgcgccaccatgcctggctaatttttgtatttctatttatttgtttatttatttggagacggtgtctcgctctgtcgcccaggctggagtgcagtggcgcgatctcggctcactgcaagctccccctcccgggttcacgccattctcccacctcagcctcccgagtagctgggactacaggcacccgccaccaagcccagctaattttttttgtacttttagtagagacggggtttcactgtgttagccaggatggtctcgatctcctgatctcgtgatctgcccgcctcggccatagagatttggaaggttattaccaccctgagatatgaagagccctgaagagaaggaacacaatgagacctgcgaggaccaattaaactttcagagagtgtgggacatctatgcccacgcatgagaacacatacggtgacctcaaggaaaaattaccaacaggaacgcatgagtctatctgtttatctacgcatatgcctgtctacagcctgactcgggacacttctcgaaaacatgaaagaaacaaaaggactcactatgaaaaggaaaacagtcaataagggccattttatgtttaaaaaaaaaaaaaacacaggccaggcgtgatagctcacgcctgtaatcccagcacttcgggaggccaaggcaggcagatcacaaagtcaggagatcaagaccatcctggctaacacggtgaatccctgtctctactaaaaatacaaaaaattagctgggtgtgatggtgcacgcctgtaatcccagcatcttgggaggctgaggcaggagaatggcttgaaccagggagtcagaggttgcagtgagccaagatcgcaccactgcactccagcctgggcaacagagcaagactccgtctcaaaacaaacaaacaaaaagcaaaaaaaaaaaaaaaaacaaaaaaacacaggggctgagcttggtgtcttacacctgtaatcccagcactttggaaggtgggaggatcgcctgaggccaggagtttgagaccagcctgggcgacataatgagaccccgtctctagaaaaaatttaaaaaacaaaattagccatgtgtagtggtgcatgctactagtcccagctactcgggaggctggggtaggaagtttcctactgaggagtttgaggctgcagtgagctatgatcacaccactgcactccaacctgggtgacagagcaagaccttgtctccaaaacaacaaaacaaaaaacaaaggtaattgtgaatatatgctgaaccagaatacacatccacaatctggttaaaacttctcgggaataaacataattaatcgttggcgaacacattcacataaagtgctgtgattccaacttcagcacagacatgatctctcaaggattctatgccctaaaatcatgtcacaagaattctgtacattaaaaatggatacccaggggtgtggggagaattccatgccatcaacactcacatcatcctttttccaagtttcgcaacctccttaacaatccttctacccaatccgaaagtctacaggttgaagaaaaattctaggtgtcttcttgccccaagatatgtctgcctcctgacttggagttctcgctctgtttgatgatgaagaccagtagacacctacacagagactcttgcatgtcatcatgaataacatatgtcccagtcatgtgtcacaggtgagcctgtaaaacaggcactgaggtagattgtctcgggagccactgtgtttcaggcactgaatcagagactcagaagatacctgtgcacagaatccatctctgccctcacaaagctctgattttagcagggacaggcgatgaggagggtgagtattcccaaaacaacaaccctcatctcttgcacgtggaacgggtcacaaagagctctcttactgacaacaagcattcatcctacacttcactgactcttgtattttcaatctactcaattacgttgatgacctgttatcaaccttcatcctgatttcacagtattctgttttcatgataaattcaagtattttataggtcattggataggccaaaatgatggttcacaaagatctattttcaaagtagaagtgcctcccaaggcggcgtgcaaaatttaccttcttgacacccatcaattacagaaggcattgaccagtgatttcttttattgaaaacaaacttggtctaataactgggtggaagcacatgaaccaaacagctagtccctcttctgatgaagacggcacaagctactggaagaataatatttgggaagcttttttttttttttttttttagatgaagtttttctctgtcgcccaggccggagtgcagtggcatgatctcggctcaccgcaaacctccgcctcccgggtccaagccattctcctgcctcagcctcctgagtagctggaattacaggcacccgccaccatacctgactaacatttatatttttagtagagatggggtttcaccgtgttggccaggctggtttcaaactcctgacctcaagctatctgcccgcctaggcctcccaaagagctgggatgacaggcgtgagccatcgtgcctagccaggaagctaaatgaatcagaagatgctgtttgtgattaaagttacacaatcattatagaaaatgaggacaccgtgcaccttccaaagaggatacacagcacgtgtctagtctgatctctcttaggatttaggattacaggggttccaccatggcatgtacgagctgcaaaagagaatgggcctgccttcagtgcttttaagagtgtttaactggttatctctccccatctgagttcatttgaacacggctatgcctttctgtgtttgctttcatggagccgctggggtttgatttatttatatttggaggagtttcggtaagtgaatgagactatttgttctaagtaagacagctttcatcagcacataattacccaggagccacaaaggtgtgggcacaatggctaagtgatgataaggagtgaaaacgcttccctggaaaatccctagcttgggaaatgagccatctcgcccagattcctgaaaacaatcgcgcatttataattccgagagctcaattagccgtccttctgtgggcacgtagcttcccatgccctgcccagcgtgggatctcagaggagcacgacttcaaagacagaaagtacaacaaagtacgcaggccagagtattaacccaagaactaaggagagagaattgagagcaggaaaggcaggaggggaaagcaggctagacaggcgcccagcatgttgaaataattgtgtgactgacactccacagcaatctgtgctcctggagtcaggacgtgagccgacttgcttaaaaataaatccacatggctgaaccggggttacccgatgccgggatcccagcagagcaagaacgaaacagcacattcagctccctctgtccctcgctgggcaactggaggttgtggggacaagaatcagagttccagcaggtgcaggccagtccagagagaagcacaatttagagcaaggttcgtacgggtttggtggaggtgtgcccaggtctcagctgaggagggaagggatgcctgtaggagctgtggtcgtccataagatgttgtgggcagcagataccactcacaggcagagggcagaccctgccgtgtggctggaccacggatctgggggctcctgagcctggaggcagactcagtcgaggtaaaggctcaatggccacagccgaaatgtccccacccagctgggcctcagcatcatctatcaaggactggagagtcccccagcagtggacataccagggccaccactgatgaatgtccaaacctgttcagattttaaacttttttcttttaaaaaaaaaaattgcatgcacacatagtaggtgtatatatttatgggataatgaggtattttgatacaggcatgcaatgtgtaatactcacatcagggcaaatagggtatccatcccctcgagcattcatcacttgtttgtgtcactaacattccaattacacctttaattggtttctttttttttttttttttttttgagatggagtctctgtagtccaggttggagtgcggtggcacaatctcagctcacagcaacctccgcctcccagattcaagcaattctcctgcttcagcctcccaagtagctgggactacaggtgtgcaccaccacgcccggctaatttttgtgtttttagtagagacggggtttcaccatgttggccaggctggtctcgaactcctgacctcaagtcatccacctgcctcggctttccaaagtgctgggattcaggggtgagccaccatgtccagcaacttttagttatttttaaatggaccatgaaggattgttgactgtagtcacccttttgtgctatcaaatacgagaccttactcattctatctaaagtatatttttgtgcccattaaccatctccacggcacaccccatcttcccaccctcttacaagatggtaaagcttttaaacagccacagaaagtgcaaacgattcttttcttcttttctgtaagattggcttaaaggccatcggtatttatatgccacaagtaaactaacattttttaatggtggggacaaatcatgtattcgtcatgctacttgtccacaaaacactgcactttaaaaactgatgatcgaatatcctacacaaacttttccaagaaaacagcaatgatttgttattgtggtcagatgcagtggctcacgcctgtaatcccagcaatttgggaggctgaggtgggtggatatctgaggtcaagagtttgagacaagcctggctaacacggtgaaaccccatctctactaaaaatacaaaaaattagccgggcctggtggtgggtgtctgtgatcccagttactcgggaggctgaggcaggagaatcgcttgaacccgggaggcggaggttgcagtgagccgagatcacaccactgcattctaacgtgggcaacaagagtgaaactctgtctcaaaaaaaaaaaaaaaaaattattggtcaaaattcatgttgtctaaatctgaaacattttcagaatctaataaaattaagttggtgattataaatcattgtttcttggctgtcattttggttaggtggatcacatatgtgaattttggggaactatatatagtttttaagccgttcagattaaaagcaaaaagtcatgagaaaagaatgcctcacttgtcagtttccagaaacttctctttgggctccagattgatggttgaatgccttcaggacagcagcaagtgtaccatttgaaggtgcgtggggatcatttaacggcctcataagaatgcagattccagggccccgcccccacccccagaggccccgattcacagatgggccctgggcacctgcatttcttgtttactccccggaaatgctgatgtgacaggcccggagaaggcacttttggattcattgtgttagaaaatgccactcctttgaaaacctgctgcaaatgaggaagggccaaggtggcagggaataggaccccctgtcacagatgaaacaggaattttaaaaaatttaaaaatgtataagcaaaaactcagttgtatgtaagaaaacccagttctccctgaggaagagaaagagttgaagtccattaaaaattaactgcctgtttttctgcggctaataagccttgtctcttcctttcccaagcattataaaaactctgcttctctagctatacagctacaaagtcactaggcaaataatctcaaatcataaaacatattattccttaaaaaataaaaaataatataatgcatgtgtcaattaaacaactgtctttgtttctcacttctatgatatacttccccctacacagagctccccccgccccagaaaatacttaaaaaataaccaaactctttgttcaaaactcggtcctttaaatgttaatccgacggggtcggtacaaataaataattaaataattcctcctcaacccctcggtgtctctaattccttaattatccctctacacagaaaccaatccttttgccccaaggcagatcctaatgaggagaaaagatctggccaggctgctgccactctgtgacattgtacactgggcttggctctggctgagcgggagcccctgtgggagtgtgttcctgaaaatcacagggatcctgcaatgccggctatgaaatttcaacataccccagcccttggcagaggtaataacaaggtgtttcacagcagcttagggtagaaaggaggagataggggcataggcagtgaccaggctcagctctgtgtagcgttcatttcactctcatggctttaaaaagaatcaaggccgggcgcggtggctcacaccggtcatctcagcactttgggaggctgaggcgggtggatcatgaggtcaggagttcaagaccagcctggccaagatggtgaaaccccgtctctactaaaaatacaaaaattagccgggcttggtgggtgggcgcctgtaatcccagctactcgggaggctgaggcaggagaatcgcttgaacccgggccacagaggttgcagtgagccgagatcacattgctgcactccagcctgggtgatagagtgagactctgtctcaaaatattaataataatcgtcatcatcatcaaaataggccaggcacagtggctcacacctataatcccagcactttgggaggccgaggtgaatggaccgcttgaacccagtagttcaagatgaacctgggcaacaaggcaaaaccccaactctacaaagagtagctgggtgtggtgctgcacacctgtattcccagctactggggaggctgaggcaggagaaacacttgggcctgggaggcggaggttgcagtgagccgagataacaccactgtactccagcctgggcaacagagtgagaccctgtatcaaaaaacaaacaaacaaataaagaatcaaaatacacccatcccccacttgggggaattctcaaaacaccatctcaaattcaaacagccaaggaagggatgtgcatttaaaaaaaaaaaaaaaataaggtaccacacataaacatggccgagaaaagcacttagcatttggatggccaacaggtatatgaaaaggtgcttataggaaaaggtagtcggccgggtgcagtggctcacgcctgtaatcccaacactttgggaggctgaggcgaacggatcacgaggtcaggagttcgagaccagcctggccaacatggcgaaaccccgtctctattaaaaatacaaaaattagctgggcatggtcgccaatgcctgtaatctcagctactcaggaggctgaggcagaagaatcgcttgaacctgggagccggaggttgcagtgagccgagatcgcaccactgcattccagcctaggtgacagagtgagactccgtctcaaaaagaaacaaaaaaataaacaaagaaaaggtactcaacatcactaatcatcagggaaatgcaaatgaaaaccaccatgagctactatctcacaccagctaaaatggatattgtcagaagggtgtttttgtttgtgtttttttgttttttgtttttttttttctttgagacagagtcttgctctgtcacccaggctggagtgcaaaggtgtgatctcagctcactgcaacctccaactcccaggttcaagcaattctcctgcctcagcctcctgagtagctggggttacaggcccctgccaccacgctcggctaatttttgtatttttagtagactcgaggtttcaccatgttagccaggctggtctcgaactcctgacctcaggtgatccacccgcctcggcctcccaaagtgctgggattacaggtgccagccaccacgctggccagaatgatgatttctacagttaattacaagtgttggggagggtgtagagaaaagggggcccttgtacaccactggtgggaatgtcaattagtacagtcactatgaaaaacagtacagaagttcctcaaatcattaaaaataaaagcaccacataattcagcaattccactgctaggcacagactcaaagcaaatgaaatcagtgtatcaaagagatgcctgcattcctatgtgcattgcagcactattcacaggagccaagatatggaaacaacctaggtgtccaacaacacacgaaagcataaagaaaatatatatctatacctgatggaatactatgcagccatgaaaaaggaggaaatcctatctcctgcagcaacacagatggaactggaggccattaccctaagggacataactcagaaaccgaaagtcaaataccattcttcttaggtcgagtccaatttgctgggtccgactcgcagactttggctgagcgacggatgaacaaatgcactcagacacagatttccagtgaaagcgtgggctaggggatggggccactcacagacactgaggagggtgttttaaagagtcagcagccacggctttgacaagctgctgctgtgggcctttatttagtatacatttaatgacaaaggccttgagtcaacacattcgtgggcaattcatatggtcgtcccccgcaacccggagagagggagagagtagttctgtgcgtggatgattaaaggccaggttctgaggcctaagcaaactaacttatctagatcagtttctttacatcccctcgttatctaacctaagctttcaggcactggataagagaatctggctgccttcagccaaatcttattcgggagcatttgcaaaaccttctggcctcccaagaaggtttgcatcttctacaatttttcctaccaccctgaccgacctcctacattcttacttataagcaggagctaaataatgtgtccacatggaaagagtggaataacagagactggagactcagaagggtgggaggtggaagaggagcaagggatgagaaattacctctcgggtacaatgtacgtgattcaggtgttagctatactaaaagcccagacctcaccactacgccattcatccatgttaacaaaactgtacttgcactccctacctgtatacaaatgaaaaataaaataataaataaataaaaggacagagcattgagaatctagatggatattagaaagttgtgtgcacaccttccttagtgtgaacagacagaaagagcacaccagaatttggtctagcacctggtcgaaaatcttaagggcaagcatattcctgtttgatttatctttttttctttctttcttttttttttttgagacggagtcttgctctctctcccaggcagtcccagattcaagcgattctcctgcctcagcctcctgggtcattgggattacaggcacatgccaccatgcctggctaatttttgtatttttagtagagattgggtttcaccatgttggccaggctggtctccaactcctgacctcgtgatccacccgcctcagcctcccaaagtgctgggattacaggcgcgagccactgcgcccggcctgatttatcttaagtcaagaactcccaaccagcagaggcacctcctggcatgtgccctggaggtcaacaggaaaggacaatggctcctgttccctggggaacacacatttgagtaagagtgcaagctaccagcacatctgcatgcctttcctagcagatgtcagagctgagtgatgctatcttcgccttgccttgaccatctcctgctctaggatggggccagaaatccccaaaagaagagtgcaaaaatcagagccatctctcccaaatgccacctggcacgtgactgaagctcagccatgaaccacgcaaacgacctgtcccaaggaaaaaaaaaaacaaaaaaaagccattggagtatctctcggtacctttgtcgttcaaggtttcttcttttattttgcttacaacttgtttggctttgctgtcattatttccagctaaaaggaaaaagaaaaaaaagatacggtgacttgtaggattatccagaaactattaactgcaaaaaaaaaaagaggttttaagagaagtataacacaaatctgaaatgtgcctttgatggactttccctttatcctagcgtctaacttgacagccattttggcagactaaagctatccatttaagagtcattttctttagcctgcattggcaaaaagtacaaatgcatttgacattctacttttcaatagtgacagggacccggggcacctgctggtgtaatttgcacgtgagagctgagaatagcataagcataaaaaatgtgcattaaaatgtcaggatggaaacgaattttcgaaggagcttttatgctggaaacatcccagtgtgcacacacagactgcacgatgcacgtgatcacagaccgtggttcctactacgtgctcaggatttctttctgtttcttttttttaattctactttaagttctggggcacatgtgcggaatgtgcaggttggttacataggtatacacgtgccatggcagtttgctgcacccatcaacccatcatctacattaggtatttctcctaatgctctccctgccctgccccctcaacccctcgacaggccctggtgtgggatgttcccctccctgtgtccatgcgttctcattgttcaactcccacttatgaaggagaacatggggtctttggttttctgttcctgcgttagttggctgtgtgctcaggatttcttactcctctcactgcacttccgtaaaactctccaagtgaggtttcaggaacacgcctttagaaggatggaaagaggtgttttgcttgttatagctaaaataaagactaggaaatccggggtgaaagaatgttaattgggtttttttgttttgtttttttgttttgttttttttttgagacagaatcttgctctgttgcccaggctggagtgcagtggtgcgatctcagctcactgcaacctccacctctctgattcaagtgattctgctgcctcagcctcctgagtagctgggattagaggtgactgccactatgcccagctaattttttcgtatctttagtagagagggggtttcaccatgttggcaaggctggtcttgaactcctgatctcaggtgatcctcccgcctcggcctccacagtgctgggatgacaggtatgagccaccacacccggcctggtttctttaatgtcttaggaagtgaacatgcgttgaacaggagactatagtttgatgttgtcttcgtcattttttcaaatgtctttgacccgggaggttggattttaaggtgtttctgaaggggcggctctttaggggaaaggagtttggcaaatttttcctccttcagcctcatccttcattaacctgttggcaacatgtgggattagctgctttccagggtgagccaagcccaaaactccctttcagggagggtcacggaaaaagtgttgagagaagggagatgagaactagcaggggaagcgcacaggcttgaacaagaacgtcttgggtgcccggagagcttcaaacagctgatctgcaaggagcagttaccaagggggtggggccggtctatctccatcctacctgcacccagcccgggccagtgaggtgttctgtagtacagcaccgtccccgggtctccatgaaaatacattaccaaataatccctctctttggcattcctgaatactgagtcaacacggcgtattgaatttacacactctaacacaaggaagagaccatgctgtttgatatcctatcattgtattcggtattctttcttctgtgttaaggccatgggctcccaaattaactattagaatgcacttttcaaaaaacaatgaaaatgttttcagcaaagagtgaaaaaatatataaaagaggagaagcagtgaaacttatgaagttggaaatgtttttggctccagtgggagacggctaagataaatagtgcaaagtccatcctttggggcagagtaaatggaatatctaaattgtcacttccttgaaggaattcaaagttgcagacatcagaagactgaagctgcaaaggtaatttgcacctttgacttccttaaagaaacagaacatgataccattattacatttttgctttgacagtcctttggcactgaggaggcagcaggcatttcagggaggtgggtttcgacgggagggagaggaagaaatagcctgaaaggtatattccatctataaatgtcctatgcatcaaacacaaaacaaaaaaagaaaggataaaaaaattcaaagtcaaggtaacctttacactggggacttgtacattcatgagcttatttatgaaatcccatgaactttttaaatgtaagcactcatccactgctgggctgctctgccgtatcagccatctcaagatcaaagggtgcggccgggtgcggtggctcatgcctgtaatctcagccctttgggatttgggaagccgaggcaagcggatcacgaggtcaggagttcaagaccagcctggccaacatgaggaaaccccatctctactaaaaacacaaaaattagatgggcatggtgatgtgtgcctgtaatcccagctactagggaagcggaggcaggagaattgcttgaaccaggacccgggaagcagaggttgccatgaactgagatcacaccactgcactccagcctgggcgacagagcccaactctgtcccaaaaaaaaaaaaaaaaaaaaaagttagccagacatggtagcaggcacctgtaatcccagctactctggaggctaaggcagaagaattgcttgaacccagtaggcagaggttgcagtgagatgagattgcgccactgcactccagcctgggcaacacagcgagactccatctcaaaaagaaaacaaaacaaaacaaaacaaaaaaaaacaaagggaaacatgccggaagctgggacgaagtaagatgggagcctccaccttctcaagaaagacaaaagtgaccagaaaaagctgggagcatcaaaaaaagccaggtgaagtgattatttgggaagaccaccttcatgggcaggccattttccatggtggcaccgtcaacgctggcataggacagaagcaccacactggaggaatggagaaggtgaggtggcacgtgcggtatcttctttggccaatgtcaccttcagcaattgtctcctcagacctggagggagctgctttaaggaactggacgtgggacatttggcctcatatgcatttgctggagtggttcctacatttgctgagcaagtactgcatatgcagaaacaccgcacacgtcccaaacacagtgcatctgccttctgcttcatcctttgtatttgggggggcaggggagggcgttacatgttatatgtgcaatggaaattggtatagccattatggaaaacagtggagatggggtttcactatgttggccaggctggtcttgaacgcctgacctcgggtgacccgtttgcctttgcctcccaaagtgctgggatgacagacatgagccactgcacccggcctggtttttttcacatcttaggaagtgaacgtgcttggacaggagactatagtttgatgttgtcgtcatttttttcaaatgtctttgaccagaaaggttggattttaaggtgtgtctaaaggggtggcctttttttttttaagagttcctcaaaaaatgatcattatgcctaccataggatctagcaatctcactcctctgtatagatccaaaggaaatgaaatcagccccttatagagatatctacacccccatgttcgttgcagcatgattcacaagagccaagatatgaaaccaacctaagtgtccatctaaggatgggtagataaataaaatgtgggatagctacaccatggaataccattcagtctttgaaaaccagaggaccctatcctgtgatacaacatggatcaaccaggagtacatcatgttaagtaaaataagccacataaaaccaaatcccacatgatctcacccatatgtagagtctccagaagttgaactcacaagaaaaagtattatgatgattattggccaggcgtggtatctcatgcctgtaatcccagcactttgggaggccaaggcaggtggatcacaaggtcaagagatcgagaccatcctggccaacctggcaaaagcctgtctctactaaaaatacaaaaattagccgggtacggtggcatgcacctgtagtcccagctactcaggaggctgaggcaggagaatcgcttgaacccaggaggtggaggttgcagtgagccgagattgcgccactgcactccagcctggtgacagagtgagactccatctcaaaaaaaagaaagaaagaaaagaaaaagaattatggtgattaccaggtgctaggggggtgggttgctgagattttgttcaaatgacaccaaatgtcagtttgacagaaggtataagttcaagagatctattgtacttaaggtgactaaattagtgactataatcttgaacctgactataattagtcacagtgactataattaatatttgaaaattgcaaagagagtagattttaagtgtttccaaaaacacacacaaaaagaaacatgtaaggtaatggatatgtgaattagcttgaattggccattccagatggaaacatatatcaaaaccacattttgtacaccataaaaatatgtaacttgtttttgtctattaaaataagtaaatagataattaaatacaagtttaaatattttacacgtttcacatgtactattcatggacaatacaaagtatatgtggcacaagtcatttttaaaagacagttgcaatttagataacctaaccaactagacttcctgtgacctacaaaactagattttatgatgaccaacgcaactacacctcatcatactctaacccaactaaatctcattaggactaaccaaaatacacctcatcataacttaacccaaatagatctgattataccctaacccaactagacctcatcatgacctaacccaactaaatctcattataacctagcccaaataaacctcaacatgacctaatacaaacaggtatctttatgaccaacccaaatacacctcatcataacttaactgaatctcatcacaaccaacgacactagacctcataacctaaccaaactagacctcatcatgacctaatacaactagatcacatcatgaccaactcaactagacctcatcatgacctgacacagctaaatctcattataaacaagcccaacaagaactaatcatgactgactatgactagatttcatcatgaccaacccaactacctcatcgtgacctaactaactctcatcatgaccaacccaactatacctcatcataacttaacccaacttaactacatcataacctaactcaacaagacttcattatgacctaatacaactacatctcatcaaggccaacaaaactagtcctcatcatgacctaacaaaatctcatcatgaccaacccaaatagacctcatcacaaccttatccaagtaaatctcctcataccctaacccaactagaactcatcatgacctaaccaaactagacttcatcataacctaaccaaactagacctcatcacgacctaatacaactatatctcatcaagaccaacccaactagaccttatcatgacctaattatatctcatcatgaccatccaactagatctcctcatgacataatccaacaagatttcatcataaccaaaccaactagacctcatcataacctaacccaactaggtctcatcatgacctaatacaactagatcccatcatgagcaacacaactagactgcatcataaacaaattacatctcattatgacaacgaactagatcttatcataacctaacacacctgggtctcatcatgacccaatacaagtagatctcatcatgaacaacctaccagagctcatcatagcctaggccaactagatttcattatgacctaatacaactaattctcataatgaccaatcccactagacctcatcatgacctaaccaaactggacttcatcataacctaacccaactagacctcatcatgacatgagacaactagatctcatcacgacctacccaactagaactcatcacgacctaactagatcacatcgtgaccaaccaaacagatcccattataacttaatccaactagatctcatcataacctaatacaactagatctcatcatgaccaatgcactagacctcatcatatcctaccacaactagatctcatcatgacctaatccaactagatctcatcataacctaatacaactagatctcatcatgaccaatgcactagacctcatcatatcctaccacaactagatctcatcatgacctaatacaactagatttcattatgaccaccgcatctggacctcatcataacctaactggatctcaacatgaccaaccaactagatctcatcataacctaacccaactataactcatcatgatctagtacaactagctctcatcatgacaaactcaatgagacctcatcataacttaccccaactacatcacatcatgacctaatacaactagatctcatcatgaccaaccaactagatatcatcgtaatataattcaattagatctcatcatgacctaatacaactagatctcataaagaccagcccaactagacctcatcataacctaactcaattaaatctcctcataccctaacccaactagacctcatcatgacctaacccaactaaacctcatcataatctaacccaactagacctcatcatgactgaatatgactagatctcatcacaaccaacccaaatagacctcatcataacctaattagatctcatcatgaccaaccaactagatcgcatcataacctaacccaaccagatctcatcatgaccaacccaactagacctcataataacttcacccaattagatcacatcataacctaatacaactagatctcctcatgaccaatctaactagacctcatcagaacctaactagatctcatcatgacctaatacaactagttctcatcatgaccaacccaactagacctcatcataacctaacccaactagatctcatcaagacctaatacaattagttctcctcatgaccaacccaaccggacctcctcataacctaactagatctcgtcatgaccaaccaaccagatctcatcacaacctgacccaactagatctcgtcatgacctaatacaacttgatctcatcctgaccaacacaactagtcctcattatagcctaactaagtctcatcatgaccaatcaactagacctcatcagaaccttacccaactggatctcatcaggatctaatacaactagatctcatcatgaccaacccaagtagacttcatcataacccaactaaacttcattataacccaactagacctcatcattatctacccttcctgaggactgtacaagagatttcttatattggaaaaaagcagtataatttcctcttactaaataaaaagattttgagcccaaaccagagtcaccaatctgcggctaaacctggcctgcagctggatattgtacaaaaagttttacagcaacatagactttcctgttgttttaagtattacctatgggtggttactcactactagggcagagctcatagttatgagagaaacatatgaacacatttattatctgtctctttacagaaaaagtttacccaccccactttcatcttagatgacagtccattgagcattatgaaaaaaaatgatcccccaccaaaataatattttgaaacaatgagaactaagatcttgtggacagatgggaatttgaacaactgatatatgtgtctagtaatattaatgtgcttcagttggacccaggttataatctgaattattttacaagtaattgattattctttaaatattaataaatttttaattaaaattttgaagttaaatttcccatctcttattttgtatttaatataaaattcattgtgttcaatgatattttttcattaattgactttgaatcaaactgccatacaaaatgaaaaaatgcctctctcagaatatatccaattatcctcaaagtcacacaggggaaataagactgcataattgattggattgacctgaagggtcaaaactgtaactcacagtgaaaattaaacactgacatcaggagctctgtgggataggagacacaggtggggtgcagatgtggtgtttactttctgtttatctcaagaaaaaaggcacattggtgctgacatatactgctcctgatgctcagtaaacatcatctaaatgaagtggtaacacttgagattcccatgcacatgaacaagaagcttgctcacatgtcttcattgctttgtgcctacaaagtcctcagtcaactagacctcactgtgacctaaccaaaccacacatcatcatgatctaactcaacctgtcatcatgatctaatccaagaggactttattgtgttctattcaactacctcatgatgacataacccagctggaccttatcatgacctaatccaactagaccttatcatgacctaacccaactagacctcatcatgatctatccactaggcctcatcatgaccttcctaactagatctcctcatgatctaacccaattagacgtcatcatgacctacccaactagacgtcaatgtgacctgacccaactagaactcattgagtcttaacccaactagacttcatcatgacctagccaaaccacacatcaccatgatctgatccagctagatctcatcatgctattactgaagtagacttcattaagacctaattaaatcacacctcataatgatctaactcaaccagtcatcctaatctaatccaacaagatttcatcacattctactcaactacctcatcatgacatagccaaactaaacattatgatgaactaatacaactagacttcatcatgacctaaccaaactgtaccttaccatgatctaatacaaccaaacctcatcatgacttaatacaaatagacctcatcatggcctacccaactagacctcaatgtgacctaactcaactacatttcatcaggacctaactcaacaagacctcatcatgacctacccaattagatctcaaagtgacctagcccaacaagatttcatcatcacctaaataagtcacacatcatcaagtctaatccaactagatctcatcatgctgttactgaactagacttcattaagacctaatcaaaccatacctcataatgacctaactcaaccagtcatcatgatctaatcgaacaagacttcattacattctactcaactacttcatcatgacataaccaaaggagacgttatcatgatctaatacaactagacttcatcatgaccaaaccaaactgtacctcagcatgatctaactcaaccagacatcatcagaacctaatacaactagacttcatcatgacctgcccaactagacctcatcatgacctaaaccaccacaatgaggcaaaaaagcacaaagaaatggggtgttttcttcctttcctagtttgattaagaattaaactaataattaaacattgcctagctaaattaagaattaagaagatgaaaaagatcattgcactggaggagacaaaagatcaaatataaccagtaatggatgtgagccctcccatctttgttcaaccttgagggtctctcttcatcctactccaccatcattgaagccactaggctcacatccagccaaccttcagagaatacctattgctctccctgttcaaaaaatcagcatcattttgacccagtcatctcaaatattggcagaagtctgagatatagaaagtcctggaaagtttgtcatgttgttaatgatacagcagatatccacctagcatggatggtcaaaaccaagggttgccatccatcaccacctcacagtctccaagctaaatctcagaaccccccctgccctacatcttgtctctaatttactcaggtcccagggagatgtaaacagatcatggaggtgctcaagttcataagaagttctagaaatacactctcagatgggcaccctctcccctggggtctcctcatctaaacccaatccttttgcatctagagggggcgcaataaactgaatgtttgtatccctccaaagttcctatgttgaaattctaacatccccagtgattctgttgggaggcggaggctttgcgggatgattaggtcacgagggtggagcacaatgaatggaattagtacccttataaaagagaccccatccaggttccaccatgtgaggacacaggagaaagtggccatccacaacctagaagacagactacaccagaatctgaccacactgaccccctggtcttgggacttccagccttgagaactgtaggacaataagtttctatggtttattgtggaagtcagtgtggcgattcctcagggatctagaactagaaataccatttgacccagccatcccattactgggtatatacccaaaggattataaatcatgctgctataaagacacacgcacacgtatgtttatagcagcactattcacaatagcaaagacttggaaccaacctaaatgtccaacaacgatagactggattaagaaaatgtggcacatatacaccacagaatactatgcagccatcaaaaatgatgagttcatgtccttcgtagggacatggatgaagctggaaaccatcattctcagcaaactatcgcaaggacaaaaaaccaaacaccgcatgttctcactcataggtgggaactgaacaatgagaacacatggacacaggaaggggaacatcacacaccggggactgttgtggggtggggggaggggggagggatagcattaggagatatacctaatgctaaatgacgagttaataggtgcagcacaccagcatggcacatgtatacatatgtaacaaacctgcacgttgtgcacatgtaccctaaaacttaaagtataataataaaattttaaaaaaaaagtttctatggtttgcaaggcactcaggctacagcagcccaaacacaccaagacaggagagttagggacatggatgaacttgacaatttcaagaaattgtcataaagttttaacttgtcccagtctattaagagaatgaggccgggcgcagtggctcacgcctgtaatcccagcactttgggaggccgaggcaggcaaattacgaggtcaagagatcaagaccatcctgacctacatggtgaaaccccccctctactaaaaatacaaaaaattagcttggtgtgctggcacgcgcctgtaatcccagctacttgggaggctgaggcaggagaatcgcttcaacccgggaggcagagtttgcggtgagctgagatcgcgccactgcactccagcctgggcaataacagcgaaactccatctcaaaaaataataataataataataataaaataataaaataaaataaagagaatggggccgggcacagtggctcacgcctgtaataccagcattttgggaggctgaggcaggtggatcacaaggtcaagagatcgagaccatcttggccaacatggtgaaaccccgtctctactaaaaatacaaaaattagctgggtgtggtggtgtgctcctgtagtcccagctactcaggaggctgaggcagcagaatcgcttgaacccgggaggcggaggttgaagtgagctgagatcgcgccactgcactccagcctgggcaacagagtgagacttcatgtcaaagtaaaaaaaaaaagaatggataaaaaaaatgctcaagtgggagttaggcacaactttgaggaaaataactgcttgatggaaagaaagagactgatatagaccaaaaagtgctcacctgcttccgaagctcaacaagtcattaactaatccaacaagatttcattatattctactcaattgcctcattatgacatagccaaacacgatgttatcattatctaatacaactaagcttcatcatgtgaaacagtacacatctctgtatactattttacaaaccctgaagtgcatcagagaaagatggttatatgaggaatggaactgcgtgtacaaaattattattttaaaagactctgggcacagtggctcacacctgtaatcccagcactttgggaagccgaggcaggcagatcgcttgaactcaggtgtttgagacaagtccaagcaacatggtgaggccccatctctactaaaactacaaaaaattatccaagcctggtggtgcacgcctgtggtcccagctacttgggaggctgaggtgggaggatcgcttgagcccaggaggcagaggttgtagtgggctgagatcacgccattgcactccagcctgggtgacagagtgagacgctgtctcaaaaatgtgaaagttgggaagagccatgacatagaaaaatttcaagttttgcattcatgttttgcaaaagccaaaaaggctcaaacttaagtgaaggacggagcaaggagccatgtgcgctgacatggaccacgcatctccagggagaccagaaggccacatgggctgaacatggggtttccccatctgagtcaaagactcctggggattcctgcatgaaattcaggaggttagcatcagcaaggttagcattttcttcttttgtaaatgaagatgagaaaacacagaggtgtgggcagcagccgtgcatttgccccagcagaaactgccatggagatttttggagagagctaactcaaagccaagtggatggccatcgaggctcagaacgctagcagctattgaaacgcatgaggcccaggaccagagcagctatttaaacgcatgagtatatcacagtttttatcgtatagatgtaatgcatacaatgatgtggagagttcattttttccttataccttttatctgcatgtcaacttcatcgattcgtaacatgatgacttttagcctgtccaatgagcaccaacagatgtccagaggttcaaggcctggaaagactctttgctgagccctggtcaccagatcagactcatgctcttatgcttgagccttttgggctatcgcaaaggcattcaaggcccagaaaagtgtctgtcctggacagagctcctcaaagataaggaagaactgagacaaattcatgttgaaatctccagccctaagcattgtttatgatccatgatcatctttccataatgacaacaagggaaagaaggacagagaatggcggagaggaagaagtcaatcaataatgggcattggttttggaaagtctttttttgagacagagtctcactctgtcacccaggctggagtgcagtggcgcgatctcggttcactgcaacctccggctccctggctcaagcgatgctcccgcctcagcctcccgagcagctgggattacaggcatacgccaccatgccgagctactttttgtatttttagtagagacggggtttcaccatgttagccaggatggtctcgatctcctgacctcgtgatctgcccgcctcggcttcctaaagtgctgggattacaggcatgagccactgctcccgtcctggaaagtgttaagtcaatacgatcctgcatatctcaaaccagacctacagtatgatgtttataaaagcagacaccataaaagttattaaaagcaaagggtgcccaggcctagtggctcacacttgtaatcccagcactttgggaggccaaggtgggaggatcacttcaacccaggagttcaagaccagcctgggcaacatagcaagacccagtatctccaaaacattttgtttatttttttgagactgagtctcgctctgtcacccaggctggagtgcagtggcgtgatctcagctcactgcaacctccgcctctcaggttcaagcaattcacctgcctcagcctcccgagtagctgggactacaggcgcccaccaccacgcaggcactcacccccaagcccagctaatttttgtgtttttaggacagtcagggcttcaccatgttggccaggctggtcttgaactcttaacctcaagtgatctgcccaccttgacctcccaaagtgctgggattacaggcataagccaccacgcccagccgccaaaataacttttttaaatgagccagggccaggcacggtggttcatgactgtaatcccagcgctttgggaggcggaggtgggcagatcacgtgaggtcaggagttcaagaccagcctggccaacaaagcaaaaccccatctctactaaaaatacaaaaattagcagggcatggtggcgggcgcctgtaatcccagctactctggaggctgaggcaggagagtcgcttgaacccaggaggcaggggatgccgtgagccgaggtcgtgtcactgcattccacctgggtgacagagcaagattctgtctcaaaaaaaacaataataaataaataaataaaatgagcttggcatggtggtgcacgcctgtcatatcagcgactcatgaggctgagtcaggaggattgctggagcccaggagtttgaggttgcagtgagctatgattatgtcactgcactgcagtctgggctgacagagtaggatcctgtctgaaaataattaattaaatgcagatagtgtcaagagtgggcataatacacattaaggcttttatttttccaagctcgtctccacacatcatttaagctagctgatttagacttccccaggtatgcaatagactctctcccctcctccccgccccccactccgtctccattggcagtagtggaatgggttaatttgaactgtcctcatattcccagttgaagggagacctgaagaggtcacagaggaagaggagtcagagatcacgataagcttttagagaaattttcaaaaagaagagcagaaatcaaaccgtgagtgtctataggtcatggttgcagaagaaacaagtatcccgcaacattgttcagattctgttaggagcttgtgtttgaacaaaattcataaattgaagtcctaaagcccagggcctcagaatgtgactgtgtttggaaataaggtctttaaagtggtgattaaggtaaaatgaggtcaccagagtgggccccgatctaattgaactggtgtccttataaggagagcatatgaggacacggacacacacagagggatgaccctgtgaggacacagagagaaaccaaggagagaggcctcaggaggaaccagccctgcccacacctggatctcagacatccagcctccaggactgtgggaaactcaatgtctgttgtatataagctgcccattctatggtaattctgttatagcgcctgaaatggactaagacatctcaggagaagaggagatgaaaacacacagagggacgaccctgtgaggacacagggagaagatggtgtctacaagccaaggagtgaggtgtcgggaggaaccagccttactcacactgtgatattgaacctccagcctctggaattgggaggaaccagccctacttacactgtgatattgaacttccagcctctggaattgtgaaaaataaattttggctttttaagcaacctccagtctccttgagatactttgttataacagccctagtaaagtcataaagatatatggttatttttttccagtaaaccatgtgaaagaaacacaggatcaatatttaagcagaatatatatctacttccaaaagggtacaacaattttctgtgttttctaggttgtgaatatcaccttcatgagctttctggatctgactgaattttctatatgcacatcaacatttgcatacatgtctgaatcgacacctaagtagctcacattaggtataagacacaactaactctgccaggcgcagtggctcacacctgtaatcctagcactttgggaggccacggcaggcggatggcttgagctcaggagttcaagaccagcctggccagcatatggaaactctgtctctactaaaaatacaaaaattatccaggcgtggtggtgcatgtctgtaaacccagctactcgggaggctgaggtaggagaatcactttaacccaggaggtggaggctgcagtgagccaagattgcaccactgcagtccagcacgggttgacggactgcgatcctgtctcagaaaaaaaaaaaaaccgaaaaaacaaaaaacacaagtaactgtaaaagtcatcacctatgataacatgcatgccaagtctcgccagatgcttcgctgtagaatagccaatgccatctgtccctcccgtcactatagcgacacggtcaggtcgtggggggaaaactgaaaaagaagaagagaaaatcatcaaactaagatttgaaagcagagcacatatttgtaagaattaagcctccagagaggcaagatgccaaagggagttatggttcatttatttctggttctgttcctcttgaattcccacaggctcaggaggcatgaatgtattaaagtggattcgcccccagtaatgacagtgcagtaaaaaaccacctgataaatcccctgtcatcccctgtgagtccctggcaggctctgcaatatgccgtcagtgtgaccggcagaaaggtctgcagaacggataccctttacagaggcgagcaagaatcctggaataacctctgctctcagggcagcactgagcaggacatttttgttcgtttgcgttgtaaaatgtagactttattatgatgtaggtatggtggggccaacagatcaggagactgccgttaagcaagtggtttgttactcacaggtcccaagaggaggggcgtgttgacaccactcaggaccacacaggggcgcaccaagtttggtcaggtgggaagacaaaggagaccagagctctcactgtggtttccaagggaaggaacaggcgagtaggcttacagttggctagtgtgaatgatttcagcaggctctggggcataggggctgtccctgactctctggtacctggctttggggtggttagggcaggtggagagtgacgtggaatatgcaaccccaataaaggagatggctggggggtggattctggattgatgggtttgcatatgaaagacaggttcataggtgggctcttcaccacctctggggattcgctagctatgggaggggcagggtctctagggttgacaaggccatgaaagtcatgcatcagaacacagaaaataaaagacttggttaatacagtttgcttcatagctgctggtatcacacgtgcagatagcatctcacttgaatttctggttaagacgagtgatccacattttgagggagatttgtatttctttttcttccttccacttgtcctcccttccttctctccatctttccttccttccttccctctttccttccttcctccttccttctctttttcctttcttccttcattccttccttccttcattctttccttccctccctctttccttccctccctccttccttccttccctccctctttcctttcttcattccttccttccctccctttttccttccttcctccttccttctttccttccttccttccctctttcttttcttcattccttccttccctccctctttccttctttcctttcctctttccctcctttcttctttacttccttgtctcactccttctttcttcttttcctttttccttccctccctttccttcctttctccttccatcctttcctcttcacttctttctctcactttttccttccttccttcccttcccttcctttcctctttacttccttctctcactctttccttccttctttccctctttccttccctccctctttcctttctttcctccctctttccttcctttcttcctccttccttctgtccatcttctaacccttccctccttcttttataaaatatgtgtagagcccacactctgtgcccagcatacagggaaatgaattagacaaagataaacatgttgtctgcctcaaggacatttggttcccctgggaaagataccaaccactctaaatacacagatgtgtctggcaataatgcagaactttccagatctcacatcttccagttatgaatgaacttcaaaggaagaagaggaaagggagaagcagtgattctggacggagggttagagaacaatcttccaaggaggggctcctgagctgatgttgtgacggtgagagcaaaagtctagcaggcctgggatattccaggaagaggaaggcggctggctggctagctggagccaagcacatggaaggagggaagagaggagggaagaaggagtaggggcaccccagagttcgtgagcttctctctggcagacagggcgtcatcacggggctctgagccaatctgtgatatgtttcacaggaaggaatagattcatggagaatccacttgagctggaggaagacaaggctatcaagggtctcctgaagcagctgcagggactgacgggggagctccgccacagttcagcacaggtggtatgagaggtgctggattcagaatatgtctcacaggtactggccacaggggtgctggtgggagtcagacttctcgcgttcaaaataaaaagaaatcacaagacaaggacagagagggggacatgatgaggcaagaatgactccttgtactgggggctgagaaaattcaaggagggaatttccatgaattcccttgagaaagaaagactgagggaaaagtggattttgcaggcaggtagtcaggaaagtccctttctgtgaattattataggcacatatgatctttttcaagttaggagattattttgttcaacatatttggaatgttctttattaaaatataaagcctaagtgtccaccatcagacaatttgattttttaaaatatggcacatatataccatggaatactacacagccatgaaaaggaatgatgttgtgtcttttgcagcaacacgaagggaactggaggccattatcctaagtgaaatggctcagaaacagaaagtcaagtaccacatgttatcccttataagcgggaattaaataatgtgtacacgtcgacatagagcataaaaaatagacatcgaggactcagaagtctcacagggtgggatgggatgagggatgagaaattacctattggctaccatgtacgttatttgagtgatggcctcactaacagcccaaacattaccactatgcaatatattcatgtaacacaagtgtactcatacccacaaaatctataaaaatacaaaggtaatttaaatagaaataggtttataaatcattccactataacgacacacacacgtatgtttattgcagcactgttcacaatagtaaagacttggaaccaacccaaatgcccatcaacgatagactgaataaagaaaatgtggcacatggacaccatggaatactatgcagccataaaaaaggatgggttcatgtcctttgcagggacatggatgaagctggaaaccatccttctcagcgaactaacacaagaacagaaaaccaaacaccacatgttctcactcacaagtgggagttgaacaatgagaacacatggaaacagggaggggaacatcacacaccagggcctgtcaggaggtgagggactaggggagggagagcattaggacaaacacctaatgtagatgatgggttgatgggtgcagcaaaccaccatggcacgtgtatacctatgtaacaaacctgcacgttctgcacatgtaccccagaacttaaagtataataaaataaaataaaacaataaagcctatgctgcttttccatttcacctttccaagtataaaatgttgtgtctcctctccccccaaaataattcctatgttgagaacatacaatcgccagggtgatggtatcaggaggtggggcctgtggaggaggcttcaacatataatctgttatttgtcagcccgtacatttcgttgtcagtattgtgcgaacaatcctcttggtgtgtaagactttcattttgtttttcttgatacacgcatgaatcgatgaaaaggtatgttcacttagaaaattgccgaataagttttccatatgcttaggttttctggtgtatccctcgtaacctgaagatagaacctgtacaatgacattcccgtgttcctgacccaagctgagggacttgcaaatactatatgtagtatcagtagatgtattgatgttcttaatttactaagtttattttaaaaataggaatgtattattaaattgtaattacagacacacagtatgcatatatactgtgtatgtatacatgtgtgtctgtgtgtgggtgtgtctgtgtgtgtacatacatatttctcagccccaatgccaacttcctagtcaataaagaaatctctaaaatcttccagctaaacttggaaaagcagcaagtatccatcctgttctctgtgatgcttttttttttttttgagctggggtcttactacattgcccaggctgcagtgcagtggtgcaatcatggctcgctgaagcctcgacctcctggactcaaatgatcctcctgcctcagcctcccaagtagctgggactacaggtgtgagccaccacacttggctaattttttttactattttttttttgtaaagatggggtcttgctgtgttgcccagaccggtcttgatctccggggctcaagtcatcctcccaccccggcctcccaaagagctggattccaggagtgcaccctgtcatttaacatgctactggagatcttatccaacatggtcagacaaataattacaacagacacaagaacggcagagggagagtcaaaatatactttgcagatgatatgatggtatgccaggaaaaaactaacaaaatcaacattaaataaatccaagaagagaattcaggaaggtagtcagatagaaaactcagaagcaaatatcaatagcttccatacatacacaaacaattggcaggttaaaaaggtaggggaagagacagtcctgcttataatatagaaacaacagcaacactgaaatgagacttggtcatcgagagtgtgcaaaacctatatcaggaaacctaaagacataaaagtagagttgaggccatggaaagatgccctcgggtctcggtgaggatgtcatgccacatggttttggaggtgcccgtggggtcttccctgaaaacgcacagtgagccgtgattgtgccactgcaccgcagcctgggcaaggtagcgagaccccagctcaaaaaaaaaaaaaaaagcatcacagattgcagaatggacccttgctgcatttgtaactttagctagaagagtttagtgttttccttacggaccaggaagctggcattggggctgagaagtatgtatgtacccacacagacacccccgcacacaacaggttgcaacaatcgcctgacaccagccacccggtgcctctgcagatggggaacatgtttcgcaagatcgggcttcctcagggttttgggttttcacagccaatgactcggcatgaccagagaactggctggacgctccttctacccaattcctcgccgtctctttcttcacaggtgtgaggcacctacaccatcacctgcaagccttcctccactcttctgccagcgcctgtttgacccttcacacacagttcccctagtaaatctctggcccatcatgttccttcttggtgtgtgcttctccaaagacccaaatgggtcaggcgcagtggctcatgcctgtaatcccagcactttgggaagccaaggcaggcagatcgcttgagcccaggagttcaagaccagcctgggcaacatagtgaagccccattgctacaaaacaaaaaaaaaggtacaaaaaaattagccaggcatggtggcacacggctgtcatctcagctacccgggaggctgagttcagaggatcacgcaagactgggaggttgaggctgtagtgagctccgatcataccactgcactccagcctgggtgacagagcaagactgtctcaaaacaaaacaaaaaaaagacggccgggcacggtggctcatgcctgtaatcccagcactttgggaggccgaggcgggtggatcacgaggtcaggagatcgacaccatcctggctaacacggtgaaacccggtctctactaaaaatacaaaaaattagcctggcgtggtggcgggcgcctgtagtcccagctactcggaaggctgaggcaggagaatggcgtgaacctgggaggtagagcttgcagtgagccgagattgtgccactgcactccagcctgggcgacagagctagactccatctcacaaaaaaaaaaaaaaagacaaaaaaaacccccaaactttgtccaatccggagttgacagacacctaagtttgattccatgtctttgcttttatgaatagtgctgcgatgaacacacagtacgtgtgtctttttggtagaatgacttactttcccttgggtagatacccagtaatgggattgctggctcaaatgttaattcaattcttaggaagacatggtgcatctataccatggaatactatgcacccattaaaaagaatgaaatcatgtcctttgcagcaatatagatgcaagaggaggccattctcctatgtgaattaacacagaaccaggaaactaaatatcagacgttctcacttcttactgggaggtaaacatcaagtacagatggacataaagatgggaacaataaacactgagcaattcaatggggcaaggaagggatggggcaagggttggaaaactattgagtgctgtgctgactacctgggtgacgggatccttgtgctccaaacctcaacatcacacaatatacccagggaacaaacctgcacatgtacccccgaacctaaaatagaagttgaggccagatgcggtggctcacacctgtcatcccagcactttgggaggccgagacgggtggatcacgaggtcaggagttcaagaccagcctggccaacatggtgaaaccgcatctctactaaaaatacaaaatttagctgggcgtggtggtgtgtgccacctgtaatcccagcgactcgggaggctgaggcaggaggatcgcttgaacccgggaggtggagcttgcagtgagctgagatcacgccagtgcactccagccagggcgacagagccagactccgtctcaaaaaaaaaattttttttaatttaaaaaataaaatagaagttggagggggaaaaaaaatctaaactgatacaatcctaaaggtgtcagaatgacccaagtcaatatgcaaatttgatgtgatccaataaagatagttcacagaatttcttttaggcaaactggacgaatcgattcgaaaattgctgtggggaaaagaattccaaatgaggcggcaaagaggaaaattctgatatgtacaaagattgagaacacaatggccctgtaggagattaaaacatttgagaagcttctataattaaacgggaggtactacaggcattaatggaggaaggaacagggtacaatttccaaaaataggccaactgcatgtggaaattgagtacacgacaaaaggggcaaaagatgggcgttttaataaaccgtgttggggcacgtgaagccacattaggaaacagataaaattagtgccagacctcatagcatgcatgagtgaactccaaggcaaaaacaaagttaaaccatgagaagattgcaagaaagcaggaatcattagtttaacctccacagaaagaaaatgcttcctaaacgaaaattcagaaagatggttagatagatttcactatttaaaaaactacttgtttaaaaaacaggccgggcagtggctcatgcctgtaatcccagcactttgagggctgaggtgggggtatcgcttgaggccaaaagctcaggaccagcctgggaaacagagagaggcctcatctctacaaaaaatttaaaaaattaaccgggtgtggcggtgcgtgcctgtagttccagcaagctgggaggctgagatgggaggatcacttgagcccaagggatggaggttgcagtgagccaagatcgtgccactgcactccaggaggaacaagacactatctcaaaaaaaaaatcacatggtaaaaaacaaaacaaatctccataagcaaagtaaaaaataaataatgagctggaagaaaatttgcaacttccatcagaaatattaacagctatttttcagatatctaaaaagttcaactccagaaaaaccccaaacatgctacaaagaaaagggcaaaaataagagtttatatacagaacaggctcaaatggccctcaacacatatgttctcctttatatctaataacagacatcctaattcagaccatattgaaatactatttcttttttttttaaagttctgggatacatgtgtagaacgcgcaggtttgttacataggtatacatgtgccacggtggtttgctgcacccatcaacccatcatctagcttttaagccctgcatgcattaggtatttgtcctaatgcgctccctctccttgttccccagcccccagcaggttctggtgtgtgatgtccccctccctgcgtccctgtgttctcactgttcagctcctacttgtaagtgagaacatgtggtgtttggttttctgttcctgcgttattaggctgagaatgatgccttccagcttcatccatgtccctgcaaaggacatgaactcatcctttttatggctgcgtagtattccatggtgtatttttctaaccttttcttttttgagatggagtctcgctctgtcgcccaggctggaatgcagtggcgcaatatcagctcaatgcaagctccacctcccgggttcacgccgttctctcacctcagcctcccgagtagctgggactacaggcgcccgccaccacgcccggctaattttgtttttgtatttttagtagagacagggtttcactgtgttagccaggatggtctcgatctcctgatctcgtgatccgcccgcctcggcctcccaaagtgctgggattacaggcgtgagccaccgcgcccggtctataaagagctcttctaaccaaaccccagtccctccacaaatgggtaaaggaaatgaatatgcaatttggagatatgaaataaaacataagcatatgaaacaaagttcagtctcgctgacaatgaaataatgaataaagcaattgtgagctttcatcaatcacatggaataggttaaaaagtagggttgttatccagaatgcgtatgccttggagaagttagaagtttacatactcagttcaaatgtacccaccaagactgcattttcttaggagataagttgacaatgactcctgaaaggtgacaggcagccaggcctggtagcttatgcctgtaatcccaacactttgagaggccaaggtgggaggatcagcggaggctaggagcacgaggcccagcctgggcaacatagcaagaccctacctctacaaaaataaaaataaattagccagacgtggtgatgctcgcctgtagtcccagctaccctggaggctgaaatgggaggatcactggagcccaggaggtcgaggctgcggcaagctatgattgcaccactgcactccagcctgggtgacagagcaagacgctgtctctttaaaataaagaaaagaaaatttacatgcattttctttttggctcagctattccacttccaagaattacttgcacagatacactcccacacatatgctaagatatacgagaaaaccattcatggctgccttgtttagaatcaaaaaccatttagtttcatcgccattttataaaagactttttgcaggtgttacttaaaaagaaacatcttattgttcttagcaacaacttggatggctctccagggaattctattgagtgaaggaaaaaaagacacacgtgatttgaaaggggttacactctgtatgactccatttatatgacattcttgacatgagaaaaggtacagaaatagagaacagactagtaattctcaggggttcaggacaggagaggaggttgaggtaggatgcaggttggtacagaaatagagaacagactagtaattctcaggggttcaggacgggagaggaggttgaggtaggatgcagagagagaaacaggaggggttgttggtgaaagaaatgctctgtgtgttgcggacaatgctggcttcacaaacctgcacgcactatgaaattgcacagaactcggtacaaaaacccacacggatacgagtaaaacataagatcaatgcattattgcctgaatgtgaatatcctccttgtgacatggtattattgctttccaagatgttaccactgggggaagtagacacaagattctttcctattatttcttacaactgcttataaatctacaatgatctcaaagtaaaaaccttaattggaaaaaaaaaaaaaaagtctaggcaggaagcagtgggtcacacctgtaatcccaacactttaggaggtcagggtgagacaatcacttgaggccaggagtttgagatcagcttgggcaacatagcaagaccccatctctacaaagaaatttaaaacttagccaggcatggtggcttgcatgtgtagtcccaggtacgtgggaggctgagatgggaggattgtttgagcccaggacttgaaggctgcagtgagctatgattgcattactgcactccagcctgggcaacagagcaagatcctgtctctaaaaataaatgaatagataagtaagtaaataaataaatctatgcttacgccatatgatatttcattcttaaaaaacaggaaaaacaaaagtcctatccttcttgatcctagtacagttgttttgaaaatatctatatgtttcatgggggctgggcgcagtggctcacgcctgtaatcccagcactttgggaggccgaggcaggcggatcacgaggtcaggagtttgagaccagcccaatcaacatggtgaaaccccgtctgtactaaaagtacaaaaattagccgggcatggtagcacgcacctgtaatcccagctactcgggaagctgaggcaggagaatcacttgaacccgggaggcagaggtagcagtgagccgagatcacaccactgcactccagcctgggtgacagagggagactccatctcagaaaaataataacaacaaaaataaataaataaataataaaacaaaactaaaaaaataaaaactatgtgttttatgattcccgtttgaactgctgatcttcccacaccctggtcccttcatctaacactgagggctggagacacagtgagttttgtctactgtcatgagcttcagggcatggcaggtacaggtgttgagtttttgttgttttatcatgaggttggtgcaaaagttaatggcaaaagcagcaattacttttgcagcaacatattattattattattattattattattattattattactactactactactgatagggtcttgctctgtcaccccggctggagtgcagtggtgaaaacacagctcactgcagcctcaaactcccagacttaagcaatcctcctgcctcagcctcctaggcagctgggactacaggcacgtgccagcacatctgccagttttttttttaatcttttgtagagacagggtcttgctccattgttcaggctgatctcaaactcctgttttcaagtgatcctcctgcctcagtcccccaagtagctggaactacaggtgtgtgccaccatgccccactaatttatttttatttttgtagagatggggtctcactatgttggccgagctgatctcaaactcctggcctcaagtgatcctcccaccttggcctcccgacgtgttgcaattataggcatgaacaggctacagaccccaccgtcatctcctccatcaaagaggttcctgaactttactttcatgtttggtatacactgccttgaatcctttctctttttttgagaccgagtctcgctctgttgcccaggctggagtgcagtggtgcaatctcggctcactgcaagctctgcctcctgggttcatgccattctcttgcctcagcctcccgagtagctgggattacaggtgcccgccaccacacctgactaattttttttgcatctttagtagagatggagtttcaccgtgttagccaggatggtctcgatctcctgacctcgtgatccgcccacctcagcctcccaaagtgctgggattacaggtgtgagccaccatgcccggacacaaggtcatattgaaaagatgctcagccgagtctggtggctcatgtctgtaatcccagcactttgggaggccgaggtagaaaaatcactaggtcagaagttcaagaccagcctgaccaacatagtgaaaccccgtctctactaaaaatacaaaaattatccaggtgtgatggtgtgcccatgtggtcccagctactcaggaggctgaggtgggaggattgcttgagcctgggagagcaaggctgcagtgagccatgttcatatcagtgcactccagcctaggtgacagagcaagaccctgtctcaaaaaaaaaagaagaagaaaaaaaagcatcatttcattgttgatataccattgtttcctaagagagacagagagagagagagagagagagagagagtgtgtgtgtgtgtgtgtgtgtgtgtgtgtgtgtgtcacagtcctcaaatttgggagagtaaagtgaagatgaccagcagccaaaaacccaacaaagctggtcccaggaacacattttcctgatatgcagtgtaacttaggttcttatagaagaaagaccgtgtcactcaaccaccataattaagaaccttcagagtccaattcatgaaaactcaccggcagaacaatatgtggcaaccattctaagcgaacctcagatgaagcaccttgaaggcttcacgagcctgtgtgctattggataaccatggggaaaaaaaaaaaactgaattctggccgggcgcggtggctcatgcctgtaatcccagcactttgggaggccgaggcaggagaatcgcttgaacccgggaggtgggcattgcagtgagccgagatcatgccactgcactctagcctgggtgacagagcgagactccatctcagaaaaaaaaaaaaaaaacctgaatggtcattcattttaggaacagaatgatctaggagtattggactgcagaggagagggagggagagagcagctggagcttcatatagttacacattacagaatgcatacacacacacacacacacacatatatatgcattcatcttaaagtaagattgacagcaaagcatcaataaagactgcaaaccggccacgtgcagtggcttcacgcctgtaatcccagcactttgggaggctaaggtgggctgatcacctgaggtcagaagtttgagaccagcctgactaacatggtgaaaccccatctctactaaaaattaaaaaattagccgggcgagatggctggcgcctgtaatcctgcctcaggagggtgaggcaggagaatcgcttgaacccaggaggcggacattgcggtgagccgagatcacgccactgcactccagcctgggggacagagcaagactccatctcaaaataaaaaaaaaaaaaatggtcgttcatttcaggaacagaatgatctaggagagtactggactgcagaggagagggaaggagagagcaggtggagcttcatatattcacacattacagaatgtatacacatacatatatatgcattcgtcttaaagtaagattgacagcaaagcatcaacaaagacctgcaaactggccagttgtggtggctcacacctgtaatcccaacactttgagaggccgaggtgggtggatcatgaggtcaggagttcaagaccagcctggccaacatggtaaaaccctgtctctactaaaaacacaaaaattagcccagcgtggtggctggcgcctgtagtcccagctactcaggaggctggggcaggagaattttttgaacccaggaggtggaggttgcagtgagctcagatcatgccattgcactccagcctgggtgacaagagcgagacttttttgtctcaaaaaaaaaaaagcttaaaaaataaaaacagcttaaaaataaagtaaaataacataaaagcttaaaatataaaataaaatttaagaggtcattcatttcaggaaaagactgatctacgagaattggactgcagaggaaagagagggagagagcagctggagcttcatatattcacacattacagaatgtatatacatatatatacgcattcatcttaaagtaagagtgacagcaaagcatcaataaagaccttcaatccatactctgacaagttcctttgtccagtggtcctcaagctttttggcaccaggaaccagtttcatggaagaccatttttccactgatgtggggtgggggatggtttggggatgattgaagtgcattctatttatcatgcactttatttctattattattacactgtaatagagaatgaagtaattatgaaactcaccatcgtgtagaatcagtggaagccctgagcttgttttcctgcaactagacggtcccatctgcgtgcgggtgatgagagccagtgacagatcatcaggcattagattttcatacggagcacgccacctaggtccctcacatgttcagttcacagtagggttcatgctcctatgagactctaatgccaccactgatctcataggaggcagagctcaggaggtaatatgagctatggggagcagctgtcaatacagatgaagctttgctcactcacacgctactcacctcctgctgcacagcccagttactaaaaggctggggaccggtactggatgcaaggatacaaggatgcaagagatgctaaaattcattaaaatgggtccacggatgccctgcattcttcacactctccaattaatcttgtgaattcagcattgagtcactgaaggtcacagtgagtcccacttctgatttacccacttttgaaatgaacagaatgcagaaaggaaaacaaggtcagtagcatctgtcagcaaagtttgccaacggctgtacccacacaaagaagagaggtgtgtctgtcttcttatttgttcttttttctttttcttttttttgagacaaggtctcactctttcacccaggctggagtgcagtggggcaatcatggctcactgcagcctcaacttcccaggctcaaccaaacctcccatctcagcctcctgagtagctgggactacaggtgtgcaccagcatggccagataatttttgtgtttttttgtagagacagggtctccgtatgttgcccaggctggtttcgagctcctaggctcaagcaatccacccaccttggcctcccaaaatgctgggattacaagcagaagatgccgcatccagctcatttctgctttttaaatgtttttctttctttctttttttttttgaaacggagtctcgctctgtcacccaggctggagtgcagtggcgggatctctagccttcatctttctcccatgctggatgcttcctgccctcgaacatcaagaccccagggtctttgggttttggaccgttggacctacaccagtgatttgccaggggctcctggaccttcgaccacagactgaaggccgcactctcagcttgcctacttttgaggttttgggccttggactggcttcctggctcctcagcttgcagacggcctattgtgggacttcaccttgtgatcgtgtgagtcaattatcctagtaaactccccttcatatacacatcagtcctattcgttctgtccctgtagatcaccctgacttgaacagcatgaagagcaacgctgtaaccagccctgtcctgactgaggcagccgaatgagaatcagcaatgaggagctacagacgacgcagacggcaccagtagctaccgcccaggatgcatggacactctagtttccacagccacattcaagttctggaacaccacggcttccggctgtcttcagtgaagacggagcacgtgtcagtcccagggtgcaatgatcacacctcggagctttccaaaattctatctcatcacgttcaccaacaaagacatccaaggagcagaattcaaagtcaaggaagcctgtgaaattcacaaggagcaagaagaacaaaggctaaggactatttgacaggaggggaagaggcctggtccctgggttctccaaggcaacgcggtggaatgtgttttgacgtgtcttcaagtctgaaaggaacctggtccttccattccctggatgctatgtctctcttagtggctttgcaatgatgtcatctgtggacacagatctgcatgagtgacagttctgcagagaaacaaccagtaggatatatatatagagagaaagagattttaaagaactggctcccaagatgtgggggaggggcaaaaccaaaatgtgcagggtagaccagcaggccagatgcccatggagacatgatgtcgcagctcaagtctgaaggtggattccagatagaattccctcttccttggaggagggactctttttacctcttaagaccttccactgattaggcaaggcccacccacattatgaacagctatcggcttcactcaaagtctactgaaaatctcattattgggtacacacccagaggaatataaattgttctaccataaagactcacacggctgggcacagtggttgacgcctgtaatctcagcactttgggaggctgaggcaggtggatcacgaggtcaggagttcaagaccagcctggccaacatggtgaaactccgtctttactaaaaatacaaaaaaaattagctgggtgtggtggcgtgcgcctgtaggcccagctatttgggaggctgaggcagaagaattgcttgaacccagaaggcagaggttgcagtgagctgagatcatgccactgtcaatcaacatgtattttgtatttatatatattatatactacattctcaacacatgtttgtatttattttgtgtttctatgtattatatactgcattcttacagtaaagtaagctagagaaaagaaaatgctattaagaaaatcttaaggaagagaaaacatatgtactactcatcgagtggaagtggatcatcctaaaggtctccatcctcatcgtctccatgctgaagaagctgaggaggaggaggaggaacaaaaagggttgttcttgctgtctcgggggtggcagaggtggcagaaaatccacatataaatggacctatggagtttacacctgtgttgttcaaaggtcaactgtatatattataatatatatgatatatgatgatatataattacattgtataatatattatgggtgtctatgtgtgtgtgtatatatatatattcagttccatccaggtatggataataaagcccagtacgtatgcaacacactggccatcagcgtcacgcctagttatcatgctggccggtaaacaacgtgtctttgcagtcctgtgcctgagatcatacccttcccagtgccacaggtccccaaatcactgcattatttctagaaaaacccagccgcgatttcctagaaacaagaaccccaggaaatgtaatcaagtaccatcttctggaaattgagacatctgagatgaaaagtgtgacttgttaactgccacgtagaagctctcaggaatattccctttccgaagacatttgtacaaactgaagggttctgtactaacagagaatgctattgcctctttccccaaggaaacacagcttaaggaatgttcccctcaatgcaccatctgtcaccagacacgtgcgtgttccgtcacatgtcactatgataagacaatgacttgtgtgtgtgtcaatctagaagctgagtattaccttgaaatcaagagggaggcggagtttctcaacctcattttactttttatttgtgtttcgtagagacagggtctggctctgtcacccaagctgtagtgcagtggtgtgatcatggctcactgcagcctccacctcctgggctccagtgatcctcccacctcagcctccaaagtagctgggagcagatgcacaccaccatgtccagctaattttttttaaattttatatagacgggggtctcactgcgttgcccatgctcctcttaaactcctggactcaagtgattttcccacatcagcctccgaaagtccagggattacaggcaccagccaccgtggctggccctcaaccttactttagcccaggggtctaactcctgggcagatatcctaagattcttacagaaaaccaaaggcaaacaagtccagtcaaggcagcatgcaaaaccaccatacttggcaagtgatgtacattctctacccattctccaaggggagttctgcctctccggacacagcaccccgaaacgagaccctgttactcaaatgagctgcatgacaggggaaatgatggatcaagcaatgacagcatttgggctctgctcttatttttaacttgtatcacatgctgggcaccgttacactcacctggaagcaatgctttaaggacaagttctttccaacagtgagaataactcgtgtgagagaagatgagatggtaaaaaaaagagccaatgggccgggcacggtagctcacgcctgtaatcccagcactttgggaggccgaggcgggcagatcacgaggtcaggatatcgagaccatcctggccaacacagtgaaaccccatctctactaaaaatacaaaaaattagccgggtgtggtggcggaagcctgtagtcccagctactcgggaggctgaggcaggagaatggcgtgaacccgggaggtggagcttgcagtgagctgagatcacaccctgcactccagcctgggcgacagagcgagactccgtctcaaaaagaaaaaaaaaaaaaaaaagggccaatgaccatggccaattccaagcctgagttggaggcctggaagccattggggaaataacctaccatcaccgttttccctctaaaaatctaaaatctgcttattccacagcccctcagtaggctgctactgtttgtttttagccgtctactaaatttcattgatacatgtttctgccttcttggtgatcccaaatacaacaatttattcacacatgaaattgaaaatgtgataattctgcaagcacacaccccttaagatatgactctcagctcacaggctttctcctctaaacatttatattcagtaacaggtatttgattcctcttgaattttaatgaggaaggcacttacgaggactcttagaggccgtgtttaagggtcattcattatgccctccattaaatcaagtggcaacagcaaaccatgcaggtgaggagacctgggcggcagacgggacagtgtctgagggtatgtgtttgggtttctctagctgttgaacaattacacacatgagggactgggcactgtgccccatgcctgtaatcccagcactctgggaggcccaggtgggaagatccattgaggcccagagttccagacgaacctgggaaacatagtgagacgccatctctacaaataatttttttaaaaacttgcctgggcatgatggcacacacctggagtcccagctatcatgaggctgaggtgggagcatggcttgagtccaggaggtcaaagctgcagtgagccatgatcatgccactgcactctagcctgtgggacacagcaagacccagtctccaaaaaaaaaatgttaaaaattaaaaataataaaaaattaggctgggcggagtagctcacacctgtaatcccagcactttgggaggccgaggcgggcagatcacctgaggtcaggagttcgagaccagcctggccaacatggagaaaccccgtctctactaaaaatacaaaaattagctgggcctggtggcggacaccggtaatcccagctactcaggaggctgaggcgggggaattgcttgaacccaggaggtagaggttacagtgagccaagatcgcaccactgcactccagcctgggcaacaagagtggaattccgtctcaaaaacaaagaacattagatagtaccggacacgctgggttggacacagggccgaaaagggctaactataaacaacttttaggcaatttccgaaaaagttgcatgtcagaaaaaggaaaggtgggctttcccaggaactgcgtaccacctatattttgccgtgaccaggatttttatataagcccacgtcctatgtgtatttcacagcactaaccttcaccttcaaaacaaggagcgtttctttgactcctccttcttggaaaatttatcaatcaagaaaaaaaaaagcttaaccattactgtatttttttaaagaatggtatttgctactatctgaaagtttgtgttcctcccccaaattcctgcgttgaaatcctcacccccaagggaccgctgccgtgggcacactgaagactttccctaagaatgcggccaagggaccgctgccctgtacacaaggaagaggttccctaagaatgcggccaagggaccaccgccatgtacacactgaagatgttccctaacaatgtggccaagggaccaccctgaagacgttccctaagcatgcagccaagggactgccaccgtgtacacactgaaaacattccctaagaatgcagcaaaggaacagcactgaagatgttctctaggcatgtggccaagggactgccaccgtgtacacactgaggacgttccctaagcatgtggctaagggactccgccatgtacacactgaagatgttccctaagaatgtggccaagggaccgacgccatgtacacactgaacacatttcctaagaatgtggtcaagggaccgcactgaagacgttccctaagaatgcagccaagggaccgctgctgtgtattcactaaagacattccctaagtttgtggctaagggaccgccatcatgtacacactgaagatgttcccgaagaacgtggcaaagggaccgcactgaagacgttccagaagtgtgcggccaagggactaccaccatgtacacactaaagacattccctaagaatgtggctaagggactgccgccatgtacacactaaaaatgttccctaagaatgtggccaagggacccacaccatgtacaaactgaagacgttccctaagaatgtggacaggggactgccgctgtgtaggcactgaagacattccctaagcatgtggccaagggacctcactgaagacgttccctaagaatgtggccaagggaccgccaccgtgtacacactgcagacgttccctaagcatgtggcccaagggacgacagctgtgtacacactgaagacggtctcgaggcttgtggctaagggaccaccgccatgtacacactgaagatggtccctaacaatgcggccaagagaccaccgccatgtacacactgaagacggtccctaagaatgcggccaagggaccacctccatgtacacactgaagacattccctaagcatgggctaagggacggtagccatgtacacactgaagaagttccctaaaaatgtggccaagggaccaccgccatgtactcactgaagatgttccctaagaatgtggccaagggatcgacaccatgtacagaagaagacgttccctaagaatgtggacaagggactgccactgtgtaggcactgaagacattccctaagaaagcagccaagggaccgcaaggaagatgttcccaaagaatggggccaagggaccgttgcagtgtacacactgaacatgttagctatgtatgtggctgaggggccgccgccatgtacgcactgaagccatgtacgcactaaagacattccctaagaatgcagccaagggacggcactgaagacattccctaggcatgaggccaagggaccgccacgggtacacactgaagacattccctaagcatgtggctaagggaccaccgccctgtacacaaaccgtgtacacactgaagatattccctaagaatgtggccaaggaacagcactgaagacgttccctaagcttgtggctaagggaccaccgccctgtacacaaaccgtgtacacactgaagatattccctaagaatgtggccaaggaacaccactgaagacgttccctaagcatgcagccaagggactgccaccgtgtacacactgaagacattcactaagaatgtggctaagggactgctgccatgtacacactgaagatgttcccaagcatgtgaccaagggaccaacgccgtatacacactgaagatgtttccaaagaatatgaccaagggaccgccaccttgtacacagtaaagacattccccaaggttcagtcatgggcctgtgaaacatcacaggaaagaatgatgtgcaggatccagttattccaccataaggtgtgtacccaaaggaaaggaaatcagcccatcaacgggatacctgcaccccctgtgcactgcagcactactcacagtttccaagatatagaatcaacccatgtgtcaatcaacacatgagtgcctcaagcaaatgtggcatagacacacagtggaatagtatgcagccatgaaaaaggaaatcctgccatttgcaacaacatggatgggactggaaaatacaatgtgaagtgaaataaaccaggcacagagagaataccatatcatctcgtatgtagaatctaaaaaagctgaatgcataaaagcagagagtgcaatggtggttgccagggaagaatgcttcatgaagtgtttgtcaaagaacataacatttcagttggaggccaggagcggtggcttatgtccggaatcacaatgctatggaaggctgaggaaggaggaccactgaaggccagaagtttgagacaagcctgggcaacgtaatgaaaccccatctctaaaaaaaaaacaaaaacaaaaaaattagctgggtatggtggcatgcacctgtagtcccagctacttgggaggctgaggcaggaggatcacttcagcccaggaattcaagaccagcctgagcaacatagcaagatcccatctacataaaaaatttaaaaattaaccaggtgtggtggtgtgcacctgtagtcccagctacctgggaggctcaggagggtcacctgagccaggagttggaggctgcagtgagctatgaacatgacgctgcactccaccgtgggtgatagggtgagactgtctcaaaaaaatataaattacattaaaattaaattttttcagttacataaaagaaataaattcaaagatctatcacaccacagtgatcatagttaataatacatcgcatctttcaaaatgactaaaagtagattttacatattctgaccacaaaaaaaagtaggtgaggtgatataggttagagttaaggttatgtgaatatgttaattagcttgttaatatgttaattagcttgattgttaatgtgtttattagcttgattattaatatgttaattgacttgattgttaatatagtatctagcttgatttaatcaccgcacaatgtgtacttggattaaaacatcacgtacctcatatatatgtatacgattattttttgttaatgaacaatacattttctataaaaatgactcgcatttccaggcagaaagcaaaacaagtcccagttttgaggacagctgtgacatatttaatggtgtctcttcttaattcaacacagtttacacgaccatgacacaaggggttccaagtttccaaggaaaggattccagttatgtgctcaaggtgtatccacactgggccgggcgcggtggctcacgcctgtcatcccagcactttgggaggctgaggcgggtggatcacctgaggtcaggagttccagactggcctgaccaatatgctgaaaccccatctctactaaaaatacaaaaattagctgggtgtggtggcgggcgcctgtaatgccagctactcaggaggctgagacaggagaatggcttgaacccaggaggtggaggttgcagtgagctaagatcgcaccactgcactccagcctgggcaacaagagtaaaactctgtctcaaaaaaaaaaaaaaatgtgtccactctgcaccctgaccagaagagacgaccttcaaatgatcacacgaggtcatctcacaaagcggcgagtgttcccagttattactcggagggccgggcctgctcaggagggttggtgagatcaggctgtcccctaacacacaccatggcagggctcatcctcctgagtacatgcaaggtgcactgagacagctccccatagaactccaaaaatagcccagctgggaagaaatggaacattctgggggacactgattttcatattgaaatttcctatctttttaaatttattgtggttgagacagggtcacacccaggcgattgcccaacctggagtgcagtggcatgatgctagctcactgcagcctcaacctccttgggctcaggcgatccttcagcctcagcctcccaagtagctgtgaccacacacgcgtgccaccacatttggctaatttttatgtttgtatttttagacacagcacctctcgcttggttgcccaggctgtggtcacagctcactgcagcctccaactcccacactcaagtgatcctcccacctctgcctcctgagtagctgggaatataagcacatactaattttttctatttttagtagagatggagtttggccatgttgcccaggctggtctcaatctcctgtactcaagcgatccaccggcctaaagtgctgggattacgggcgtgagccaccacgcctggccatgcagctgttttaataagcaattctgagaagacacaaatgcccccctgctcttttgtaataatactaacacagattaccgaattacactgacgaaaacctcacatgcgttacctaaggaaacacagagcccccagtgttagatctgaattgtttctccacccaggacaaataagtgcattccaattagtgcctcaaaaaaaaaaggaaaaaagtaccaataaataaataaataaataaaacacagtagagcagtttcaacaaactccagcccttatttttggaaggcccacttgtcaagaacagtgtttatgtttataaatgttttttctgaatttctcaatgcttagggaaaaaaagtcaaaagagcaatattatttcttgacacaacatttatataaaatttagtaatccaaactactcaggaggctgagacaggagaatcgctcgaacccgggaggtgaaggttgcagcgagccaagatcgcgtcactgtactccaggcttggcaacaagagcaaaactctgtctcaaaaaaaaagaatgttagatagtatcggacatgctgggttggacacaggactgaagagctaactataaacaattttaggcaatttccacaaaagttacatgtcagaaaaaggaaaggtgggctttcccaggttctgcgtaccacctatattttaccgtgaccaagattttataagcccaagtcccacgtatattttacagcactaacattcaccttcaaagcaaggagggtttctgtgtctcctccttcttggaaaatttatcaaattaaaaaaaaaaaaagcttaactattactgtatgtttttaaagaatggtatttgctatatatagtctgaaagtttgtattcctcccccaaattcctgcattgaaatcctcacccctaagacaatggagtcaggaggtgggagacttgggaggtgatgagatcatggggatcgagcctcatgaatgggatcagtgtccttataaaagggaccccagagagctccctcgccccttccacgcagagaaaatgcatcatctatgaaccaggaagtgggtccccaccagacactgaatccgccacgatcttaaacctccaacctttagaactgtgagtgacaaatgtctgtagtttataaattacccaactgaaggtattttattttagcagctccctactcaggaggctgtggcaggagaatcgcttgaacccgggaggcggagggtgcagtgagctgagatcacagcactgcactccagcctgggcaatacagcaagactccatctttaaaaaaaaaaaaaaaaaagttgcatcaagaatgaaaggtgcacaaaggcagccagggatgcaagccccttccaccctgggccctggaactgcacaggccaccttcaaaggtttctttcctgtcatcctcccaagtctacacgaatataaagaaacacactagaagcctctgataggatgggggcatctccagaaatccgaagattcaggttctgaacctctgatctgggtggggctgggagctgcagttccagaaagcaaatgaagccttggctgtgattcagaccatttcttggtagcaagcgtgtaggggaagaagaatgtggacggggcaggggaaggaatgaattcggtcaggacggtggctggagaatgtctgagacggccacgtgcagagaggagcaggctggctgcgtctctcactgtgcctgggacaggcggtgacagagaaatgggattccacatgagagtcagagacacccagtgaagaaacaaaagcagcttacagggtgaaaaggacacagacagacactgacactcagaagaatgttgccaagggaccgccactgtgtatgaactgaaaaggttccctaagaatgcggccaagggactgctgccgtgtacacactgaagacgctccctaagaatgcaactaaaagacaacactgaagacgttccctaggcatgtggctaagaaaccactgccatgtacacattgaagacattccctaagtatgtggctaaggcaccactgccatgtacacactgaagacgttccctaagtatgtggttaagggactgccgccatatacacactgaagatgttcactaagcaggtgactaagggatcgccgccatgtactcactgaagacgttcactaagcatacggccaagggactgccgccgtgtacacactgaagacattccctaagaatgtggctaagggaccgccgccatgtacacactgaagatgttcccaaaaaatgtggccaagggactgctgccatgtgcacattgaagacgttccctaagcaggtggctaagggaccaccaccatgtacacactgaagacgttccctaagaatgcagccaagggacggcactgaagacgttccctaggcatgtggtcaagggaccgcactgaagatgttccctaagcatgtagccaagggactgccaccgtgtacacattgaagacattccctacgaatgtggataagggacctccgccatgtacacactgaagacgttccctaaccatgcgcccaagggacctccgccatgtacacagtgaagacgttcccgaagaatgtggccaagagaccaccatgtacacactgaagatgttccctaagcatgtggccaatggaccgcactgatgacgttccctacgcatgcggccaacggactgccactgtgtacgcgcggaagacattccctaataatgtggctaagggaccactgccaagtacacactgaatatgttccctgagcatgtggccaagggacggccgtcatgtacacattgaagacgttccctaagaatgtggccaagggaccaccaccttgtacacagtgaagacgttccaaaggtccagtcatgggcctgcgaaacatcagaggaaagaatggtgtacaggatctagtcatcccaccactgggtgtgtacccatcaatgggatacctgccccactgtgcactgcagcactactcagtttccaagagacggaataaacccatgtgtcaatcaacagatgagtgcatcaaacaaatgtggcatagacacacactggaatagtatggagccatgaaaaaggaaatcctgtcatttgcagcaacatggatgggactggaagatacaaggtgaagtgaaatgaaacaggcacagagagacaaataccatatcatcgcatatgtagaatataaaaaagctgaacacataaatgcagagggtacaatggttgttgccagcaaagaatgctgaagtgtttgtcaaagaacacaaaatttcagttgctggccaaaagcggtggctcatgtctggaatcacaatgctatggaaggctgaggaaggaggatcacttgaggccaggagtttgagataagcctgggcaacagaatgaaaccccatctctaaaaaaaaaaaacaaaaaattagctgggtatggtggcatgcacctgtactcccagctacatgggaggctgaggcaggaggatcgcttcagcccaggaattcaagaccagcctgagcaacatagcaagacaccatctctacaaaaaatttaaaaattaaccaggtgtggtggtgtgcacctgtactcccagctacctgggaggctgaggtgggagggtcacctgagccatgacttggaggctgccgagagctatgaacatgatgctgtactccagcctggctatagggtgagactgtctcaaaaaatacataaattacattaaaattaatttttttcagttagataaaacaaataaattccaagatctatcacaccacagtgatgatagttaataatacatcgcgtctttcacaatgactaaaagtagatttgacatattctccccacaaaaaaaactaggtgaggtgatataggtcagagttaggattatgtgaatatgttaattagcttgattgttaatatgttaattagcttggttaatacgttattagctttattttaatatgttaattaactttattgttaatatggtaactagcttgatttaatcattgcacaatgtgtacttggattaaaacattacattgtaccatatatatgtatacaattattttttgttaacgaaaaataaattttctataaaaatgacttgcatttccaggcagaaagcaaaacaagtcccagtttcgaggacagctgtgatatatttaacagtgtctcctcttaattcaacacagtttatatgaccatgacacaaggggttccaagtttccaaggaaaggattccagttatgtgctcaaggtgtatccacactgggccgggcgctgtgactcacgcctgtcatcccagcactttgggaggctgaggcgggtggatcacctgaggtcaggagttccagaccagcctgaccaatatgctgaaacgctgtgtctactaaaaatacaaaaattagccaggtgtggtggcaggcacctgtaatcccagctactcaggaggctgaggcaggagaattgcttcaacccgggagatgttggctgcagtgagccgagattgagctattgcactccggcctgggcaacaagagagaaactccgtctcaaaaaaaaaaaaagacatattcatgttgagatttctacactgtgaaaaaagatctccaatagtgtgcatcaggcaccccaaaaattcccaattctattaaccaatcaaatctactaggaaattgcaattggaatgactccacggtttcccagaaaggccaacaccattctaatagaaagcattcactgtttttatgcaaatcatttcatccatacctcaaaacgacgtcatgtagactggataaagaaaggtgggagcatatacactatggaatactatgcacccatgaaaaagaatgggattggttgggcgtggtggctcacgcctgtaatctcagaaatttgggaggccgaggcgggtggattacctgaggtccggagttcaagaccagcctgtccaacatggagaaaccctgtctctactaaaaacacaaaattagctgggcgtggtggcatgcacctgtaatctcagctactcagaaggctaaggcaggagaatcactggaacccgggagccagaggttgcggtgagtcaagatcacacaattgaactccagcctgggcaacaagagggaaaccccatctcaaaaaaaaaaaaacgggatgatgtcctttgcaggaacctgcatggaggtggaggccattatccttagcaaacttacacagcaacagaagacaaaatacctcctgttctcactgataagtggtaggtaagcattgggtacccgtggatataaagaagggatcagactccggggcctgctggaaggtggagggtgggacaaacgagaggattgaaaaattacctatcaggtggtagtaggcttattacctggttgatgaaataatctctacactaaacccccaggacatgcaatttacccgtgtaacgaacctgcgcatgtgcccctcaacctgaaataaaagtaaaaacaagtaggccgggagcagtgattcctaatcccagcactttgggagggcaaggcgggtggatcacttgaggccaggagttcgagaccaccctgaccaacatgatgaaaccctgtcactactaaaaatacaaaattagtcgggcatggtggcacacacctataatcccagctacgtgacaggctgatgcgggagaatcccgtgaaccctggagacggaggttgcagtgagccgagattgtgctactgcactccagccttggcgacaagaacaaaacttcgtctcaaaaaaaaaaaaaaaaaaaacaataaaaagcacacacaaaacactgcatgcttctatggggaacattttactgatttttttttaactcttttaaaatgttagattagtgtcttaggaaatcagggatttccagaggcaggacttcacgacaccaacgttgagtgtcaaaaggattcctttcaatgtagaaggtgcatgcctgctctgggcttccacaaatccccgagacttaataagacacctggctccgtcactgatcaaagaatgggtaccacgacttagcatccactgcaaagctccatggtgcctagctttagccagtttgttcacagccgtgattaaggtgtccacagcatcctcaccagcctcaggaacagggcacagtcaactcaccacaggggtgaccccagaaacaagagacacgactgtaacagggacaatgtgcgggacgccaaaaaccagaacaagagacaggaatattataacagggacaaagtcgacaccacatggaagatggatgactcatttgtcacaggtagaaacagtttatctgcgagtttgtaaccaggtgaatcaagaatgaagggtgcggccgggcgcagtggctcatgcctgttatcccagaactttgggaggctgaggcaggtggatcacctgaggtcaggagttcaagaccagcctggccaacatgatgaaaccccatctctactaaaaatacaaagattagccatgtgtggtggcaggtgcctgtaatcccagctactcgggaggctgtggcaggagaatggcttgaacacaggaggcggaggttgcagtgagctgacatcacagcactgcactccagcctgggggacacagcaagactcctcttcaaaaaaaaaaaaaaaaaacagctggatgaagaatgaaaggtgcacaaaggcagccagggatgcaagccccttccaccctgggccctggaactgcacaggccaccttctaaggtttctctcctgtcatcctcccaagtctacacgaatataaagaaacacactagaagtctctgatgggatgggggcatctccagaaatccgaagattcaggttctgaatctctgatctgagtgcggctggggagctgctgttccagaaagcaaatgaaactttggctgtgattcagaccatttcttggtagcaagggtgtagggaaagaaggatgtggaccgtgcaggagaaggaatgaatggggtcaggacagtggctggagaatgtctgagatggccacgtgcagagaggagcaggctggctgtgtctctcactgtgcctgggatgggtggtgacagatgagtgggattccacatgatagagacacccaatgaagaaataaaagcagcttacagggagcaaatgacacagacactcagaagaaagtggccaagggatcgtccccatgtatgaactgaagacgttttctaagaatgtggccaagggtccacactgaagatgatccctaagaatgtggccaagggaccaccaccatgtaggcactgaagacgttccctaagaatgtggcagcgggatggccactgtgtagaaactgaagatgttccctaaggatgtggccaagggaccaccaccatgtacacactgaagacgttccctaagtatgtggcgcaagggacctctgctgtgtgcacactgaagacgttccctaagcatgtggctaagggactgctaccatttacacactgaagacattccctaagatgcagccaagggacagcactcaagacattccctaggcatgtggccaagggaccgccaccatgtaaacactgaagacgttccctaagcctgtggctaagggacagccgccatgtacacactgaagacatcccctaagaatgccgcaaaagaaccgccaccgtggacatgctgaagatggttcccctaagcatgtggttaaaggactgccgccctgtacacactgaagacgttccctaagaatgtggccaagggactgccaccatgtacacactgaagacgttccctaagcatgtggcccaagggacagccacggtgtgcacactgaagacgttccctaagcttgtggctaagggaccaccaccatgtacacactgaagacgttccctaagaaagcagccaagagacggcagggaatatgttccgtaagcatgtagccaagggaccgccaccaagtacaaactgaagacattccctaagcttgtggctaagggaccaccgcagtgtgcacactgaagacgttccctaagaatgcggccaagggactgccgccatgtacacactaaagacattcccgaagaattaggactagggactgccaccgtgtacacactgaagacattcgggaagaatgtggctaagggactgctgccagctacacactgaagatgtttcctaagcatgtggtcaagagaccaacatcgtgtacacactgcagacgttccctaagaatgtggccaagggacccccaccttgtacaaagtgaagacgttccctaaggtccagccattggcctgcaaaacatcagagcaaagaatgttgtgcaggatccagtcatcccaccgctcggtgtgtacccaaaggaaaggaaatctgcccatcaatggcatacctgcaccccctgtgcactgcagcactactaatagtttccaagatatagaatcaacccatgttcaatcaacagataagtgcatcaagcgaatgtggcatagacacacaatggaatggtatgcagccatgaaaaaggaaatcctaccatttgcagcaacatgggtgggactgaaagatacaatgtgaagtgaaatgaaccaggcacagagagacaaatatcgtatcatctcataggtagaatctaaaaaagctgaacgcataaacgcagagagtgcaatggtggttgccagggaagaatgcttcatgaagtgtttggcaaagaacataacatttcagttggaggccaggagcggtggctcatgtctggaatcacaatgctatggaaggctgaggaaggaggatcacagaaggccaggagtttgagagaagcctgggcaacataatgaaaccccatctctaaaaataaaaaaaaatgaaaaaattagctagatatggtggcatgcacctgcagtcccagctacttgggaggctgaggcagaaggatcacttctgcccaggaattcaagaccagcctgagcaacatagcaagaccccatctctacaaaactttaaaaattaaccaggtgtggtggtgtgcacctgtagtcccagctacctgggaggctcaggtgggagggtcacctgtgccaggagttggaggctgccatgagctatgaacatgacgctgcactccagcctgggtgatagagggtgagactgtctcaaaaacataaattacattaaaattaaattttttcagttacataaaagaaataaattcaaagttctatcataccacacagtgattatagttaataataatacattgcatctttcaaaatgactaaaactagattttacatattctcatcaccaaaaaaacgaagtgaggtgatataggttagagttagggttatctgaatatgtaaattagcttgttaatatgttaattagcttgattgttaatatgttaattaggtcaatggttaatatgttaattcacttaattattaatgttaattagcttcattgctaatatggtaactagcttggtttaatcactgcacaatgtgtacttggattaaaacatcatattgtaccatagagagagagagagagagaatgtgtgtctgtgtgtatatatatatatatatatatatatatatacacacacatacaatatatatatacacacacacacaattattttttgttaacgaacaataaattttctataaaagtgactcccatttccaggcagaaagcaaaacaagacccagttttgaggacagctatgacatatttaacggtgtctcctcttaattcaatacagtttatatgactatgttccaaggggctccaagttgtcaaggaaaggattccagttatgtgctcaaggtgtatctacactgggccgggcgcggtggctcacgcctgtcatcccagcactttgggaggctgaggcaggtggatcacctgaggtcaggagtttgagaacagcaaggccaatatgctgaaaccctgtctctactaaaaatacaaaaattagccgggtgtggtggcgggcgactgtaatcccagctactcaggaggttgagacagaagaatggcttgaacccaggaggtggaggttgcagtgagccgagatcatgccattgcactccagcctgggcaaaaagagcaataatccttctcaaacaaacaaacaaacaaaaaaagtatccacactgcagcgtggaccagaagagatgaccttccagtgagcacacgaggtcctctcacaaagcggcgagtgttcccagttattactcggagggccgggcctgctcaggagggttggtgagatcaggctgtcccctaacacacaccatggcagggctcatcctcctgagtacatgcaaggtgcactgagccggctccccatggaactccaaaaatagcccagctgggaagaaatggaacgttctgggggacactgattttcacattgaaatttcctatctttttaaatttattttggttgagacagtcgcccaggctattgcccagcctggagtgcagtggcatgatcgtagcttatggcagcctcagcctccttgggctcaagcgatccttcagcctcagcctcccaagtagctgtgaccacacacgtgtgccaccacgtctggcttttttttttttttttagagacagcatctctctccttgttgcacaggctggagtgcagtggtgcgatcacgtttcacagcagcctccaactcccaggctcaagtgatcctcccacctcagcctcctgtgtaactgggactacaaatgcacaccttatgtccagctaatttttttattgttactagagacaaggtctcattatgttgaccaggctggtctcaaacccctgagttcaagtgatcctactgacttagcctcccaaagtgcaggtattacaagcatgagccaccacacccagcctatttttattttatttttgtaggcacaggatctcgctgtttgcccaggctgatctcaaactcctggtctcaaaaatcatcctcctgcctcagcctcccaaagtgctgggatgacaggtgtgagccattgtgcccggcctcataccatttttgaatcatgaaactttattattctttgcagtttttcccccaagaatttagacatgtaagaagcaaaccaacaccttttaaaacttaaacataattcctagcttgtggatccagttttggaagcgatttaaattctagaaagcctgcagtaaactggctatttgatacgttctcagagttcctgcctttccagttaaacacaaataaaataggagtccggtgacctcgaacaccccagggtaagaacgcacaagctaaaagccagttggagcctgaatgtgaaaaggcaatcgttccttctgcatcaaaacatctgcacccacgggtccacccgtcagccaaaagccacctcagcaatgctaccaaaacagggaaaagaaaggctaccctctttctttcatgcaagccctctaagataacgcacaacctactagctcacgtaaattagggcacaaagaacccaactgaaatcccggcagaacaagcacaacttctgcttaatcatgaacttatttatttatttagagacagggtgtctctcactctggtgcccaggctgcacgacagtgatgcaatctcagctcactgcagcctcgactttgtgggctccagtgatcctcccacctcagccacccaggtagctgtgaccacacacgcgtggcaccatgtttggctaatttttatttttataattttagacacagcatctctcgcttggtttcccaggctgtgatcacagctcactgcagcctccaactcccacgctcaagtgatcctcccacctctgcctcctcagtagctgggactacaggcacgctctcactttttgtatttttagtagagatgaggtttggccatgttacccaggctggtctcaaactcctgggctcaagcgatccaccggcctcggcctcccaaagtgctgggatcacaggcatgagagccaccgcggctggccatgcagctgttttaataagcaattctgagaagacacaaatgccactctgctcttttgtgataatattaacacagattactgaattacagtgacaaaaacttcatatgtattacctaaggaaacacagagcccccagtgttagatctgaactctttctccacccaggacgaataagtggattccaattagtgcctcaaaaaaaaaaaaaaagaaaaaagtagcaagaaaaaaaaagaacagtagagcagtttccacaaacgccagcccttatttttggaaggcccacttgccaagaa
